United States Patent 12,617,821 (ENGINEERED VIRAL CAPSID POLYPEPTIDES AND USES THEREOF) - sequence listing, part 2

SEQ ID NO: 23064 - protein, 30 aa, Artificial Sequence
  Description of Artificial Sequence: Synthetic polypeptide
DEEEIRTTNPVATEQYGSVSTNDQQRGNDV

SEQ ID NO: 23065 - protein, 29 aa, Artificial Sequence
  Description of Artificial Sequence: Synthetic peptide
MENEIRTTNPVATEQYGSVSTNLQRGNDT

SEQ ID NO: 23066 - protein, 31 aa, Artificial Sequence
  Description of Artificial Sequence: Synthetic polypeptide
DEQEIRTTNPVATEQYGDSVSTNNLQERGNR

SEQ ID NO: 23067 - protein, 28 aa, Artificial Sequence
  Description of Artificial Sequence: Synthetic peptide
DEEEISTVNPVSTEQYGSVSTELQRGNR

SEQ ID NO: 23068 - protein, 28 aa, Artificial Sequence
  Description of Artificial Sequence: Synthetic peptide
REEEIATTNPCATEQYGSVSCNLQRGNR

SEQ ID NO: 23069 - protein, 29 aa, Artificial Sequence
  Description of Artificial Sequence: Synthetic peptide
DEEEIRTTNPVATEQYGSVSTDLEHGENR

SEQ ID NO: 23070 - protein, 31 aa, Artificial Sequence
  Description of Artificial Sequence: Synthetic polypeptide
DEEEIRTTNPVATEQYGSVSTNLQDREGNDD

SEQ ID NO: 23071 - protein, 29 aa, Artificial Sequence
  Description of Artificial Sequence: Synthetic peptide
DEEEIRTTNPVATEQYMSVSTNSQPRGRR

SEQ ID NO: 23072 - protein, 28 aa, Artificial Sequence
  Description of Artificial Sequence: Synthetic peptide
DEEEIRTTNPVATEQYGSVSTDLEPGNV

SEQ ID NO: 23073 - protein, 28 aa, Artificial Sequence
  Description of Artificial Sequence: Synthetic peptide
DEEEIRTTNIVATEQYGSVSTNLEQGER

SEQ ID NO: 23074 - protein, 30 aa, Artificial Sequence
  Description of Artificial Sequence: Synthetic polypeptide
DEEEIRTTNPVATEQYGSVSTNLQEVGNDA

SEQ ID NO: 23075 - protein, 30 aa, Artificial Sequence
  Description of Artificial Sequence: Synthetic polypeptide
DEELIRTTNPVATEQYGSVSTNLWYREGNR

SEQ ID NO: 23076 - protein, 28 aa, Artificial Sequence
  Description of Artificial Sequence: Synthetic peptide
YEEEIRTTNPVATEQYGSVSTPLQTGNI

SEQ ID NO: 23077 - protein, 29 aa, Artificial Sequence
  Description of Artificial Sequence: Synthetic peptide
DEQEIATTNPVATEQYGSVSAENLQRGNR

SEQ ID NO: 23078 - protein, 28 aa, Artificial Sequence
  Description of Artificial Sequence: Synthetic peptide
DEEEIRTTNPVATEQYGHVSTIIQRGER

SEQ ID NO: 23079 - protein, 28 aa, Artificial Sequence
  Description of Artificial Sequence: Synthetic peptide
DEQEIATTNPVATEQYGSVSTNVQRGGR

SEQ ID NO: 23080 - protein, 29 aa, Artificial Sequence
  Description of Artificial Sequence: Synthetic peptide
DEEEIRTTNPVATEQYGSVSTNLQAEGEE

SEQ ID NO: 23081 - protein, 28 aa, Artificial Sequence
  Description of Artificial Sequence: Synthetic peptide
DEEEIRTTNPVATEQYGMVSDELQRGNV

SEQ ID NO: 23082 - protein, 28 aa, Artificial Sequence
  Description of Artificial Sequence: Synthetic peptide
DENEIRTTNPVATEQSGSVSTNLQKGNF

SEQ ID NO: 23083 - protein, 29 aa, Artificial Sequence
  Description of Artificial Sequence: Synthetic peptide
DEEEIRSTNPVATEQYGSVSATNLEPGNR

SEQ ID NO: 23084 - protein, 28 aa, Artificial Sequence
  Description of Artificial Sequence: Synthetic peptide
DEEEIRTTNPVATEQWGSVSTNLEVGNW

SEQ ID NO: 23085 - protein, 28 aa, Artificial Sequence
  Description of Artificial Sequence: Synthetic peptide
DEEEIRTTNPVATEQFGSVSTNPQLGNS

SEQ ID NO: 23086 - protein, 30 aa, Artificial Sequence
  Description of Artificial Sequence: Synthetic polypeptide
DEEEIRTTNPVATEQYGSVSTCNLQEQGNQ

SEQ ID NO: 23087 - protein, 29 aa, Artificial Sequence
  Description of Artificial Sequence: Synthetic peptide
DEEEIRTTNPVATEQYGDASTNLQERENR

SEQ ID NO: 23088 - protein, 28 aa, Artificial Sequence
  Description of Artificial Sequence: Synthetic peptide
KEEEIRTTNPVATECYGSVSTNLQQGNS

SEQ ID NO: 23089 - protein, 30 aa, Artificial Sequence
  Description of Artificial Sequence: Synthetic polypeptide
DEEEIRTTNPVATEQYGSVSATDLQMGGNR

SEQ ID NO: 23090 - protein, 28 aa, Artificial Sequence
  Description of Artificial Sequence: Synthetic peptide
DEEEIRTTNPDATECYGSVSTNLQNENR

SEQ ID NO: 23091 - protein, 28 aa, Artificial Sequence
  Description of Artificial Sequence: Synthetic peptide
DEEEIRTTNPVATEQYGSVSTNLETGEL

SEQ ID NO: 23092 - protein, 28 aa, Artificial Sequence
  Description of Artificial Sequence: Synthetic peptide
DEEEIRTTNPVATEMYGSVSENLQFGNE

SEQ ID NO: 23093 - protein, 28 aa, Artificial Sequence
  Description of Artificial Sequence: Synthetic peptide
DEEEIRCTNPCATEQYGCVSTNLQRGNG

SEQ ID NO: 23094 - protein, 32 aa, Artificial Sequence
  Description of Artificial Sequence: Synthetic polypeptide
DEEEIRTTNPVATEQYGSVSTCNLQDREGDNR

SEQ ID NO: 23095 - protein, 28 aa, Artificial Sequence
  Description of Artificial Sequence: Synthetic peptide
DEEEIRTTNPVATEQYGSASECLQKGNR

SEQ ID NO: 23096 - protein, 28 aa, Artificial Sequence
  Description of Artificial Sequence: Synthetic peptide
DEEEIRTTNPVATEQWGSVNENLQRGNH

SEQ ID NO: 23097 - protein, 28 aa, Artificial Sequence
  Description of Artificial Sequence: Synthetic peptide
MEQEIRTTNPVATEQYGSVSTNLQTGNV

SEQ ID NO: 23098 - protein, 28 aa, Artificial Sequence
  Description of Artificial Sequence: Synthetic peptide
DEEEIRTTNPVATEQYGSVSENLNEDNR

SEQ ID NO: 23099 - protein, 28 aa, Artificial Sequence
  Description of Artificial Sequence: Synthetic peptide
DEEEIRTTNPVATEQSGSVSTNTQVGNI

SEQ ID NO: 23100 - protein, 28 aa, Artificial Sequence
  Description of Artificial Sequence: Synthetic peptide
DEGEIRTTNPVATEGYGSVAENLQRGNR

SEQ ID NO: 23101 - protein, 28 aa, Artificial Sequence
  Description of Artificial Sequence: Synthetic peptide
MENEIRTTNPVATEQYGSVSTDLQHGNR

SEQ ID NO: 23102 - protein, 28 aa, Artificial Sequence
  Description of Artificial Sequence: Synthetic peptide
DESEVRTTNPVATEQYGSVSTNLQRETR

SEQ ID NO: 23103 - protein, 28 aa, Artificial Sequence
  Description of Artificial Sequence: Synthetic peptide
DEEEIRTCNPVATEQYGSVSTNLQRNQE

SEQ ID NO: 23104 - protein, 29 aa, Artificial Sequence
  Description of Artificial Sequence: Synthetic peptide
DEEEIRTTNPVATECYGSVSTDLQRDGNA

SEQ ID NO: 23105 - protein, 28 aa, Artificial Sequence
  Description of Artificial Sequence: Synthetic peptide
DEQELRTTNPVATEIYGSVSNNLQRGNR

SEQ ID NO: 23106 - protein, 28 aa, Artificial Sequence
  Description of Artificial Sequence: Synthetic peptide
NEEEVRCTNPVATEQYGSVSMNLQRGNR

SEQ ID NO: 23107 - protein, 30 aa, Artificial Sequence
  Description of Artificial Sequence: Synthetic polypeptide
DEEEIRTTNPVATEQYGSVVLTELQLRGNR

SEQ ID NO: 23108 - protein, 28 aa, Artificial Sequence
  Description of Artificial Sequence: Synthetic peptide
DEEEIRTTNPVATEIYGSVSTNLQNGPV

SEQ ID NO: 23109 - protein, 28 aa, Artificial Sequence
  Description of Artificial Sequence: Synthetic peptide
DEEEIRTTNPVATEQYGSVSENEQQGNF

SEQ ID NO: 23110 - protein, 29 aa, Artificial Sequence
  Description of Artificial Sequence: Synthetic peptide
DEEEIRTTNPVATELYGSVTTNLQQGNSR

SEQ ID NO: 23111 - protein, 28 aa, Artificial Sequence
  Description of Artificial Sequence: Synthetic peptide
DEEEIRTTNPVATEQYGSVSTEQIRGNV

SEQ ID NO: 23112 - protein, 28 aa, Artificial Sequence
  Description of Artificial Sequence: Synthetic peptide
DEQEIRATNPVATEVYGWVSTNLQRGNR

SEQ ID NO: 23113 - protein, 30 aa, Artificial Sequence
  Description of Artificial Sequence: Synthetic polypeptide
DENEIRTTNPVATEQYGSVSTNLVQRNGNS

SEQ ID NO: 23114 - protein, 29 aa, Artificial Sequence
  Description of Artificial Sequence: Synthetic peptide
DEEEIRTTNPVATEQYGSVDTNGLQPGER

SEQ ID NO: 23115 - protein, 31 aa, Artificial Sequence
  Description of Artificial Sequence: Synthetic polypeptide
DEEEIRTTNPVATEQYGSVDDDTNLQREGNR

SEQ ID NO: 23116 - protein, 28 aa, Artificial Sequence
  Description of Artificial Sequence: Synthetic peptide
YEEEIRTTNPFATEQYGSVSTNLQDGNE

SEQ ID NO: 23117 - protein, 29 aa, Artificial Sequence
  Description of Artificial Sequence: Synthetic peptide
DEEEIRTTNPVATEQYGSVSTNLMMQGNF

SEQ ID NO: 23118 - protein, 30 aa, Artificial Sequence
  Description of Artificial Sequence: Synthetic polypeptide
DEEEIRTTNPVATEQYGSVSTNLVQEHGNI

SEQ ID NO: 23119 - protein, 29 aa, Artificial Sequence
  Description of Artificial Sequence: Synthetic peptide
DEEEIRTTNPVATEQYGSMVSETLQRGNW

SEQ ID NO: 23120 - protein, 30 aa, Artificial Sequence
  Description of Artificial Sequence: Synthetic polypeptide
DEEEIRTTNPVATEQYGSVSTMNLQYGNDQ

SEQ ID NO: 23121 - protein, 28 aa, Artificial Sequence
  Description of Artificial Sequence: Synthetic peptide
DEEEIRTTNPVATEQYGSVVDNLQIFNR

SEQ ID NO: 23122 - protein, 28 aa, Artificial Sequence
  Description of Artificial Sequence: Synthetic peptide
DEEEIRTTNPVSTEHYGNVGTNLQRGNR

SEQ ID NO: 23123 - protein, 28 aa, Artificial Sequence
  Description of Artificial Sequence: Synthetic peptide
DEEEIRTTNPVATEQYGSVSENLQHGDA

SEQ ID NO: 23124 - protein, 28 aa, Artificial Sequence
  Description of Artificial Sequence: Synthetic peptide
DEEEIAATNPVATEQFGSVSTNLQRGDR

SEQ ID NO: 23125 - protein, 28 aa, Artificial Sequence
  Description of Artificial Sequence: Synthetic peptide
DENEIRTTNPVATEQWGSVSTNEQRGNF

SEQ ID NO: 23126 - protein, 28 aa, Artificial Sequence
  Description of Artificial Sequence: Synthetic peptide
DEQEIRTTNPVATEQYGSVSDNLQVGNT

SEQ ID NO: 23127 - protein, 28 aa, Artificial Sequence
  Description of Artificial Sequence: Synthetic peptide
DEEEIRTTNPVATEQYGSVATNLQALNH

SEQ ID NO: 23128 - protein, 28 aa, Artificial Sequence
  Description of Artificial Sequence: Synthetic peptide
DEQEIRTTNPVATEQYGSVDENLQRGNE

SEQ ID NO: 23129 - protein, 28 aa, Artificial Sequence
  Description of Artificial Sequence: Synthetic peptide
DEEEIRTTNIVATECYGSVSTNIQLGNR

SEQ ID NO: 23130 - protein, 28 aa, Artificial Sequence
  Description of Artificial Sequence: Synthetic peptide
DEEEIRCTNPVASEIYGAVSTNLQRGNR

SEQ ID NO: 23131 - protein, 28 aa, Artificial Sequence
  Description of Artificial Sequence: Synthetic peptide
DEEEIRTTNPVATEQYGSVSTDLQIGES

SEQ ID NO: 23132 - protein, 28 aa, Artificial Sequence
  Description of Artificial Sequence: Synthetic peptide
DEMEIRTTNPVATEQFGSVPTNVQRGNR

SEQ ID NO: 23133 - protein, 28 aa, Artificial Sequence
  Description of Artificial Sequence: Synthetic peptide
DEEEIRTTNPVATECYGSVSTNLEGGDR

SEQ ID NO: 23134 - protein, 28 aa, Artificial Sequence
  Description of Artificial Sequence: Synthetic peptide
DEEKIRTTNPVATETYGSVSGNLQPGNR

SEQ ID NO: 23135 - protein, 29 aa, Artificial Sequence
  Description of Artificial Sequence: Synthetic peptide
SEEEIRTTNPTATEQYGSVSTMNLQQGNR

SEQ ID NO: 23136 - protein, 28 aa, Artificial Sequence
  Description of Artificial Sequence: Synthetic peptide
DEEEIATTNPVATEQYGDASTNLQRGER

SEQ ID NO: 23137 - protein, 28 aa, Artificial Sequence
  Description of Artificial Sequence: Synthetic peptide
DEEEIRQTNPVATEGYGSVPTVLQRGNR

SEQ ID NO: 23138 - protein, 30 aa, Artificial Sequence
  Description of Artificial Sequence: Synthetic polypeptide
DEEEIRTTNPVATEQYGSVSTVNLQAGDPR

SEQ ID NO: 23139 - protein, 30 aa, Artificial Sequence
  Description of Artificial Sequence: Synthetic polypeptide
DEVEIRTTNPVATEQYGVVSTNLQREGENR

SEQ ID NO: 23140 - protein, 28 aa, Artificial Sequence
  Description of Artificial Sequence: Synthetic peptide
DEEEIRTTNPDATEQYGCVSTPLQRGNT

SEQ ID NO: 23141 - protein, 28 aa, Artificial Sequence
  Description of Artificial Sequence: Synthetic peptide
DEEEIRTTNIVATEQFGSVSENLQNGNR

SEQ ID NO: 23142 - protein, 29 aa, Artificial Sequence
  Description of Artificial Sequence: Synthetic peptide
DEEEIRTTNPVATETYGWVSTELQREGNR

SEQ ID NO: 23143 - protein, 28 aa, Artificial Sequence
  Description of Artificial Sequence: Synthetic peptide
DEEEIRPTNPVATEQYGSWSTNDQDGNR

SEQ ID NO: 23144 - protein, 28 aa, Artificial Sequence
  Description of Artificial Sequence: Synthetic peptide
DEEEIRTTNPEATEQYGSVSADLQRGPR

SEQ ID NO: 23145 - protein, 28 aa, Artificial Sequence
  Description of Artificial Sequence: Synthetic peptide
DEEEIRTTNPDATEQYGSVSTEEQRGER

SEQ ID NO: 23146 - protein, 30 aa, Artificial Sequence
  Description of Artificial Sequence: Synthetic polypeptide
DEEEIRTTNPVSTEQYGSVSATNLQRAGGR

SEQ ID NO: 23147 - protein, 28 aa, Artificial Sequence
  Description of Artificial Sequence: Synthetic peptide
DEEEIRAVNPVATEQYGTVSTNLQGGNR

SEQ ID NO: 23148 - protein, 28 aa, Artificial Sequence
  Description of Artificial Sequence: Synthetic peptide
DEEEIRTTNPVAYEQYGSVSFNFQRGNY

SEQ ID NO: 23149 - protein, 28 aa, Artificial Sequence
  Description of Artificial Sequence: Synthetic peptide
DEQEIRTTNPVATEQYGSVSENLERGNN

SEQ ID NO: 23150 - protein, 28 aa, Artificial Sequence
  Description of Artificial Sequence: Synthetic peptide
DEEEIRTTNPVATEQYGSVSDNLQNGQT

SEQ ID NO: 23151 - protein, 28 aa, Artificial Sequence
  Description of Artificial Sequence: Synthetic peptide
DDEEIRTVNPVATEQYGWVATNLQRGNR

SEQ ID NO: 23152 - protein, 31 aa, Artificial Sequence
  Description of Artificial Sequence: Synthetic polypeptide
DEEEIRTTNPVATEQYGSVSTNLQEREGEER

SEQ ID NO: 23153 - protein, 29 aa, Artificial Sequence
  Description of Artificial Sequence: Synthetic peptide
DEEEIRTTNPVATEQYGSHVSENEQRENR

SEQ ID NO: 23154 - protein, 30 aa, Artificial Sequence
  Description of Artificial Sequence: Synthetic polypeptide
DEEEIRTTNPVATEQYGSVDTMNLQRGNDA

SEQ ID NO: 23155 - protein, 29 aa, Artificial Sequence
  Description of Artificial Sequence: Synthetic peptide
DEEEIRTTNPVATEQYGSASTNLQHGNDQ

SEQ ID NO: 23156 - protein, 28 aa, Artificial Sequence
  Description of Artificial Sequence: Synthetic peptide
MEEMISTTNPVATEQYGEVSTNLQRGNR

SEQ ID NO: 23157 - protein, 28 aa, Artificial Sequence
  Description of Artificial Sequence: Synthetic peptide
DEDEIRTTNPVATECYGSVSTNLQLGNA

SEQ ID NO: 23158 - protein, 28 aa, Artificial Sequence
  Description of Artificial Sequence: Synthetic peptide
DEEELRTTNPVATELYGSVSTNEQRGNF

SEQ ID NO: 23159 - protein, 31 aa, Artificial Sequence
  Description of Artificial Sequence: Synthetic polypeptide
DEEEIRTTNPVATEIYGSVSETNLQLRGNDR

SEQ ID NO: 23160 - protein, 28 aa, Artificial Sequence
  Description of Artificial Sequence: Synthetic peptide
TEEEIRTTNPVATEQYGSSSDNAQRGNR

SEQ ID NO: 23161 - protein, 28 aa, Artificial Sequence
  Description of Artificial Sequence: Synthetic peptide
DEEEIRTTNPVATEQYGSVSTELEFGER

SEQ ID NO: 23162 - protein, 30 aa, Artificial Sequence
  Description of Artificial Sequence: Synthetic polypeptide
DEEEIRTTNPDATEQYGSVSATNLQMRGNN

SEQ ID NO: 23163 - protein, 28 aa, Artificial Sequence
  Description of Artificial Sequence: Synthetic peptide
DEEEIRTTNPVATELYGSVSTNLMQGNF

SEQ ID NO: 23164 - protein, 28 aa, Artificial Sequence
  Description of Artificial Sequence: Synthetic peptide
SEEEIRTTNPEATELYGSVSTNLQRGNF

SEQ ID NO: 23165 - protein, 28 aa, Artificial Sequence
  Description of Artificial Sequence: Synthetic peptide
NEEEIRTTNPVCTENYGSVATNLQRGNR

SEQ ID NO: 23166 - protein, 28 aa, Artificial Sequence
  Description of Artificial Sequence: Synthetic peptide
DEQEIATTNPVATEIYGSVATNLQRGNR

SEQ ID NO: 23167 - protein, 28 aa, Artificial Sequence
  Description of Artificial Sequence: Synthetic peptide
DENEIRTTNPVATECYGSVSTNLQHGNW

SEQ ID NO: 23168 - protein, 28 aa, Artificial Sequence
  Description of Artificial Sequence: Synthetic peptide
DEEEIRTTNPVATEQYGSVSTDLQVGEQ

SEQ ID NO: 23169 - protein, 28 aa, Artificial Sequence
  Description of Artificial Sequence: Synthetic peptide
DEEEIRTTNPVATEQYGSVSTELQHGDV

SEQ ID NO: 23170 - protein, 29 aa, Artificial Sequence
  Description of Artificial Sequence: Synthetic peptide
DEEEIATTNPAATEQYGGVSTNLQRGDNR

SEQ ID NO: 23171 - protein, 28 aa, Artificial Sequence
  Description of Artificial Sequence: Synthetic peptide
DEEEIRTTNPVATELYGSVDTNEQVGNR

SEQ ID NO: 23172 - protein, 28 aa, Artificial Sequence
  Description of Artificial Sequence: Synthetic peptide
SEEEIRTTNPVATEQYGSVSTNLQQGDF

SEQ ID NO: 23173 - protein, 28 aa, Artificial Sequence
  Description of Artificial Sequence: Synthetic peptide
DEEEIRCTNPTATECYGSVSTNLQRGNA

SEQ ID NO: 23174 - protein, 30 aa, Artificial Sequence
  Description of Artificial Sequence: Synthetic polypeptide
DEEEIRTTNPVATEQYGSVSENPLQEEGNR

SEQ ID NO: 23175 - protein, 29 aa, Artificial Sequence
  Description of Artificial Sequence: Synthetic peptide
DEEEIRTTNPFATEQYGSVSTANLIQGNR

SEQ ID NO: 23176 - protein, 28 aa, Artificial Sequence
  Description of Artificial Sequence: Synthetic peptide
DDEEIVATNPVATEQYGSVSTNLQRGNQ

SEQ ID NO: 23177 - protein, 28 aa, Artificial Sequence
  Description of Artificial Sequence: Synthetic peptide
DENEIRTTNPVATEQYGSVETCLQTGNR

SEQ ID NO: 23178 - protein, 30 aa, Artificial Sequence
  Description of Artificial Sequence: Synthetic polypeptide
DEEEIVTTNPVATEQYGSVSTNLQERGNDE

SEQ ID NO: 23179 - protein, 30 aa, Artificial Sequence
  Description of Artificial Sequence: Synthetic polypeptide
DEEEIRATNPVATEQYGSVSATALQREGNR

SEQ ID NO: 23180 - protein, 32 aa, Artificial Sequence
  Description of Artificial Sequence: Synthetic polypeptide
DEEEIRTTNPVATEQYGSVSITNLQRKGDNPR

SEQ ID NO: 23181 - protein, 28 aa, Artificial Sequence
  Description of Artificial Sequence: Synthetic peptide
DEEEIRTTNPVATECWGSVSTNEQRGNM

SEQ ID NO: 23182 - protein, 28 aa, Artificial Sequence
  Description of Artificial Sequence: Synthetic peptide
DEEEIRTTNPAATECYGSVSTNWQRGTR

SEQ ID NO: 23183 - protein, 28 aa, Artificial Sequence
  Description of Artificial Sequence: Synthetic peptide
KEEEIATTNPVATEQYGSASTNLQAGNR

SEQ ID NO: 23184 - protein, 29 aa, Artificial Sequence
  Description of Artificial Sequence: Synthetic peptide
DEEEIRTTNPVATECYGSVSTGNLQRENL

SEQ ID NO: 23185 - protein, 30 aa, Artificial Sequence
  Description of Artificial Sequence: Synthetic polypeptide
DEEEIRTTNPTATEQFGSVSTMNLQRGNTR

SEQ ID NO: 23186 - protein, 28 aa, Artificial Sequence
  Description of Artificial Sequence: Synthetic peptide
DEEEIRTTNPVATEQYGIVSENDQRGNY

SEQ ID NO: 23187 - protein, 28 aa, Artificial Sequence
  Description of Artificial Sequence: Synthetic peptide
DEEEIRTTNPVATECYGSVSTDLQYGNI

SEQ ID NO: 23188 - protein, 30 aa, Artificial Sequence
  Description of Artificial Sequence: Synthetic polypeptide
DEEYIKTTNPVATEQYGSVSTNLQRFGNVR

SEQ ID NO: 23189 - protein, 31 aa, Artificial Sequence
  Description of Artificial Sequence: Synthetic polypeptide
DEEEIRTTNPVATEQYGSYVSTMNLQMGNDR

SEQ ID NO: 23190 - protein, 28 aa, Artificial Sequence
  Description of Artificial Sequence: Synthetic peptide
DEEEIRTTNPVATEQYGSVSTNLTQGED

SEQ ID NO: 23191 - protein, 28 aa, Artificial Sequence
  Description of Artificial Sequence: Synthetic peptide
DEEEIRTTNIVATEQYGSVSTNLQVEER

SEQ ID NO: 23192 - protein, 30 aa, Artificial Sequence
  Description of Artificial Sequence: Synthetic polypeptide
DEEEIRTTNPVATEQYGSVSTGNLDRGEDR

SEQ ID NO: 23193 - protein, 28 aa, Artificial Sequence
  Description of Artificial Sequence: Synthetic peptide
DEQEIRCTNPVATEMYGSVSTNLQVGNR

SEQ ID NO: 23194 - protein, 28 aa, Artificial Sequence
  Description of Artificial Sequence: Synthetic peptide
DENEIRTTNPVATEQYGSVSTELQHGER

SEQ ID NO: 23195 - protein, 28 aa, Artificial Sequence
  Description of Artificial Sequence: Synthetic peptide
DENEIRTTNIVATEQYGSVSDNLQSGNR

SEQ ID NO: 23196 - protein, 28 aa, Artificial Sequence
  Description of Artificial Sequence: Synthetic peptide
DEEEIRTTNPVATEQYGSVFTDDQRGNA

SEQ ID NO: 23197 - protein, 30 aa, Artificial Sequence
  Description of Artificial Sequence: Synthetic polypeptide
DEQEIRTTNPVATEQYGSVSETNLQDRGNL

SEQ ID NO: 23198 - protein, 28 aa, Artificial Sequence
  Description of Artificial Sequence: Synthetic peptide
AEEEITTVNPVATEVYGSVSTNLQRGNR

SEQ ID NO: 23199 - protein, 29 aa, Artificial Sequence
  Description of Artificial Sequence: Synthetic peptide
YEEEIRTTNPVATEQYGSVSTNLQQRLNA

SEQ ID NO: 23200 - protein, 29 aa, Artificial Sequence
  Description of Artificial Sequence: Synthetic peptide
DEEEIRTTNPVATECYGSVSTDLQQGNDR

SEQ ID NO: 23201 - protein, 30 aa, Artificial Sequence
  Description of Artificial Sequence: Synthetic polypeptide
DEEEIRTTNPVATEQYGSVDTNLQHAEGNR

SEQ ID NO: 23202 - protein, 28 aa, Artificial Sequence
  Description of Artificial Sequence: Synthetic peptide
DEEEIRTTNPVATEQYGSVSTNDEIENR

SEQ ID NO: 23203 - protein, 28 aa, Artificial Sequence
  Description of Artificial Sequence: Synthetic peptide
DEEEIRTTNPVATEQYGSVSTELEVGND

SEQ ID NO: 23204 - protein, 30 aa, Artificial Sequence
  Description of Artificial Sequence: Synthetic polypeptide
DEEEIRTTNPVATEQYGSVSTNLQERNGED

SEQ ID NO: 23205 - protein, 28 aa, Artificial Sequence
  Description of Artificial Sequence: Synthetic peptide
DEQEIRTTNPVATEQYGSVSTNDDRGNG

SEQ ID NO: 23206 - protein, 29 aa, Artificial Sequence
  Description of Artificial Sequence: Synthetic peptide
DEEEIRTTNPVATEQYGSWSTNLQERENN

SEQ ID NO: 23207 - protein, 30 aa, Artificial Sequence
  Description of Artificial Sequence: Synthetic polypeptide
DEEEIRTTNPVATEQYGSVDSTPGQERGNR

SEQ ID NO: 23208 - protein, 28 aa, Artificial Sequence
  Description of Artificial Sequence: Synthetic peptide
DEEEIGTTNPVATELYGSVSTNPQRGNN

SEQ ID NO: 23209 - protein, 28 aa, Artificial Sequence
  Description of Artificial Sequence: Synthetic peptide
DENEIRTTNPVATEQYGSVSTNEMRGNM

SEQ ID NO: 23210 - protein, 29 aa, Artificial Sequence
  Description of Artificial Sequence: Synthetic peptide
DEEEIRTTNPVATEQYGSVDTNLQQHGNA

SEQ ID NO: 23211 - protein, 29 aa, Artificial Sequence
  Description of Artificial Sequence: Synthetic peptide
DEVEIRTTNPVATEQYGSVSTGLPQQGNR

SEQ ID NO: 23212 - protein, 29 aa, Artificial Sequence
  Description of Artificial Sequence: Synthetic peptide
DEEEIRTTNPVATEQYGSIQSTNLIRGWR

SEQ ID NO: 23213 - protein, 29 aa, Artificial Sequence
  Description of Artificial Sequence: Synthetic peptide
DEQEIRTTNPVATEQYGEVSADNLQRGNR

SEQ ID NO: 23214 - protein, 30 aa, Artificial Sequence
  Description of Artificial Sequence: Synthetic polypeptide
DEEEIRTTNPVATEQYGSVSTNLDREGNDD

SEQ ID NO: 23215 - protein, 30 aa, Artificial Sequence
  Description of Artificial Sequence: Synthetic polypeptide
DEEEIRTTNPVATEQYGSVSTNLERDGNED

SEQ ID NO: 23216 - protein, 28 aa, Artificial Sequence
  Description of Artificial Sequence: Synthetic peptide
DESEIRTTNPVATEQWGSVSTNGQRPNR

SEQ ID NO: 23217 - protein, 29 aa, Artificial Sequence
  Description of Artificial Sequence: Synthetic peptide
DEEEIRTTNPVATEQYGIVSDNLQYRGQR

SEQ ID NO: 23218 - protein, 28 aa, Artificial Sequence
  Description of Artificial Sequence: Synthetic peptide
DEEEITTTNPVATEQYGSVSVNLQRGDF

SEQ ID NO: 23219 - protein, 28 aa, Artificial Sequence
  Description of Artificial Sequence: Synthetic peptide
DEEEIATTNIVCTEQYGSVSTNLQRGND

SEQ ID NO: 23220 - protein, 28 aa, Artificial Sequence
  Description of Artificial Sequence: Synthetic peptide
MEEEIRTTNPVATEQYGSVSTNLQVGDH

SEQ ID NO: 23221 - protein, 29 aa, Artificial Sequence
  Description of Artificial Sequence: Synthetic peptide
DEEEIRTTNPVATEQYGSVSTNLQEGGDC

SEQ ID NO: 23222 - protein, 28 aa, Artificial Sequence
  Description of Artificial Sequence: Synthetic peptide
DEEEIATTNPVATEQYGSVSTDPQRPNR

SEQ ID NO: 23223 - protein, 28 aa, Artificial Sequence
  Description of Artificial Sequence: Synthetic peptide
DEEEISTTNPVATEQYGAVSTNLQQGNS

SEQ ID NO: 23224 - protein, 29 aa, Artificial Sequence
  Description of Artificial Sequence: Synthetic peptide
DEEEIRTTNPVATEQFGSVSTNLQERGTN

SEQ ID NO: 23225 - protein, 30 aa, Artificial Sequence
  Description of Artificial Sequence: Synthetic polypeptide
DEEEIRTTNPVATEQYGSHYSTNLQRGLNA

SEQ ID NO: 23226 - protein, 29 aa, Artificial Sequence
  Description of Artificial Sequence: Synthetic peptide
DEEEIRTTNPVATEQYGSVSTGLEDGNDR

SEQ ID NO: 23227 - protein, 28 aa, Artificial Sequence
  Description of Artificial Sequence: Synthetic peptide
AEEEIRQTNPVATEQYGSVSTALQRGNP

SEQ ID NO: 23228 - protein, 31 aa, Artificial Sequence
  Description of Artificial Sequence: Synthetic polypeptide
DEEEIRTTNPVATEQYGSVSITGLQRNGNDR

SEQ ID NO: 23229 - protein, 29 aa, Artificial Sequence
  Description of Artificial Sequence: Synthetic peptide
DEEEIRTTNPVATEIYGVVSTDLQRGNDR

SEQ ID NO: 23230 - protein, 28 aa, Artificial Sequence
  Description of Artificial Sequence: Synthetic peptide
DMEEIRTTNPVATEQYGSVSTGLQHGTR

SEQ ID NO: 23231 - protein, 30 aa, Artificial Sequence
  Description of Artificial Sequence: Synthetic polypeptide
DEEEIRTTNPVATEQYWGSVSTNLQEPGER

SEQ ID NO: 23232 - protein, 30 aa, Artificial Sequence
  Description of Artificial Sequence: Synthetic polypeptide
DEEEIRTTNPVATEQYGSVSTMNLQHGNDS

SEQ ID NO: 23233 - protein, 28 aa, Artificial Sequence
  Description of Artificial Sequence: Synthetic peptide
DEEEIRTTNPDATEQYGSVSTLLQREND

SEQ ID NO: 23234 - protein, 28 aa, Artificial Sequence
  Description of Artificial Sequence: Synthetic peptide
DEEEIRTTNPTATEQYGSVSTNEQIGNL

SEQ ID NO: 23235 - protein, 28 aa, Artificial Sequence
  Description of Artificial Sequence: Synthetic peptide
DENEIRTTNPVAYEQSGSVSTNLQPGNR

SEQ ID NO: 23236 - protein, 28 aa, Artificial Sequence
  Description of Artificial Sequence: Synthetic peptide
DEEEIATTNPVATECYGSVSTNLQQGNF

SEQ ID NO: 23237 - protein, 29 aa, Artificial Sequence
  Description of Artificial Sequence: Synthetic peptide
DEGEIRTTNPVATEQYGCVSTNLQRGLNN

SEQ ID NO: 23238 - protein, 29 aa, Artificial Sequence
  Description of Artificial Sequence: Synthetic peptide
DEEEIRTTNPVATEQYGSVSTNLYPWGNM

SEQ ID NO: 23239 - protein, 28 aa, Artificial Sequence
  Description of Artificial Sequence: Synthetic peptide
DEEEIRTTNPVATECYGDVSTNLDDGNR

SEQ ID NO: 23240 - protein, 28 aa, Artificial Sequence
  Description of Artificial Sequence: Synthetic peptide
DTEEIRTTNPVATEQYGSWSTNDQRGNP

SEQ ID NO: 23241 - protein, 30 aa, Artificial Sequence
  Description of Artificial Sequence: Synthetic polypeptide
DEEEIRTTNPVATEQYGSVSTNLQEQGNDS

SEQ ID NO: 23242 - protein, 28 aa, Artificial Sequence
  Description of Artificial Sequence: Synthetic peptide
DEEEIRTTNPVATEMYGSVSENLQQGTR

SEQ ID NO: 23243 - protein, 30 aa, Artificial Sequence
  Description of Artificial Sequence: Synthetic polypeptide
DEEEIRTTNPDATEQYGSVSTTNLQVRGER

SEQ ID NO: 23244 - protein, 28 aa, Artificial Sequence
  Description of Artificial Sequence: Synthetic peptide
HEEEIRTTNPCATEQYGSVSTNLQEGND

SEQ ID NO: 23245 - protein, 28 aa, Artificial Sequence
  Description of Artificial Sequence: Synthetic peptide
DEEEIKTTNPVATEQYGSVSTNLNGGNL

SEQ ID NO: 23246 - protein, 28 aa, Artificial Sequence
  Description of Artificial Sequence: Synthetic peptide
SEEEIRTTNPVAIEQWGSVSTNLQEGNR

SEQ ID NO: 23247 - protein, 29 aa, Artificial Sequence
  Description of Artificial Sequence: Synthetic peptide
DEEEIRTTNPVATEQYGSVSCENLQQGNQ

SEQ ID NO: 23248 - protein, 30 aa, Artificial Sequence
  Description of Artificial Sequence: Synthetic polypeptide
DEEEIRTTNPVATEIYGSVSSTNLQINGNR

SEQ ID NO: 23249 - protein, 29 aa, Artificial Sequence
  Description of Artificial Sequence: Synthetic peptide
DEEEIRTTNPVATEQWGDVSTNLQNRGNA

SEQ ID NO: 23250 - protein, 29 aa, Artificial Sequence
  Description of Artificial Sequence: Synthetic peptide
DEEEIRTTNPVATEQYGSVSENPQEQGNR

SEQ ID NO: 23251 - protein, 31 aa, Artificial Sequence
  Description of Artificial Sequence: Synthetic polypeptide
DEEEIRTTNPVATEQYGSVYSTNGLQQGVNR

SEQ ID NO: 23252 - protein, 28 aa, Artificial Sequence
  Description of Artificial Sequence: Synthetic peptide
DEEEIRCTNPVCTEQYGSVSDNIQRGNR

SEQ ID NO: 23253 - protein, 28 aa, Artificial Sequence
  Description of Artificial Sequence: Synthetic peptide
DEEEIRTTNPVATEQYGSVDTELQVGNT

SEQ ID NO: 23254 - protein, 28 aa, Artificial Sequence
  Description of Artificial Sequence: Synthetic peptide
DEEEIRTTNPEATEQYGSVSTDEQRGNM

SEQ ID NO: 23255 - protein, 29 aa, Artificial Sequence
  Description of Artificial Sequence: Synthetic peptide
DEEEIRTTNPEATEQYGSVSTNLQITGNH

SEQ ID NO: 23256 - protein, 31 aa, Artificial Sequence
  Description of Artificial Sequence: Synthetic polypeptide
DEEEIRTTNPVATEQYGSVSTMNLQLREGNQ

SEQ ID NO: 23257 - protein, 30 aa, Artificial Sequence
  Description of Artificial Sequence: Synthetic polypeptide
DEEEIRTTNPVATEQYGSVSTINLQYKGNG

SEQ ID NO: 23258 - protein, 28 aa, Artificial Sequence
  Description of Artificial Sequence: Synthetic peptide
DEEEISQTNPVATEQYGEVSENLQRGNR

SEQ ID NO: 23259 - protein, 28 aa, Artificial Sequence
  Description of Artificial Sequence: Synthetic peptide
DEEEIATTNIVATEQYGSVSTDFQRGNR

SEQ ID NO: 23260 - protein, 28 aa, Artificial Sequence
  Description of Artificial Sequence: Synthetic peptide
AEEEIRTTNIVATEQYGSVSTNLQRGEH

SEQ ID NO: 23261 - protein, 29 aa, Artificial Sequence
  Description of Artificial Sequence: Synthetic peptide
DEEEIRTTNPVATEIYGSVSTNPLQFGER

SEQ ID NO: 23262 - protein, 28 aa, Artificial Sequence
  Description of Artificial Sequence: Synthetic peptide
DEEEIVTTNPVATEQYGSVSTNEQSGNL

SEQ ID NO: 23263 - protein, 30 aa, Artificial Sequence
  Description of Artificial Sequence: Synthetic polypeptide
DEEEIRTTNPVATEQYGSVTSTCNLQAGNG

SEQ ID NO: 23264 - protein, 29 aa, Artificial Sequence
  Description of Artificial Sequence: Synthetic peptide
DEEEIRTTNPVCTEVYGSVSTNLQRFGNM

SEQ ID NO: 23265 - protein, 29 aa, Artificial Sequence
  Description of Artificial Sequence: Synthetic peptide
DEEEIRTTNPVATEQYGSVSTNDQDQGNQ

SEQ ID NO: 23266 - protein, 28 aa, Artificial Sequence
  Description of Artificial Sequence: Synthetic peptide
DEEEIRCTNPVATEQYGTVSTNWQRGNF

SEQ ID NO: 23267 - protein, 29 aa, Artificial Sequence
  Description of Artificial Sequence: Synthetic peptide
DENEIRTTNPVATEQYGSVSTNLQDTGNL

SEQ ID NO: 23268 - protein, 28 aa, Artificial Sequence
  Description of Artificial Sequence: Synthetic peptide
DEEEIRTTNPVATEQYGSVSDNLQHGEN

SEQ ID NO: 23269 - protein, 28 aa, Artificial Sequence
  Description of Artificial Sequence: Synthetic peptide
HEHEIRTTNPVATEQYGYVSENLQRGNR

SEQ ID NO: 23270 - protein, 28 aa, Artificial Sequence
  Description of Artificial Sequence: Synthetic peptide
DDEEIRTTNPVATEQYGSVSTNEQQGTR

SEQ ID NO: 23271 - protein, 29 aa, Artificial Sequence
  Description of Artificial Sequence: Synthetic peptide
DEEEIYTTNPVSTEQYGEVSTNLQTRGNR

SEQ ID NO: 23272 - protein, 30 aa, Artificial Sequence
  Description of Artificial Sequence: Synthetic polypeptide
DEEEIRTTNPVATEQYGCSVETNLDIRGNR

SEQ ID NO: 23273 - protein, 28 aa, Artificial Sequence
  Description of Artificial Sequence: Synthetic peptide
DEEEIRTTNPVATEQYGSVETDLERGNT

SEQ ID NO: 23274 - protein, 28 aa, Artificial Sequence
  Description of Artificial Sequence: Synthetic peptide
DEEEIRTTNIVATEQYGSVSENLQAGER

SEQ ID NO: 23275 - protein, 28 aa, Artificial Sequence
  Description of Artificial Sequence: Synthetic peptide
DEEEIRTTNPVATLIYGSVATNLERGNR

SEQ ID NO: 23276 - protein, 28 aa, Artificial Sequence
  Description of Artificial Sequence: Synthetic peptide
DEEEIRTTNPVATEQYGDVGTNLQNGNI

SEQ ID NO: 23277 - protein, 30 aa, Artificial Sequence
  Description of Artificial Sequence: Synthetic polypeptide
DEEEIRTTNPVATEQYGSVSTNLQEIGNDT

SEQ ID NO: 23278 - protein, 28 aa, Artificial Sequence
  Description of Artificial Sequence: Synthetic peptide
SEEEIRTTNPVATEQYGSVSTNPQRGTV

SEQ ID NO: 23279 - protein, 28 aa, Artificial Sequence
  Description of Artificial Sequence: Synthetic peptide
DEEEIRTTNPVATEQYGIVSTNEQRGTY

SEQ ID NO: 23280 - protein, 28 aa, Artificial Sequence
  Description of Artificial Sequence: Synthetic peptide
DEEEIRTTNPVATEQYGSASTNLQQGEL

SEQ ID NO: 23281 - protein, 28 aa, Artificial Sequence
  Description of Artificial Sequence: Synthetic peptide
DENEIRTTNPVATEQYGSVSENLQQGDR

SEQ ID NO: 23282 - protein, 28 aa, Artificial Sequence
  Description of Artificial Sequence: Synthetic peptide
DEEEIRTVNPVATEIYGAVSTNLERGNR

SEQ ID NO: 23283 - protein, 29 aa, Artificial Sequence
  Description of Artificial Sequence: Synthetic peptide
DECEIRTTNPVATEQYGSVDANLQRAGNR

SEQ ID NO: 23284 - protein, 28 aa, Artificial Sequence
  Description of Artificial Sequence: Synthetic peptide
DEEEIRTTNPVATEQYGSVSTNDQLGDF

SEQ ID NO: 23285 - protein, 30 aa, Artificial Sequence
  Description of Artificial Sequence: Synthetic polypeptide
DEEEIRTTNPIATEQYGSVSTNLQEDGENR

SEQ ID NO: 23286 - protein, 28 aa, Artificial Sequence
  Description of Artificial Sequence: Synthetic peptide
DEEEIRSTNPVCTEQYGSVSTDLQHGNR

SEQ ID NO: 23287 - protein, 29 aa, Artificial Sequence
  Description of Artificial Sequence: Synthetic peptide
DEEEIRTTNPTATELYGSVSTNWQRGINR

SEQ ID NO: 23288 - protein, 30 aa, Artificial Sequence
  Description of Artificial Sequence: Synthetic polypeptide
DEEEIRCTNPVATEQYGCVSATNLQRNGNR

SEQ ID NO: 23289 - protein, 28 aa, Artificial Sequence
  Description of Artificial Sequence: Synthetic peptide
DEEEIRTTNPVATEQYGSVSENWQIGNV

SEQ ID NO: 23290 - protein, 29 aa, Artificial Sequence
  Description of Artificial Sequence: Synthetic peptide
DEDEIRTTNPVASEQYGSVATNLQRGNDR

SEQ ID NO: 23291 - protein, 28 aa, Artificial Sequence
  Description of Artificial Sequence: Synthetic peptide
DEEEITTTNPVATEQYGSVDTNDQFGNR

SEQ ID NO: 23292 - protein, 29 aa, Artificial Sequence
  Description of Artificial Sequence: Synthetic peptide
DEEEIRTTNPVATEQYGDVSTNLQRGPEK

SEQ ID NO: 23293 - protein, 28 aa, Artificial Sequence
  Description of Artificial Sequence: Synthetic peptide
DEEEIGTTNPVATEQYGSVSENPQRGNV

SEQ ID NO: 23294 - protein, 28 aa, Artificial Sequence
  Description of Artificial Sequence: Synthetic peptide
DEEEIRTTNPVSTEQYGDVSTNCQRLNR

SEQ ID NO: 23295 - protein, 31 aa, Artificial Sequence
  Description of Artificial Sequence: Synthetic polypeptide
DEEEIRTTNPVATEQYGSVCSTVNLVQNGNR

SEQ ID NO: 23296 - protein, 31 aa, Artificial Sequence
  Description of Artificial Sequence: Synthetic polypeptide
DEEEIRTTNPVATEQYGSVSDTALQERGVNR

SEQ ID NO: 23297 - protein, 28 aa, Artificial Sequence
  Description of Artificial Sequence: Synthetic peptide
DEEEIATTNIVATEQYGSVSTNEQRGNQ

SEQ ID NO: 23298 - protein, 28 aa, Artificial Sequence
  Description of Artificial Sequence: Synthetic peptide
DEEEIRTTNPVATEQYGSVETNLEAGNY

SEQ ID NO: 23299 - protein, 30 aa, Artificial Sequence
  Description of Artificial Sequence: Synthetic polypeptide
DEEEIRTTNPVATEQYGSVSTGNLQMQGNE

SEQ ID NO: 23300 - protein, 28 aa, Artificial Sequence
  Description of Artificial Sequence: Synthetic peptide
DEQEIRATNPVATEQYGSVSDNLQKGNR

SEQ ID NO: 23301 - protein, 28 aa, Artificial Sequence
  Description of Artificial Sequence: Synthetic peptide
DEEEIRTTNIVATECYGSVSTNLQRGMD

SEQ ID NO: 23302 - protein, 28 aa, Artificial Sequence
  Description of Artificial Sequence: Synthetic peptide
DEEEICTTNPVATEQYGIASDNLQRGNR

SEQ ID NO: 23303 - protein, 28 aa, Artificial Sequence
  Description of Artificial Sequence: Synthetic peptide
DEQEIRTTNPVATELWGSVSTNLQRGNS

SEQ ID NO: 23304 - protein, 28 aa, Artificial Sequence
  Description of Artificial Sequence: Synthetic peptide
DEEEIRTTNIVATEQYGSVSTELQIGNS

SEQ ID NO: 23305 - protein, 29 aa, Artificial Sequence
  Description of Artificial Sequence: Synthetic peptide
DEEEIRTTNPVATEQYGSVSTNEQVENDR

SEQ ID NO: 23306 - protein, 28 aa, Artificial Sequence
  Description of Artificial Sequence: Synthetic peptide
DEQEIRTTNPVATEQYGSVSTNGDRGNM

SEQ ID NO: 23307 - protein, 30 aa, Artificial Sequence
  Description of Artificial Sequence: Synthetic polypeptide
DEEEIRTTNPVATEQYGSVSTANLQIGNTE

SEQ ID NO: 23308 - protein, 30 aa, Artificial Sequence
  Description of Artificial Sequence: Synthetic polypeptide
DEEEIRTTNPVATEQYGSVSTELQESGINR

SEQ ID NO: 23309 - protein, 29 aa, Artificial Sequence
  Description of Artificial Sequence: Synthetic peptide
DEGEIRTTNPAATEQYGSVSTLNLQRGNL

SEQ ID NO: 23310 - protein, 28 aa, Artificial Sequence
  Description of Artificial Sequence: Synthetic peptide
DEEEIRTTNPVATEVYGSVSTALQFGNG

SEQ ID NO: 23311 - protein, 31 aa, Artificial Sequence
  Description of Artificial Sequence: Synthetic polypeptide
DEEEIRTTNPVATEQYGSVVSTNLQCRENDR

SEQ ID NO: 23312 - protein, 29 aa, Artificial Sequence
  Description of Artificial Sequence: Synthetic peptide
DEEEIRTTNPVATEQYGSVSTNLQHGEDL

SEQ ID NO: 23313 - protein, 28 aa, Artificial Sequence
  Description of Artificial Sequence: Synthetic peptide
DEEEIRTTNIVATENYGSVSTNLQHENR

SEQ ID NO: 23314 - protein, 30 aa, Artificial Sequence
  Description of Artificial Sequence: Synthetic polypeptide
DAEEIRTTNPVATEQYGSVSTNPLVQRGND

SEQ ID NO: 23315 - protein, 28 aa, Artificial Sequence
  Description of Artificial Sequence: Synthetic peptide
DEEEIRTTNPVATEQYGGVGMNLQRGNQ

SEQ ID NO: 23316 - protein, 28 aa, Artificial Sequence
  Description of Artificial Sequence: Synthetic peptide
DEQEIVTTNPVATELYGVVSTNLQRGNR

SEQ ID NO: 23317 - protein, 28 aa, Artificial Sequence
  Description of Artificial Sequence: Synthetic peptide
DEEEIRTTNPVATEQYGSVSTELGWGNF

SEQ ID NO: 23318 - protein, 28 aa, Artificial Sequence
  Description of Artificial Sequence: Synthetic peptide
DEEEIVTTNIVATEQYGSVSTNLQHGER

SEQ ID NO: 23319 - protein, 28 aa, Artificial Sequence
  Description of Artificial Sequence: Synthetic peptide
DEEEIRTTNPVATEQYGSVSTELWFGND

SEQ ID NO: 23320 - protein, 30 aa, Artificial Sequence
  Description of Artificial Sequence: Synthetic polypeptide
DEEEIGTTNPVATEQYGSYVSLTNDQRGNR

SEQ ID NO: 23321 - protein, 28 aa, Artificial Sequence
  Description of Artificial Sequence: Synthetic peptide
NEEEIRTTNPVCTEQYGSVSTNEQMGNR

SEQ ID NO: 23322 - protein, 28 aa, Artificial Sequence
  Description of Artificial Sequence: Synthetic peptide
DEEEIRTTNPVATECYGSVSTDLERGER

SEQ ID NO: 23323 - protein, 30 aa, Artificial Sequence
  Description of Artificial Sequence: Synthetic polypeptide
DEEEIRTTNPVATEQYGSVSTNDQERDINR

SEQ ID NO: 23324 - protein, 28 aa, Artificial Sequence
  Description of Artificial Sequence: Synthetic peptide
DEEEIRTTNPVATEQYGSVSTELQSGEN

SEQ ID NO: 23325 - protein, 28 aa, Artificial Sequence
  Description of Artificial Sequence: Synthetic peptide
DEEEIRTTNPVATEAYGSVSTTPQRGNH

SEQ ID NO: 23326 - protein, 28 aa, Artificial Sequence
  Description of Artificial Sequence: Synthetic peptide
DEEEIRTTNIVATEQYGSVSTNLGNGNA

SEQ ID NO: 23327 - protein, 28 aa, Artificial Sequence
  Description of Artificial Sequence: Synthetic peptide
DENEIRTTNPVATEQWGSVSENEQRGNR

SEQ ID NO: 23328 - protein, 28 aa, Artificial Sequence
  Description of Artificial Sequence: Synthetic peptide
DEEEIRTTNPDATEQYGSVSTDLERGNA

SEQ ID NO: 23329 - protein, 28 aa, Artificial Sequence
  Description of Artificial Sequence: Synthetic peptide
DEQELRSTNPVATEQYGVVSTNLQRGNR

SEQ ID NO: 23330 - protein, 29 aa, Artificial Sequence
  Description of Artificial Sequence: Synthetic peptide
DEEEINTTNPVATEQYGSVSTNLQRNGEA

SEQ ID NO: 23331 - protein, 28 aa, Artificial Sequence
  Description of Artificial Sequence: Synthetic peptide
SEEEIRTTNPVATEVYGSVSTNLQRWNS

SEQ ID NO: 23332 - protein, 28 aa, Artificial Sequence
  Description of Artificial Sequence: Synthetic peptide
DEEEIATTNIVATEQYGSVSVNLQLGNR

SEQ ID NO: 23333 - protein, 28 aa, Artificial Sequence
  Description of Artificial Sequence: Synthetic peptide
DEEEIRTTNPTATEQYGSVSTNEQVGNE

SEQ ID NO: 23334 - protein, 28 aa, Artificial Sequence
  Description of Artificial Sequence: Synthetic peptide
MEEEIAATNPVATEQYGSVSTNLQRGND

SEQ ID NO: 23335 - protein, 28 aa, Artificial Sequence
  Description of Artificial Sequence: Synthetic peptide
DEEEIRTTNPVATECYGSVSTNLQSGEQ

SEQ ID NO: 23336 - protein, 31 aa, Artificial Sequence
  Description of Artificial Sequence: Synthetic polypeptide
DEEEIRTTNPVATEQYGSVSETDNDQVRGNR

SEQ ID NO: 23337 - protein, 31 aa, Artificial Sequence
  Description of Artificial Sequence: Synthetic polypeptide
DEEEIRTTNPVATEQYGSVSTMNLQIEGNTR

SEQ ID NO: 23338 - protein, 31 aa, Artificial Sequence
  Description of Artificial Sequence: Synthetic polypeptide
DEEEIRTTNPVATEQYGSVSDTNLQRKGNDD

SEQ ID NO: 23339 - protein, 28 aa, Artificial Sequence
  Description of Artificial Sequence: Synthetic peptide
DEEEIRTTNPAATEQYGSVSVNLQTGNL

SEQ ID NO: 23340 - protein, 28 aa, Artificial Sequence
  Description of Artificial Sequence: Synthetic peptide
TEEEIYTTNPVATEFYGSVSENLQRGNR

SEQ ID NO: 23341 - protein, 28 aa, Artificial Sequence
  Description of Artificial Sequence: Synthetic peptide
DEDEIRTTNPVATEWYGGVSTNLQRGMR

SEQ ID NO: 23342 - protein, 29 aa, Artificial Sequence
  Description of Artificial Sequence: Synthetic peptide
DEEEIRTTNPVATELYGSVSENLMNRGNR

SEQ ID NO: 23343 - protein, 28 aa, Artificial Sequence
  Description of Artificial Sequence: Synthetic peptide
DEEEIRTTNIEATEQYGSVSTNLQVGDR

SEQ ID NO: 23344 - protein, 29 aa, Artificial Sequence
  Description of Artificial Sequence: Synthetic peptide
DEEEIRTTNPVATEQYGSVSTELQVSGNM

SEQ ID NO: 23345 - protein, 30 aa, Artificial Sequence
  Description of Artificial Sequence: Synthetic polypeptide
DEMEIRTTNPVATEQYGSVSTDNLQRGNDV

SEQ ID NO: 23346 - protein, 31 aa, Artificial Sequence
  Description of Artificial Sequence: Synthetic polypeptide
DEEEIRTTNPVATEQYGSVDCTMNLQRGENR

SEQ ID NO: 23347 - protein, 28 aa, Artificial Sequence
  Description of Artificial Sequence: Synthetic peptide
DEVEIRTTNPVATEVYGSVSTALQTGNR

SEQ ID NO: 23348 - protein, 28 aa, Artificial Sequence
  Description of Artificial Sequence: Synthetic peptide
DEEEIRQTNPVATEMYGSVSENLQRGGR

SEQ ID NO: 23349 - protein, 28 aa, Artificial Sequence
  Description of Artificial Sequence: Synthetic peptide
DEEEIRTTNPVATEQYGIVSTTPQRGNA

SEQ ID NO: 23350 - protein, 30 aa, Artificial Sequence
  Description of Artificial Sequence: Synthetic polypeptide
DEEEIRTTNPVATEQYGSVSTQYLQTGNDR

SEQ ID NO: 23351 - protein, 30 aa, Artificial Sequence
  Description of Artificial Sequence: Synthetic polypeptide
DEEEIRTTNPDATEQYGSVTSTALQRDGNR

SEQ ID NO: 23352 - protein, 28 aa, Artificial Sequence
  Description of Artificial Sequence: Synthetic peptide
DEEAIRTTNPDATEQYGSVSTGLDRGNR

SEQ ID NO: 23353 - protein, 31 aa, Artificial Sequence
  Description of Artificial Sequence: Synthetic polypeptide
DEEEIRTTNPVATEQYGSVSTNPLQRGDEPR

SEQ ID NO: 23354 - protein, 29 aa, Artificial Sequence
  Description of Artificial Sequence: Synthetic peptide
DEGEIRTTNPVATECYGSVSTGNLQQGNR

SEQ ID NO: 23355 - protein, 31 aa, Artificial Sequence
  Description of Artificial Sequence: Synthetic polypeptide
DEEEIRTTNPVATEQYGSVSITELQRKGNDR

SEQ ID NO: 23356 - protein, 30 aa, Artificial Sequence
  Description of Artificial Sequence: Synthetic polypeptide
DEEEIRTTNPVSTEQYGSVDTENLQRGENR

SEQ ID NO: 23357 - protein, 28 aa, Artificial Sequence
  Description of Artificial Sequence: Synthetic peptide
DENEIRSTNPVATEQYGSVSTNLQIGNA

SEQ ID NO: 23358 - protein, 28 aa, Artificial Sequence
  Description of Artificial Sequence: Synthetic peptide
DEEEIGTTNPVATEQYGSYSELLQRGNR

SEQ ID NO: 23359 - protein, 29 aa, Artificial Sequence
  Description of Artificial Sequence: Synthetic peptide
QEEEIRTTNPVATEQYGSVSTNLQYKGNE

SEQ ID NO: 23360 - protein, 28 aa, Artificial Sequence
  Description of Artificial Sequence: Synthetic peptide
DEDEISTTNPVATEQYGWVSTPLQRGNR

SEQ ID NO: 23361 - protein, 30 aa, Artificial Sequence
  Description of Artificial Sequence: Synthetic polypeptide
DETEIRTTNPVATEQYGSVSLTNLLRGNER

SEQ ID NO: 23362 - protein, 30 aa, Artificial Sequence
  Description of Artificial Sequence: Synthetic polypeptide
DEEEIRTTNPVATEQYGSVSTNLQEHGNDL

SEQ ID NO: 23363 - protein, 30 aa, Artificial Sequence
  Description of Artificial Sequence: Synthetic polypeptide
DEEEIRTTNPVATEQYGSVSTMNLQHGNDA

SEQ ID NO: 23364 - protein, 28 aa, Artificial Sequence
  Description of Artificial Sequence: Synthetic peptide
DEVEIRTVNPVATEQYGSVSTNWQRGNI

SEQ ID NO: 23365 - protein, 28 aa, Artificial Sequence
  Description of Artificial Sequence: Synthetic peptide
DEECIRTTNPVATEQYWSVSTPLQRGER

SEQ ID NO: 23366 - protein, 28 aa, Artificial Sequence
  Description of Artificial Sequence: Synthetic peptide
DENEIRTTNPVATECYGSVSTNLQLGNF

SEQ ID NO: 23367 - protein, 31 aa, Artificial Sequence
  Description of Artificial Sequence: Synthetic polypeptide
DEEEIRTTNPVATEQYGSVSTNLQEREGNDD

SEQ ID NO: 23368 - protein, 30 aa, Artificial Sequence
  Description of Artificial Sequence: Synthetic polypeptide
DEEEIRATNPVATEQYGSVSTGNLQQGNDR

SEQ ID NO: 23369 - protein, 28 aa, Artificial Sequence
  Description of Artificial Sequence: Synthetic peptide
MEEEIRTTNPVATEQYGSVSTNLQQGEI

SEQ ID NO: 23370 - protein, 30 aa, Artificial Sequence
  Description of Artificial Sequence: Synthetic polypeptide
DEEEIRTTNPVATEQYGSVSTDLERGDNDR

SEQ ID NO: 23371 - protein, 28 aa, Artificial Sequence
  Description of Artificial Sequence: Synthetic peptide
DEEEINSTNPVATEQYGEGSTNLQRGNR

SEQ ID NO: 23372 - protein, 28 aa, Artificial Sequence
  Description of Artificial Sequence: Synthetic peptide
DEEEIRTTNPVATEQYGSYSENLERGNL

SEQ ID NO: 23373 - protein, 30 aa, Artificial Sequence
  Description of Artificial Sequence: Synthetic polypeptide
DEEEIRTTNPVASEIYGSVSATNLQRNGNR

SEQ ID NO: 23374 - protein, 28 aa, Artificial Sequence
  Description of Artificial Sequence: Synthetic peptide
DEEEIRTTNPFATEQYGSVSTGQQRGER

SEQ ID NO: 23375 - protein, 28 aa, Artificial Sequence
  Description of Artificial Sequence: Synthetic peptide
DEQEIATTNPVAYEIYGSVSTNLQRGNR

SEQ ID NO: 23376 - protein, 29 aa, Artificial Sequence
  Description of Artificial Sequence: Synthetic peptide
DENEIRTTNPVATEQYGSVSTDLQRGNDM

SEQ ID NO: 23377 - protein, 29 aa, Artificial Sequence
  Description of Artificial Sequence: Synthetic peptide
DENEIRTTNPVATEQYGSVSTDLQDIGNR

SEQ ID NO: 23378 - protein, 28 aa, Artificial Sequence
  Description of Artificial Sequence: Synthetic peptide
NEEEIRTTNPVATEQYGSVSENLQGGNA

SEQ ID NO: 23379 - protein, 29 aa, Artificial Sequence
  Description of Artificial Sequence: Synthetic peptide
DEEEIRTTNPVATECYGSVSTELQRKGER

SEQ ID NO: 23380 - protein, 29 aa, Artificial Sequence
  Description of Artificial Sequence: Synthetic peptide
MEEEIRTTNPVATEQYGSVSTDLQDRGNT

SEQ ID NO: 23381 - protein, 28 aa, Artificial Sequence
  Description of Artificial Sequence: Synthetic peptide
DEEEIRCTNPVATELYGSVSTNDQRGNS

SEQ ID NO: 23382 - protein, 28 aa, Artificial Sequence
  Description of Artificial Sequence: Synthetic peptide
DEEEIRTTNPTATEQYGSVSTNPQVGNV

SEQ ID NO: 23383 - protein, 28 aa, Artificial Sequence
  Description of Artificial Sequence: Synthetic peptide
DENEIRTTNPFATEQYGSVSTDLQRGER

SEQ ID NO: 23384 - protein, 28 aa, Artificial Sequence
  Description of Artificial Sequence: Synthetic peptide
DEQEIRTTNPDATEQYGSVSTNDQRGNL

SEQ ID NO: 23385 - protein, 28 aa, Artificial Sequence
  Description of Artificial Sequence: Synthetic peptide
DEEEIRTTNPTATEQYGSVSTNLQNGTE

SEQ ID NO: 23386 - protein, 28 aa, Artificial Sequence
  Description of Artificial Sequence: Synthetic peptide
DEQEIRATNPVATEIYGVVSTNLQRGNR

SEQ ID NO: 23387 - protein, 28 aa, Artificial Sequence
  Description of Artificial Sequence: Synthetic peptide
DEEEIATTNIVATEQYGSVSDNLQRGNF

SEQ ID NO: 23388 - protein, 28 aa, Artificial Sequence
  Description of Artificial Sequence: Synthetic peptide
DEQEITTTNPTATEQYGSVSTNLQRGTR

SEQ ID NO: 23389 - protein, 30 aa, Artificial Sequence
  Description of Artificial Sequence: Synthetic polypeptide
DEEEIRTTNPVATEQYGSVDTCNNLDRGNR

SEQ ID NO: 23390 - protein, 30 aa, Artificial Sequence
  Description of Artificial Sequence: Synthetic polypeptide
DEEEIRTTNPVATEQYGSVSTNLQELGNDT

SEQ ID NO: 23391 - protein, 29 aa, Artificial Sequence
  Description of Artificial Sequence: Synthetic peptide
DEEEIRTTNPVATEQYGSVSTDLQQEGNN

SEQ ID NO: 23392 - protein, 28 aa, Artificial Sequence
  Description of Artificial Sequence: Synthetic peptide
DEEEIRTTNPVATEQYGSVSDNLQGTNN

SEQ ID NO: 23393 - protein, 28 aa, Artificial Sequence
  Description of Artificial Sequence: Synthetic peptide
DEQEIRTTNPVATEQYGSVSTNLQIGEI

SEQ ID NO: 23394 - protein, 28 aa, Artificial Sequence
  Description of Artificial Sequence: Synthetic peptide
DEEEIRCTNPDATEQYGSVSENLDRGNR

SEQ ID NO: 23395 - protein, 29 aa, Artificial Sequence
  Description of Artificial Sequence: Synthetic peptide
DEEEIRTTNPVATEQYGSVEETPDQRGNR

SEQ ID NO: 23396 - protein, 28 aa, Artificial Sequence
  Description of Artificial Sequence: Synthetic peptide
DEEEIATTNIVATECYGSVSTNLQRGNF

SEQ ID NO: 23397 - protein, 29 aa, Artificial Sequence
  Description of Artificial Sequence: Synthetic peptide
DEEEIRTTNPVATEQYGSVSCENLQAGNM

SEQ ID NO: 23398 - protein, 29 aa, Artificial Sequence
  Description of Artificial Sequence: Synthetic peptide
DEEEIATTNPVATEQYGSVSTMNEQNGNR

SEQ ID NO: 23399 - protein, 30 aa, Artificial Sequence
  Description of Artificial Sequence: Synthetic polypeptide
DEEEIRTTNPVATEQYGSVSTNLQCTGNDD

SEQ ID NO: 23400 - protein, 30 aa, Artificial Sequence
  Description of Artificial Sequence: Synthetic polypeptide
DEEEIRTTNPVATEQYGSVSTLNEQRGDNM

SEQ ID NO: 23401 - protein, 28 aa, Artificial Sequence
  Description of Artificial Sequence: Synthetic peptide
KEEEIRSVNPVATEQYGSVSTNLQRGNN

SEQ ID NO: 23402 - protein, 28 aa, Artificial Sequence
  Description of Artificial Sequence: Synthetic peptide
DEEEIRTTNPVATEQYGEVATNLQRGEM

SEQ ID NO: 23403 - protein, 28 aa, Artificial Sequence
  Description of Artificial Sequence: Synthetic peptide
QEEEIRTTNIVATEQYGSVSTNWQHGNR

SEQ ID NO: 23404 - protein, 28 aa, Artificial Sequence
  Description of Artificial Sequence: Synthetic peptide
DEEEIRTTNPVATVQYGSVSTHLQRMND

SEQ ID NO: 23405 - protein, 28 aa, Artificial Sequence
  Description of Artificial Sequence: Synthetic peptide
DEEEINTTNPVATEQYGEVSTNLQRPPR

SEQ ID NO: 23406 - protein, 28 aa, Artificial Sequence
  Description of Artificial Sequence: Synthetic peptide
SEEEIRTTNIVATEQYGSVSTNEQNGNR

SEQ ID NO: 23407 - protein, 30 aa, Artificial Sequence
  Description of Artificial Sequence: Synthetic polypeptide
DEEEIRTTNPVATEQYGSVSTNLQESGNDL

SEQ ID NO: 23408 - protein, 28 aa, Artificial Sequence
  Description of Artificial Sequence: Synthetic peptide
DEQEIRTTNPVATEQYGSVSTDLQNGNA

SEQ ID NO: 23409 - protein, 30 aa, Artificial Sequence
  Description of Artificial Sequence: Synthetic polypeptide
AEEEIATTNPVATEQYGSVSTNLQRAGNDR

SEQ ID NO: 23410 - protein, 28 aa, Artificial Sequence
  Description of Artificial Sequence: Synthetic peptide
VEEEIRTTNPVATEQYWSVSTNLDPGNR

SEQ ID NO: 23411 - protein, 28 aa, Artificial Sequence
  Description of Artificial Sequence: Synthetic peptide
DEWEIRTTNPVATEQYGSVSTNLESGDR

SEQ ID NO: 23412 - protein, 28 aa, Artificial Sequence
  Description of Artificial Sequence: Synthetic peptide
DEEEIRTTNIVATEQYGSVSTNLDIGNT

SEQ ID NO: 23413 - protein, 28 aa, Artificial Sequence
  Description of Artificial Sequence: Synthetic peptide
DEEEIRTTNPCATEPYGSVDTNLQFGNR

SEQ ID NO: 23414 - protein, 28 aa, Artificial Sequence
  Description of Artificial Sequence: Synthetic peptide
DEEEIRTTNPVATEQYGSVSTNLEPGEN

SEQ ID NO: 23415 - protein, 30 aa, Artificial Sequence
  Description of Artificial Sequence: Synthetic polypeptide
DEEEIRTTNPDATEQYGSVSTNLQVRGEPR

SEQ ID NO: 23416 - protein, 28 aa, Artificial Sequence
  Description of Artificial Sequence: Synthetic peptide
DEEEIRTTNPVATEQYGDVSTNEQSGNF

SEQ ID NO: 23417 - protein, 28 aa, Artificial Sequence
  Description of Artificial Sequence: Synthetic peptide
DEEEIRTTNPVATEQYGDASTNEQRGER

SEQ ID NO: 23418 - protein, 28 aa, Artificial Sequence
  Description of Artificial Sequence: Synthetic peptide
DEEEIRTTNIVATEQYGSVSEGLQNGNR

SEQ ID NO: 23419 - protein, 28 aa, Artificial Sequence
  Description of Artificial Sequence: Synthetic peptide
DEEEIRATNPVATEQYGWVSDNLQRGER

SEQ ID NO: 23420 - protein, 28 aa, Artificial Sequence
  Description of Artificial Sequence: Synthetic peptide
DEEEIRTTNIVATECYGSVSENLQQGNR

SEQ ID NO: 23421 - protein, 31 aa, Artificial Sequence
  Description of Artificial Sequence: Synthetic polypeptide
DEEEIRTTNPVATEQYWGSVSDTGLQRGENR

SEQ ID NO: 23422 - protein, 29 aa, Artificial Sequence
  Description of Artificial Sequence: Synthetic peptide
DEECIRTTNPTATEQYGSVSSTNLQRGNF

SEQ ID NO: 23423 - protein, 28 aa, Artificial Sequence
  Description of Artificial Sequence: Synthetic peptide
DEQEIATTNPVSTEQYGSVSTVLQRGNR

SEQ ID NO: 23424 - protein, 31 aa, Artificial Sequence
  Description of Artificial Sequence: Synthetic polypeptide
DEEEIRTTNPVATEQYGSVSSTNLPQVRGND

SEQ ID NO: 23425 - protein, 28 aa, Artificial Sequence
  Description of Artificial Sequence: Synthetic peptide
DEEEIRTTNPVATEQYGSVSTELQGPND

SEQ ID NO: 23426 - protein, 28 aa, Artificial Sequence
  Description of Artificial Sequence: Synthetic peptide
DECEIRTTNCVATEQWGSVSTNPQRGNR

SEQ ID NO: 23427 - protein, 28 aa, Artificial Sequence
  Description of Artificial Sequence: Synthetic peptide
DEEEIRTTNPVATEQYGSVSTNPNAGNG

SEQ ID NO: 23428 - protein, 28 aa, Artificial Sequence
  Description of Artificial Sequence: Synthetic peptide
DEQEIRTTNPVATEQYGSASINLQGGNR

SEQ ID NO: 23429 - protein, 28 aa, Artificial Sequence
  Description of Artificial Sequence: Synthetic peptide
DEEEIRTTNIVATECYGSVSTNLQQGQR

SEQ ID NO: 23430 - protein, 30 aa, Artificial Sequence
  Description of Artificial Sequence: Synthetic polypeptide
DEEEIRTTNPVATEQYGSVSTDGQARGENR

SEQ ID NO: 23431 - protein, 28 aa, Artificial Sequence
  Description of Artificial Sequence: Synthetic peptide
DEEEIRTTNPVATEQYGSVSTGLELGNF

SEQ ID NO: 23432 - protein, 28 aa, Artificial Sequence
  Description of Artificial Sequence: Synthetic peptide
DEEEIRTTNPVATEQYGSVSTDLEVGNQ

SEQ ID NO: 23433 - protein, 28 aa, Artificial Sequence
  Description of Artificial Sequence: Synthetic peptide
DEMEIRTVNPVATEQYGSVSDNLQLGNR

SEQ ID NO: 23434 - protein, 28 aa, Artificial Sequence
  Description of Artificial Sequence: Synthetic peptide
DEEEIRTTNPVATEIYGSVSENLQEGER

SEQ ID NO: 23435 - protein, 28 aa, Artificial Sequence
  Description of Artificial Sequence: Synthetic peptide
DEEEIRTTNPVATECYGSVSTNEMRGNW

SEQ ID NO: 23436 - protein, 28 aa, Artificial Sequence
  Description of Artificial Sequence: Synthetic peptide
DEQEIRTTNIVATEQYGSVSTNIQRGNL

SEQ ID NO: 23437 - protein, 28 aa, Artificial Sequence
  Description of Artificial Sequence: Synthetic peptide
DEEEIRTVNPVATENYGSVSNNLQRGNM

SEQ ID NO: 23438 - protein, 30 aa, Artificial Sequence
  Description of Artificial Sequence: Synthetic polypeptide
DEEEIRTTNPVATEQYGSVSTDLQREGEDR

SEQ ID NO: 23439 - protein, 29 aa, Artificial Sequence
  Description of Artificial Sequence: Synthetic peptide
DEEEIRTTNPMATEQYGWVSTNLQANGNR

SEQ ID NO: 23440 - protein, 28 aa, Artificial Sequence
  Description of Artificial Sequence: Synthetic peptide
MEEEIRTTNPVATEQYGSVSDNLQIGNM

SEQ ID NO: 23441 - protein, 30 aa, Artificial Sequence
  Description of Artificial Sequence: Synthetic polypeptide
DEEEIRTTNPVATEQYGSWSEWNLQERGNR

SEQ ID NO: 23442 - protein, 28 aa, Artificial Sequence
  Description of Artificial Sequence: Synthetic peptide
DEEEIRTTNPVATIQYGSVWTNDQPGNR

SEQ ID NO: 23443 - protein, 28 aa, Artificial Sequence
  Description of Artificial Sequence: Synthetic peptide
DEEEISTTNITATEQYGSVSTNLQRGNA

SEQ ID NO: 23444 - protein, 28 aa, Artificial Sequence
  Description of Artificial Sequence: Synthetic peptide
DEEEIRCTNPVATEQYGSVSTDPQRGNH

SEQ ID NO: 23445 - protein, 30 aa, Artificial Sequence
  Description of Artificial Sequence: Synthetic polypeptide
SEEEIRTTNPVATEQYGSVSTNEPQRGNDR

SEQ ID NO: 23446 - protein, 28 aa, Artificial Sequence
  Description of Artificial Sequence: Synthetic peptide
DEEEITTTNPVATEQYGTVSTNLQHGNF

SEQ ID NO: 23447 - protein, 30 aa, Artificial Sequence
  Description of Artificial Sequence: Synthetic polypeptide
DEEEIRTTNPFATEQYGSVSTNLDLRGNPR

SEQ ID NO: 23448 - protein, 28 aa, Artificial Sequence
  Description of Artificial Sequence: Synthetic peptide
DEEEIRTTNPVATEQYGSVSTNLWDGEN

SEQ ID NO: 23449 - protein, 28 aa, Artificial Sequence
  Description of Artificial Sequence: Synthetic peptide
DEEEIRTTNPVATEQYGSVETNLDRGKH

SEQ ID NO: 23450 - protein, 28 aa, Artificial Sequence
  Description of Artificial Sequence: Synthetic peptide
DEEEIRTTNPVATEPYGSVSTNLCTGNE

SEQ ID NO: 23451 - protein, 28 aa, Artificial Sequence
  Description of Artificial Sequence: Synthetic peptide
DEEEIRTTNPVATEQYGSVDTDDERGNR

SEQ ID NO: 23452 - protein, 28 aa, Artificial Sequence
  Description of Artificial Sequence: Synthetic peptide
DEEEIRTTNPVATEQYGDVSEDLQRGNM

SEQ ID NO: 23453 - protein, 28 aa, Artificial Sequence
  Description of Artificial Sequence: Synthetic peptide
DEDEIRTTNPVATEIYGSVSTTLQYGNR

SEQ ID NO: 23454 - protein, 29 aa, Artificial Sequence
  Description of Artificial Sequence: Synthetic peptide
SEEEIRTTNPVATEQYGMSVSENLQTGNR

SEQ ID NO: 23455 - protein, 29 aa, Artificial Sequence
  Description of Artificial Sequence: Synthetic peptide
QEEEIRTTNPVATEQYGSVSTNLQYGENM

SEQ ID NO: 23456 - protein, 31 aa, Artificial Sequence
  Description of Artificial Sequence: Synthetic polypeptide
DEEEIRTTNPVATEQYGSYVSTNPLQRENDR

SEQ ID NO: 23457 - protein, 28 aa, Artificial Sequence
  Description of Artificial Sequence: Synthetic peptide
KENEIRTTNPVATEQYGSASENLQRGNR

SEQ ID NO: 23458 - protein, 28 aa, Artificial Sequence
  Description of Artificial Sequence: Synthetic peptide
DEEEIRTTNPDATEQYGSVSTNPIRGNS

SEQ ID NO: 23459 - protein, 28 aa, Artificial Sequence
  Description of Artificial Sequence: Synthetic peptide
DEEEIRSTNPVATECYGSVSTNLQPGNM

SEQ ID NO: 23460 - protein, 28 aa, Artificial Sequence
  Description of Artificial Sequence: Synthetic peptide
DEFEIRTTNPVATEQYGSVGENLQRGNA

SEQ ID NO: 23461 - protein, 28 aa, Artificial Sequence
  Description of Artificial Sequence: Synthetic peptide
DEEEIRTTNPVATEQYGWVSTNEQEGNF

SEQ ID NO: 23462 - protein, 28 aa, Artificial Sequence
  Description of Artificial Sequence: Synthetic peptide
SEEEIRTTNPVATEQYGSVSTNDMVGNR

SEQ ID NO: 23463 - protein, 28 aa, Artificial Sequence
  Description of Artificial Sequence: Synthetic peptide
SEEEIRTTNPVATEIYGIVSTNLQRGNS

SEQ ID NO: 23464 - protein, 31 aa, Artificial Sequence
  Description of Artificial Sequence: Synthetic polypeptide
DEEEIRTTNPVATEQYGSVSTDLQERNGENR

SEQ ID NO: 23465 - protein, 30 aa, Artificial Sequence
  Description of Artificial Sequence: Synthetic polypeptide
DEEEIRTTNPVATEQYGSVNTNNLQREGNT

SEQ ID NO: 23466 - protein, 31 aa, Artificial Sequence
  Description of Artificial Sequence: Synthetic polypeptide
DEEEIRTTNPMATEQYGSVSTYNLQRNGNYR

SEQ ID NO: 23467 - protein, 28 aa, Artificial Sequence
  Description of Artificial Sequence: Synthetic peptide
DEEEIRTTNPVGTEQYGVYSTNLQRGLR

SEQ ID NO: 23468 - protein, 28 aa, Artificial Sequence
  Description of Artificial Sequence: Synthetic peptide
AEEEIRQTNPVATEQYGSVSTDLQRGND

SEQ ID NO: 23469 - protein, 31 aa, Artificial Sequence
  Description of Artificial Sequence: Synthetic polypeptide
DEEEIRTTNPVATETYGSVSTGNGLQRGENR

SEQ ID NO: 23470 - protein, 29 aa, Artificial Sequence
  Description of Artificial Sequence: Synthetic peptide
DEQEIRTTNPVATEQYGSVSCTNLCHGNR

SEQ ID NO: 23471 - protein, 30 aa, Artificial Sequence
  Description of Artificial Sequence: Synthetic polypeptide
DESEIRTVNPVATEQYGSVCSITNLQRGNR

SEQ ID NO: 23472 - protein, 28 aa, Artificial Sequence
  Description of Artificial Sequence: Synthetic peptide
NEEEIRSVNPVATEQYGSVSMNLQRGNR

SEQ ID NO: 23473 - protein, 28 aa, Artificial Sequence
  Description of Artificial Sequence: Synthetic peptide
DEEEIATTNPVATECYGSVSTDLQHGNR

SEQ ID NO: 23474 - protein, 29 aa, Artificial Sequence
  Description of Artificial Sequence: Synthetic peptide
DEEEIRTTNPVATEQYGSVSTNEMNRGNL

SEQ ID NO: 23475 - protein, 31 aa, Artificial Sequence
  Description of Artificial Sequence: Synthetic polypeptide
DEEEIRTTNPVATEQYGNSIKSTNLQRDGNR

SEQ ID NO: 23476 - protein, 28 aa, Artificial Sequence
  Description of Artificial Sequence: Synthetic peptide
DEVEIATTNPIATEQYGSVSTNLQIGNR

SEQ ID NO: 23477 - protein, 29 aa, Artificial Sequence
  Description of Artificial Sequence: Synthetic peptide
DEEEIRTTNPVATEQYGESWSTNEQRGNL

SEQ ID NO: 23478 - protein, 28 aa, Artificial Sequence
  Description of Artificial Sequence: Synthetic peptide
DEEEIRTTNPVATEQYGSVSTDEQRGEM

SEQ ID NO: 23479 - protein, 30 aa, Artificial Sequence
  Description of Artificial Sequence: Synthetic polypeptide
DEEEIRTTNPVATEQYGSVSTNPLDERGER

SEQ ID NO: 23480 - protein, 30 aa, Artificial Sequence
  Description of Artificial Sequence: Synthetic polypeptide
DEEEIRTTNPVATEQYGVVCSTNLQDGENR

SEQ ID NO: 23481 - protein, 28 aa, Artificial Sequence
  Description of Artificial Sequence: Synthetic peptide
DEEEIATTNIVATEQYGSVSTNLERGNL

SEQ ID NO: 23482 - protein, 28 aa, Artificial Sequence
  Description of Artificial Sequence: Synthetic peptide
YEEEIRTTNPVATELYGSVSTELQRGNQ

SEQ ID NO: 23483 - protein, 28 aa, Artificial Sequence
  Description of Artificial Sequence: Synthetic peptide
DEEEIRTTNPVATEQYGSASTNCMHGNR

SEQ ID NO: 23484 - protein, 28 aa, Artificial Sequence
  Description of Artificial Sequence: Synthetic peptide
DEEEIRTTNPVATEQWGSVSTILQRGDM

SEQ ID NO: 23485 - protein, 28 aa, Artificial Sequence
  Description of Artificial Sequence: Synthetic peptide
DEQEIRTTNPVATEPYGSVSTNLQSGNF

SEQ ID NO: 23486 - protein, 29 aa, Artificial Sequence
  Description of Artificial Sequence: Synthetic peptide
QEEEITTTNPVATEQYGSVSTNLQQEGNR

SEQ ID NO: 23487 - protein, 28 aa, Artificial Sequence
  Description of Artificial Sequence: Synthetic peptide
DEEEIRATNPVATEVYGWVATNLQRGNR

SEQ ID NO: 23488 - protein, 28 aa, Artificial Sequence
  Description of Artificial Sequence: Synthetic peptide
DEEEIRTTNPIASEIYGSVSTNLERGNR

SEQ ID NO: 23489 - protein, 30 aa, Artificial Sequence
  Description of Artificial Sequence: Synthetic polypeptide
DEEEIRTTNPVATEQYGSVSTNNGQRGEDR

SEQ ID NO: 23490 - protein, 29 aa, Artificial Sequence
  Description of Artificial Sequence: Synthetic peptide
TEEEIRTTNPVATEQFGSVSTENLQRGNM

SEQ ID NO: 23491 - protein, 28 aa, Artificial Sequence
  Description of Artificial Sequence: Synthetic peptide
DESEVRTTNPVATEFYGSVSTNLQRGLR

SEQ ID NO: 23492 - protein, 28 aa, Artificial Sequence
  Description of Artificial Sequence: Synthetic peptide
AEEEIRTTNPVATEQYGSVSENLQDGER

SEQ ID NO: 23493 - protein, 29 aa, Artificial Sequence
  Description of Artificial Sequence: Synthetic peptide
MEEEIRTTNPVATEQYGSVSENLQDRGNF

SEQ ID NO: 23494 - protein, 28 aa, Artificial Sequence
  Description of Artificial Sequence: Synthetic peptide
DEEEIRTTNIVATEQYGIVSTNLQQGNI

SEQ ID NO: 23495 - protein, 31 aa, Artificial Sequence
  Description of Artificial Sequence: Synthetic polypeptide
DEEEIRTTNPVATELYGSVSTMNLQRGPNTR

SEQ ID NO: 23496 - protein, 28 aa, Artificial Sequence
  Description of Artificial Sequence: Synthetic peptide
DEEEIRSTNPVSTEQYGNVATNLQRGNR

SEQ ID NO: 23497 - protein, 28 aa, Artificial Sequence
  Description of Artificial Sequence: Synthetic peptide
DENEIRTTNPVATEWYGSVSTNLEIGNR

SEQ ID NO: 23498 - protein, 30 aa, Artificial Sequence
  Description of Artificial Sequence: Synthetic polypeptide
DEEEIRTTNPVATEQYGSVYSTALQREGNF

SEQ ID NO: 23499 - protein, 28 aa, Artificial Sequence
  Description of Artificial Sequence: Synthetic peptide
DEEEIRATNPVATEMYGTVATNLQRGNR

SEQ ID NO: 23500 - protein, 28 aa, Artificial Sequence
  Description of Artificial Sequence: Synthetic peptide
DEEEIRTTNPVATEQYGSVSTNLEPGEE

SEQ ID NO: 23501 - protein, 28 aa, Artificial Sequence
  Description of Artificial Sequence: Synthetic peptide
DEEEIRTTNPVATECYGVVSTNLQPGNL

SEQ ID NO: 23502 - protein, 28 aa, Artificial Sequence
  Description of Artificial Sequence: Synthetic peptide
SEEEIRTTNPTATEQYGSVSTNPQRGNF

SEQ ID NO: 23503 - protein, 28 aa, Artificial Sequence
  Description of Artificial Sequence: Synthetic peptide
MEEEIRTTNPVATEQFGSVGTNLQGGNR

SEQ ID NO: 23504 - protein, 28 aa, Artificial Sequence
  Description of Artificial Sequence: Synthetic peptide
KEEEIATTNPVATEQYGSVSTNLQLGNV

SEQ ID NO: 23505 - protein, 28 aa, Artificial Sequence
  Description of Artificial Sequence: Synthetic peptide
DEEEIRTTNPVATEQYGSVDTDLQNGNV

SEQ ID NO: 23506 - protein, 28 aa, Artificial Sequence
  Description of Artificial Sequence: Synthetic peptide
DEEEITTTNPVATEQYGLVSTNLQHGNI

SEQ ID NO: 23507 - protein, 28 aa, Artificial Sequence
  Description of Artificial Sequence: Synthetic peptide
DEEEIATTNPVGTEMFGSVSTNLQRGNR

SEQ ID NO: 23508 - protein, 30 aa, Artificial Sequence
  Description of Artificial Sequence: Synthetic polypeptide
DEEEIRTTNPVATEQYGSVSTNPLQVRGEE

SEQ ID NO: 23509 - protein, 28 aa, Artificial Sequence
  Description of Artificial Sequence: Synthetic peptide
DEEEIRTTNPVATEQYGSVSTELQFGES

SEQ ID NO: 23510 - protein, 29 aa, Artificial Sequence
  Description of Artificial Sequence: Synthetic peptide
DENEIRTTNPVATEQYGSYSTNLQNQGNR

SEQ ID NO: 23511 - protein, 31 aa, Artificial Sequence
  Description of Artificial Sequence: Synthetic polypeptide
DEEEIRTTNPVATEQYGESVDSTNDQREGNR

SEQ ID NO: 23512 - protein, 28 aa, Artificial Sequence
  Description of Artificial Sequence: Synthetic peptide
SEEEIRATNPVCTEQYGSVSTNLQQGNR

SEQ ID NO: 23513 - protein, 28 aa, Artificial Sequence
  Description of Artificial Sequence: Synthetic peptide
DEEEIRTTNPVATEQYGSVSTNLEIGEF

SEQ ID NO: 23514 - protein, 28 aa, Artificial Sequence
  Description of Artificial Sequence: Synthetic peptide
DEEEIRTTNPVATEQYGSVSEDLQVGNL

SEQ ID NO: 23515 - protein, 28 aa, Artificial Sequence
  Description of Artificial Sequence: Synthetic peptide
DEEEIRTTNPVATEQYGSVSTDLEVGNF

SEQ ID NO: 23516 - protein, 28 aa, Artificial Sequence
  Description of Artificial Sequence: Synthetic peptide
DEEEIRTTNPVATEFYGSVSTNEQQGNV

SEQ ID NO: 23517 - protein, 30 aa, Artificial Sequence
  Description of Artificial Sequence: Synthetic polypeptide
DEEVIRTTNPVATEQYGSVSTNLRQNGQNR

SEQ ID NO: 23518 - protein, 30 aa, Artificial Sequence
  Description of Artificial Sequence: Synthetic polypeptide
DEEEIRTTNPVATEQYGSVSTNLQEIGNDI

SEQ ID NO: 23519 - protein, 31 aa, Artificial Sequence
  Description of Artificial Sequence: Synthetic polypeptide
DENEIRTTNPVATEQYGSVCSTNPLQRAGNR

SEQ ID NO: 23520 - protein, 28 aa, Artificial Sequence
  Description of Artificial Sequence: Synthetic peptide
VEEEIRTTNPVATEQYGSVATDWQRGNR

SEQ ID NO: 23521 - protein, 29 aa, Artificial Sequence
  Description of Artificial Sequence: Synthetic peptide
DEEEIRTTNPVATEQYGIVSTNLQYHGNS

SEQ ID NO: 23522 - protein, 30 aa, Artificial Sequence
  Description of Artificial Sequence: Synthetic polypeptide
DEEEIRTTNPVATEQYGSVSTNLVQIDGNV

SEQ ID NO: 23523 - protein, 28 aa, Artificial Sequence
  Description of Artificial Sequence: Synthetic peptide
DEQEIRTTNPEATEQYGSVSTDLERGNR

SEQ ID NO: 23524 - protein, 28 aa, Artificial Sequence
  Description of Artificial Sequence: Synthetic peptide
DEEEIRTTNPVATEQYGSVDTALQWDNR

SEQ ID NO: 23525 - protein, 28 aa, Artificial Sequence
  Description of Artificial Sequence: Synthetic peptide
DEEEIRTTNPVATEQYGAVATNLQFGDR

SEQ ID NO: 23526 - protein, 28 aa, Artificial Sequence
  Description of Artificial Sequence: Synthetic peptide
DEEEIRTTNPVATECWGSVSENLQRGNL

SEQ ID NO: 23527 - protein, 30 aa, Artificial Sequence
  Description of Artificial Sequence: Synthetic polypeptide
DEEEIRTTNPVATEQYGSVSTNDQLREGNP

SEQ ID NO: 23528 - protein, 28 aa, Artificial Sequence
  Description of Artificial Sequence: Synthetic peptide
NEEEIRTTNPVATEQYGSVDMNWQRGNR

SEQ ID NO: 23529 - protein, 28 aa, Artificial Sequence
  Description of Artificial Sequence: Synthetic peptide
DEEEIRTTNPDATEQYGSVFTNLDPGNR

SEQ ID NO: 23530 - protein, 28 aa, Artificial Sequence
  Description of Artificial Sequence: Synthetic peptide
DEEEIRTTNPVATEQWGSVSENEQRGNF

SEQ ID NO: 23531 - protein, 31 aa, Artificial Sequence
  Description of Artificial Sequence: Synthetic polypeptide
DEEEIRTTNPVATEQYGSVSTNEQREGDNTR

SEQ ID NO: 23532 - protein, 29 aa, Artificial Sequence
  Description of Artificial Sequence: Synthetic peptide
DEGEIRCTNPVATEQYGSVSTNLIFRGNR

SEQ ID NO: 23533 - protein, 28 aa, Artificial Sequence
  Description of Artificial Sequence: Synthetic peptide
DEEEIRTTNPVATEQYGSASTNLQHGQQ

SEQ ID NO: 23534 - protein, 30 aa, Artificial Sequence
  Description of Artificial Sequence: Synthetic polypeptide
DEEEIRTTNPVATEQYGSVSTNLQEIGNDQ

SEQ ID NO: 23535 - protein, 30 aa, Artificial Sequence
  Description of Artificial Sequence: Synthetic polypeptide
DEEEIRTTNPFATEQYGSVSTNLVDLRGNR

SEQ ID NO: 23536 - protein, 30 aa, Artificial Sequence
  Description of Artificial Sequence: Synthetic polypeptide
DEVEIRTTNPVATEQYGSVSTGNLQNGNTR

SEQ ID NO: 23537 - protein, 28 aa, Artificial Sequence
  Description of Artificial Sequence: Synthetic peptide
DEEEIRTTNPVATEQYGSVDTELQGGNI

SEQ ID NO: 23538 - protein, 29 aa, Artificial Sequence
  Description of Artificial Sequence: Synthetic peptide
DEEEIRTTNPVATEQYGSVSETNLERGEM

SEQ ID NO: 23539 - protein, 28 aa, Artificial Sequence
  Description of Artificial Sequence: Synthetic peptide
DEEEIATTNPVATEQYGSVSTNEQSGNS

SEQ ID NO: 23540 - protein, 28 aa, Artificial Sequence
  Description of Artificial Sequence: Synthetic peptide
DEEEIRTTNPAATEQYGSVSFNLQAGNQ

SEQ ID NO: 23541 - protein, 30 aa, Artificial Sequence
  Description of Artificial Sequence: Synthetic polypeptide
DENEIATTNPVATEQYGSVSTNLVQLRGNR

SEQ ID NO: 23542 - protein, 32 aa, Artificial Sequence
  Description of Artificial Sequence: Synthetic polypeptide
DEEEIRTTNPVATEQYGSVSTMNLQDREGDNF

SEQ ID NO: 23543 - protein, 31 aa, Artificial Sequence
  Description of Artificial Sequence: Synthetic polypeptide
DEEEIRCTNPVATEQYGSVSTCNLQRGINTQ

SEQ ID NO: 23544 - protein, 28 aa, Artificial Sequence
  Description of Artificial Sequence: Synthetic peptide
DEEEIRTTNPVATEQWGSVECPLQMGNR

SEQ ID NO: 23545 - protein, 30 aa, Artificial Sequence
  Description of Artificial Sequence: Synthetic polypeptide
DEEEIRTTNPVATEQYGSVSTNLEIEGNDC

SEQ ID NO: 23546 - protein, 31 aa, Artificial Sequence
  Description of Artificial Sequence: Synthetic polypeptide
DEEEIRTTNPEATEQYGSVSTENLQIRGEER

SEQ ID NO: 23547 - protein, 29 aa, Artificial Sequence
  Description of Artificial Sequence: Synthetic peptide
DEEEIRTTNPVATEQYGDVSENLQCTGER

SEQ ID NO: 23548 - protein, 28 aa, Artificial Sequence
  Description of Artificial Sequence: Synthetic peptide
DTEEIRTTNPVATEQYGSWHTNDIRGNR

SEQ ID NO: 23549 - protein, 28 aa, Artificial Sequence
  Description of Artificial Sequence: Synthetic peptide
DEEEIRTTNPEATEQYGSVSTEDQEGNY

SEQ ID NO: 23550 - protein, 28 aa, Artificial Sequence
  Description of Artificial Sequence: Synthetic peptide
GEEEIRATNPVATEQYGVVSTNLERGNW

SEQ ID NO: 23551 - protein, 29 aa, Artificial Sequence
  Description of Artificial Sequence: Synthetic peptide
DEEEIRTTNPVATMQYGSVSDFLQLGNGR

SEQ ID NO: 23552 - protein, 28 aa, Artificial Sequence
  Description of Artificial Sequence: Synthetic peptide
DEQEIATTNIVATECYGSVSTDLQRGNR

SEQ ID NO: 23553 - protein, 28 aa, Artificial Sequence
  Description of Artificial Sequence: Synthetic peptide
DEQEIRTTNPEATEQYGSVSTNLQIEER

SEQ ID NO: 23554 - protein, 28 aa, Artificial Sequence
  Description of Artificial Sequence: Synthetic peptide
DEEEIRTTNIVATEIYGSVSTDEQQGNR

SEQ ID NO: 23555 - protein, 28 aa, Artificial Sequence
  Description of Artificial Sequence: Synthetic peptide
DAECIRTTNPVAYEIYGSVSTNDQRGNR

SEQ ID NO: 23556 - protein, 28 aa, Artificial Sequence
  Description of Artificial Sequence: Synthetic peptide
DEEEIRTTNPVATEQYGSVSTDDEGGER

SEQ ID NO: 23557 - protein, 28 aa, Artificial Sequence
  Description of Artificial Sequence: Synthetic peptide
DEEEIYCTNPVATEQFGSVSTNLQHGDR

SEQ ID NO: 23558 - protein, 28 aa, Artificial Sequence
  Description of Artificial Sequence: Synthetic peptide
DEEEIRQTNPVATEQYGSVSENLMRMNQ

SEQ ID NO: 23559 - protein, 31 aa, Artificial Sequence
  Description of Artificial Sequence: Synthetic polypeptide
DEEEIRTTNPVATEQYGSVHSTNDQVAGQNR

SEQ ID NO: 23560 - protein, 28 aa, Artificial Sequence
  Description of Artificial Sequence: Synthetic peptide
DEEEIRTTNPVATEQYGSVETPLQHGEH

SEQ ID NO: 23561 - protein, 31 aa, Artificial Sequence
  Description of Artificial Sequence: Synthetic polypeptide
MEEEIRTTNPVATEQYGSVSTNLQENEGNDR

SEQ ID NO: 23562 - protein, 28 aa, Artificial Sequence
  Description of Artificial Sequence: Synthetic peptide
DEQEIRTTNPVCYEIYGAVSTNLQRGNR

SEQ ID NO: 23563 - protein, 30 aa, Artificial Sequence
  Description of Artificial Sequence: Synthetic polypeptide
QEEEIRTVNPVATEQYGSVSTNPGQRGVNR

SEQ ID NO: 23564 - protein, 28 aa, Artificial Sequence
  Description of Artificial Sequence: Synthetic peptide
DEGEIRTTNPAATEQYGSVSANLQFGNF

SEQ ID NO: 23565 - protein, 28 aa, Artificial Sequence
  Description of Artificial Sequence: Synthetic peptide
DEEEIRTTNPFATEQYGSVSTPLLPGNP

SEQ ID NO: 23566 - protein, 30 aa, Artificial Sequence
  Description of Artificial Sequence: Synthetic polypeptide
DEEEIRATNPVATEIYGSVYSTNLQREGPR

SEQ ID NO: 23567 - protein, 29 aa, Artificial Sequence
  Description of Artificial Sequence: Synthetic peptide
QENEIRTTNPVATEQYGSVSTNLELGNDR

SEQ ID NO: 23568 - protein, 28 aa, Artificial Sequence
  Description of Artificial Sequence: Synthetic peptide
DEDEIRTTNPVATETYGSVSTNLQTGDF

SEQ ID NO: 23569 - protein, 30 aa, Artificial Sequence
  Description of Artificial Sequence: Synthetic polypeptide
DEEEIRTTNPVATEQYGLSWSITDDQRGNR

SEQ ID NO: 23570 - protein, 32 aa, Artificial Sequence
  Description of Artificial Sequence: Synthetic polypeptide
DEEEIRTTNPVATEQYGSVSTDLQDREGENDR

SEQ ID NO: 23571 - protein, 28 aa, Artificial Sequence
  Description of Artificial Sequence: Synthetic peptide
QEEEIRAVNPVSTEQYGSVSTNLQHGNR

SEQ ID NO: 23572 - protein, 28 aa, Artificial Sequence
  Description of Artificial Sequence: Synthetic peptide
DEEEIRQTNPVATEQYGIVSTNLQMGMV

SEQ ID NO: 23573 - protein, 28 aa, Artificial Sequence
  Description of Artificial Sequence: Synthetic peptide
DEEEIAQTNPVATEQYGSVSEVLQHGNR

SEQ ID NO: 23574 - protein, 31 aa, Artificial Sequence
  Description of Artificial Sequence: Synthetic polypeptide
DEEEIRTTNPVATEQYGSVSTDNDVERDGNR

SEQ ID NO: 23575 - protein, 29 aa, Artificial Sequence
  Description of Artificial Sequence: Synthetic peptide
DEEEIRTTNPVASEQYGEVSATNLQFGLR

SEQ ID NO: 23576 - protein, 30 aa, Artificial Sequence
  Description of Artificial Sequence: Synthetic polypeptide
DEEEIRTTNPVAWETYGSVETNGLQRGDNR

SEQ ID NO: 23577 - protein, 28 aa, Artificial Sequence
  Description of Artificial Sequence: Synthetic peptide
DETEIRGTNPCATEQYGSVFTNDQRGNR

SEQ ID NO: 23578 - protein, 28 aa, Artificial Sequence
  Description of Artificial Sequence: Synthetic peptide
KEEEIRTVNPVATECYGSVSTDLQRGNN

SEQ ID NO: 23579 - protein, 31 aa, Artificial Sequence
  Description of Artificial Sequence: Synthetic polypeptide
DEEEIRTTNPFATEQFGSVSVTNGLQRGDNR

SEQ ID NO: 23580 - protein, 28 aa, Artificial Sequence
  Description of Artificial Sequence: Synthetic peptide
VEGEIRATNPVATECYGSVSTNLQRGTR

SEQ ID NO: 23581 - protein, 28 aa, Artificial Sequence
  Description of Artificial Sequence: Synthetic peptide
MENEIRTVNPVATEQYGSVSTNLQNGNM

SEQ ID NO: 23582 - protein, 29 aa, Artificial Sequence
  Description of Artificial Sequence: Synthetic peptide
DENEIRCTNPVSTELYGSVSTNLQRNGNR

SEQ ID NO: 23583 - protein, 32 aa, Artificial Sequence
  Description of Artificial Sequence: Synthetic polypeptide
DEEEIRTTNPVATEQYGSVSCTMDLQCRGNDR

SEQ ID NO: 23584 - protein, 28 aa, Artificial Sequence
  Description of Artificial Sequence: Synthetic peptide
DEEEIRPTNPVATEQYGFVSTNQQEGER

SEQ ID NO: 23585 - protein, 30 aa, Artificial Sequence
  Description of Artificial Sequence: Synthetic polypeptide
DEEEIRTTNPVATEQYGSVSCENLQCAGNM

SEQ ID NO: 23586 - protein, 28 aa, Artificial Sequence
  Description of Artificial Sequence: Synthetic peptide
DEEEIRTTNPAASEQYGNVSTNLQIGNQ

SEQ ID NO: 23587 - protein, 30 aa, Artificial Sequence
  Description of Artificial Sequence: Synthetic polypeptide
DEEEIRTTNPVATEQYGSVSTDLQEQGEDR

SEQ ID NO: 23588 - protein, 28 aa, Artificial Sequence
  Description of Artificial Sequence: Synthetic peptide
DEFEIRTTNPVATEQYGLVSTHLQHGNP

SEQ ID NO: 23589 - protein, 28 aa, Artificial Sequence
  Description of Artificial Sequence: Synthetic peptide
MEGEIVTTNPVATEQYGDVSTNLQRGER

SEQ ID NO: 23590 - protein, 30 aa, Artificial Sequence
  Description of Artificial Sequence: Synthetic polypeptide
DEEEIRTTNPVATEQYGSVSTEDQRGENEF

SEQ ID NO: 23591 - protein, 28 aa, Artificial Sequence
  Description of Artificial Sequence: Synthetic peptide
DEEECRTTNPVATEQYGSVSTDLQMGEH

SEQ ID NO: 23592 - protein, 28 aa, Artificial Sequence
  Description of Artificial Sequence: Synthetic peptide
DEEEIRTTNIVATEQYGDVSTDLQSGER

SEQ ID NO: 23593 - protein, 30 aa, Artificial Sequence
  Description of Artificial Sequence: Synthetic polypeptide
DEEEIRTTNPVATEQYGSVEETNLDRGEER

SEQ ID NO: 23594 - protein, 29 aa, Artificial Sequence
  Description of Artificial Sequence: Synthetic peptide
DEEEITTTNPVATEQYGSVSTNLQDTGEI

SEQ ID NO: 23595 - protein, 28 aa, Artificial Sequence
  Description of Artificial Sequence: Synthetic peptide
KEEEIRTTNPVATECYGEVSENEQRGNR

SEQ ID NO: 23596 - protein, 30 aa, Artificial Sequence
  Description of Artificial Sequence: Synthetic polypeptide
DEEEIRTTNPLATEQYGSVVANPLQLRGNR

SEQ ID NO: 23597 - protein, 28 aa, Artificial Sequence
  Description of Artificial Sequence: Synthetic peptide
DEEEISSTNPVATEWYGDVSTNLQRGTR

SEQ ID NO: 23598 - protein, 29 aa, Artificial Sequence
  Description of Artificial Sequence: Synthetic peptide
REEEIRTTNPVATEQYGSVSEILQIAGNR

SEQ ID NO: 23599 - protein, 29 aa, Artificial Sequence
  Description of Artificial Sequence: Synthetic peptide
DEEEIRTVNPVATEMYGVVSTELQREGNR

SEQ ID NO: 23600 - protein, 31 aa, Artificial Sequence
  Description of Artificial Sequence: Synthetic polypeptide
DEEEIAQTNPVATEQYGSVSTNNLVQRGNPR

SEQ ID NO: 23601 - protein, 28 aa, Artificial Sequence
  Description of Artificial Sequence: Synthetic peptide
DEEEIRTTNPEATEQYGSVSTDLQQGEG

SEQ ID NO: 23602 - protein, 28 aa, Artificial Sequence
  Description of Artificial Sequence: Synthetic peptide
DEEEIRSTNPVATEQYGVVSTELQRGEA

SEQ ID NO: 23603 - protein, 28 aa, Artificial Sequence
  Description of Artificial Sequence: Synthetic peptide
DEEEIRTTNPVATDQYGSVSNELQMGNQ

SEQ ID NO: 23604 - protein, 28 aa, Artificial Sequence
  Description of Artificial Sequence: Synthetic peptide
DEEEIRTTNPVATEVFGWVGTNLQRLNR

SEQ ID NO: 23605 - protein, 28 aa, Artificial Sequence
  Description of Artificial Sequence: Synthetic peptide
MEEEIWTTNPVATEQYGSVSNLLQHGNR

SEQ ID NO: 23606 - protein, 31 aa, Artificial Sequence
  Description of Artificial Sequence: Synthetic polypeptide
DEEEIRTTNPVATEQYGSVEETNPLQPGDNR

SEQ ID NO: 23607 - protein, 28 aa, Artificial Sequence
  Description of Artificial Sequence: Synthetic peptide
DDEEIRTTNPCSSEHYGSVSTNLQRGNR

SEQ ID NO: 23608 - protein, 28 aa, Artificial Sequence
  Description of Artificial Sequence: Synthetic peptide
DEEEIRTTNIVATEQYGSVSEELENGNR

SEQ ID NO: 23609 - protein, 28 aa, Artificial Sequence
  Description of Artificial Sequence: Synthetic peptide
DEQEIRQTNPVATEQYGSASTVLQRGGR

SEQ ID NO: 23610 - protein, 28 aa, Artificial Sequence
  Description of Artificial Sequence: Synthetic peptide
AEEEISQTNPVACEQYGIVSTNLQRGNR

SEQ ID NO: 23611 - protein, 30 aa, Artificial Sequence
  Description of Artificial Sequence: Synthetic polypeptide
DEEEITTTNPVATEQYGGVSTINLQRGDND

SEQ ID NO: 23612 - protein, 30 aa, Artificial Sequence
  Description of Artificial Sequence: Synthetic polypeptide
DEVEIRTTNPTATEQYGSVSENLPQDRGNR

SEQ ID NO: 23613 - protein, 28 aa, Artificial Sequence
  Description of Artificial Sequence: Synthetic peptide
DEEEIATTNPVATEQYGSVENNLQDGNA

SEQ ID NO: 23614 - protein, 28 aa, Artificial Sequence
  Description of Artificial Sequence: Synthetic peptide
DEDEIRTVNPVATEGYGVVSTNWQRGNR

SEQ ID NO: 23615 - protein, 28 aa, Artificial Sequence
  Description of Artificial Sequence: Synthetic peptide
DEEEIRCTNPAATEQFGSVSTDLQRGNG

SEQ ID NO: 23616 - protein, 28 aa, Artificial Sequence
  Description of Artificial Sequence: Synthetic peptide
DEEEIRTTNPVATEQYGSVETNEQIGDV

SEQ ID NO: 23617 - protein, 30 aa, Artificial Sequence
  Description of Artificial Sequence: Synthetic polypeptide
DEIEIRTTNPVATEQYGSVSTCNWQRGDNH

SEQ ID NO: 23618 - protein, 31 aa, Artificial Sequence
  Description of Artificial Sequence: Synthetic polypeptide
DEEEIRTTNPVCTEQYGSVDTENLQYRGNDR

SEQ ID NO: 23619 - protein, 28 aa, Artificial Sequence
  Description of Artificial Sequence: Synthetic peptide
DEEEIRTTNPFATEQYGSVSTADLQGNL

SEQ ID NO: 23620 - protein, 28 aa, Artificial Sequence
  Description of Artificial Sequence: Synthetic peptide
DEEEIRTTNPDATEQYGSVSTNEDPGNG

SEQ ID NO: 23621 - protein, 30 aa, Artificial Sequence
  Description of Artificial Sequence: Synthetic polypeptide
DEVEIRTTNPCATEQFGSVSTQNLQRGNDR

SEQ ID NO: 23622 - protein, 28 aa, Artificial Sequence
  Description of Artificial Sequence: Synthetic peptide
DEEEIVTTNPVATEQFGSVSTNLQCPER

SEQ ID NO: 23623 - protein, 29 aa, Artificial Sequence
  Description of Artificial Sequence: Synthetic peptide
LEGEIRTTNPVATEQYGSVWSTNLQWQNR

SEQ ID NO: 23624 - protein, 28 aa, Artificial Sequence
  Description of Artificial Sequence: Synthetic peptide
DEEEIRTTNIVATEQYISVRTNLQSGNN

SEQ ID NO: 23625 - protein, 28 aa, Artificial Sequence
  Description of Artificial Sequence: Synthetic peptide
DEEEIRTTNPVATEIYGVVSTELQIGND

SEQ ID NO: 23626 - protein, 32 aa, Artificial Sequence
  Description of Artificial Sequence: Synthetic polypeptide
DEEEIRTTNPVATEQYGSYVSLTNPLVERGNR

SEQ ID NO: 23627 - protein, 30 aa, Artificial Sequence
  Description of Artificial Sequence: Synthetic polypeptide
AEEEIRTTNPVATEQYGEVSTELQRKGNPR

SEQ ID NO: 23628 - protein, 28 aa, Artificial Sequence
  Description of Artificial Sequence: Synthetic peptide
DEDEIATTNIVATEVYGSVSTNLQRGNQ

SEQ ID NO: 23629 - protein, 28 aa, Artificial Sequence
  Description of Artificial Sequence: Synthetic peptide
DEQEIRTTNPVATEQYGSVETNLQIGEI

SEQ ID NO: 23630 - protein, 29 aa, Artificial Sequence
  Description of Artificial Sequence: Synthetic peptide
DEEEIRTTNPVATEQYGSVDTNLFVVKNR

SEQ ID NO: 23631 - protein, 29 aa, Artificial Sequence
  Description of Artificial Sequence: Synthetic peptide
DENEIRTTNPCATEQYGSVSTDLQRGEDR

SEQ ID NO: 23632 - protein, 28 aa, Artificial Sequence
  Description of Artificial Sequence: Synthetic peptide
DDEEIRCTNPVASEQYGCVSMNLQRGNR

SEQ ID NO: 23633 - protein, 29 aa, Artificial Sequence
  Description of Artificial Sequence: Synthetic peptide
QEQEIVTTNPVATEQYGSVSAENLQRGNR

SEQ ID NO: 23634 - protein, 28 aa, Artificial Sequence
  Description of Artificial Sequence: Synthetic peptide
DEEEIWTTNPVGTEQYGSVCCNLQRPNR

SEQ ID NO: 23635 - protein, 31 aa, Artificial Sequence
  Description of Artificial Sequence: Synthetic polypeptide
DEQEIRTTNPVATEPYGSVSTNLQCREGNDR

SEQ ID NO: 23636 - protein, 28 aa, Artificial Sequence
  Description of Artificial Sequence: Synthetic peptide
DEEEIRTTNPTAYALYGDVSTNLQRGNR

SEQ ID NO: 23637 - protein, 31 aa, Artificial Sequence
  Description of Artificial Sequence: Synthetic polypeptide
DEEEIRTTNPTATEQYGSVSECNLQRGDNTR

SEQ ID NO: 23638 - protein, 28 aa, Artificial Sequence
  Description of Artificial Sequence: Synthetic peptide
DEDEITCTNPVATEMYGIVSTNLQRGNR

SEQ ID NO: 23639 - protein, 32 aa, Artificial Sequence
  Description of Artificial Sequence: Synthetic polypeptide
DEEEIHTTNPVATEQYGSVSTTNPLQRGENPR

SEQ ID NO: 23640 - protein, 28 aa, Artificial Sequence
  Description of Artificial Sequence: Synthetic peptide
NEEEVRCTNPVATEQYGCVSMNLQRGNR

SEQ ID NO: 23641 - protein, 30 aa, Artificial Sequence
  Description of Artificial Sequence: Synthetic polypeptide
DEEEIRTTNPVATEQYGSVSCENLQCAGNN

SEQ ID NO: 23642 - protein, 30 aa, Artificial Sequence
  Description of Artificial Sequence: Synthetic polypeptide
DEEEITTTNPVATEQYGSVISTNEQDHGNR

SEQ ID NO: 23643 - protein, 29 aa, Artificial Sequence
  Description of Artificial Sequence: Synthetic peptide
DESEIRTVNPVATEQYGSVGATNLQRGMR

SEQ ID NO: 23644 - protein, 30 aa, Artificial Sequence
  Description of Artificial Sequence: Synthetic polypeptide
DEEEIRTTNPVATEQYGSVSTCLQLFGNDN

SEQ ID NO: 23645 - protein, 32 aa, Artificial Sequence
  Description of Artificial Sequence: Synthetic polypeptide
DEEEIRTTNPVATEQYGSVSCTMNLQCRGNDD

SEQ ID NO: 23646 - protein, 30 aa, Artificial Sequence
  Description of Artificial Sequence: Synthetic polypeptide
DEEEIRTTNPVATEQYGSVSTNEQEIGNTH

SEQ ID NO: 23647 - protein, 29 aa, Artificial Sequence
  Description of Artificial Sequence: Synthetic peptide
DEEEIRTTNPVATEQYGSVDTELERGNDH

SEQ ID NO: 23648 - protein, 28 aa, Artificial Sequence
  Description of Artificial Sequence: Synthetic peptide
DEEEIRTTNPEATEQYGSVSTDLDSGNV

SEQ ID NO: 23649 - protein, 28 aa, Artificial Sequence
  Description of Artificial Sequence: Synthetic peptide
DEEEITATNPVSTEQYGSVAVNLQRGNR

SEQ ID NO: 23650 - protein, 30 aa, Artificial Sequence
  Description of Artificial Sequence: Synthetic polypeptide
DEEEIRTTNPVATECYGSVSTNLQDYGNDQ

SEQ ID NO: 23651 - protein, 30 aa, Artificial Sequence
  Description of Artificial Sequence: Synthetic polypeptide
DEVEIRTTNPVATEQYGSVSTNLQCAGNDM

SEQ ID NO: 23652 - protein, 28 aa, Artificial Sequence
  Description of Artificial Sequence: Synthetic peptide
DDEEIRTTNPTATEVYGSVSTDLQRGND

SEQ ID NO: 23653 - protein, 28 aa, Artificial Sequence
  Description of Artificial Sequence: Synthetic peptide
DEEEIRCVNPCATEQYGAVSTNLERGNR

SEQ ID NO: 23654 - protein, 28 aa, Artificial Sequence
  Description of Artificial Sequence: Synthetic peptide
DEEEIRATNPIATEHYGAVSTNLERGNR

SEQ ID NO: 23655 - protein, 28 aa, Artificial Sequence
  Description of Artificial Sequence: Synthetic peptide
DEEEIRTTNPVATECYGSVSTNLEIGED

SEQ ID NO: 23656 - protein, 31 aa, Artificial Sequence
  Description of Artificial Sequence: Synthetic polypeptide
DEEEIRTTNPVATEQYGSVSVTMNLYMRGND

SEQ ID NO: 23657 - protein, 29 aa, Artificial Sequence
  Description of Artificial Sequence: Synthetic peptide
DEEEVRTTNPCATEQYGSVANNLQRNGNR

SEQ ID NO: 23658 - protein, 30 aa, Artificial Sequence
  Description of Artificial Sequence: Synthetic polypeptide
EEEEIRTTNPLVATGQYGVSVSTNLQRGIR

SEQ ID NO: 23659 - protein, 29 aa, Artificial Sequence
  Description of Artificial Sequence: Synthetic peptide
DEEEIRTTNPVATEQYGSVSEDLQVGNDS

SEQ ID NO: 23660 - protein, 31 aa, Artificial Sequence
  Description of Artificial Sequence: Synthetic polypeptide
DEEEIRTTNPVATEQYGSVSTNLQINNGENW

SEQ ID NO: 23661 - protein, 33 aa, Artificial Sequence
  Description of Artificial Sequence: Synthetic polypeptide
DEEEIRTTNPVATEQYGSVSDTENGLQRGDNER

SEQ ID NO: 23662 - protein, 30 aa, Artificial Sequence
  Description of Artificial Sequence: Synthetic polypeptide
DEEEIRTTNPVATEQYGCVLSTNLQTGNDA

SEQ ID NO: 23663 - protein, 28 aa, Artificial Sequence
  Description of Artificial Sequence: Synthetic peptide
DESSIRTTNPVATTQYGSVSTNLQEGNN

SEQ ID NO: 23664 - protein, 33 aa, Artificial Sequence
  Description of Artificial Sequence: Synthetic polypeptide
DEEEIRTTNPVATEQYGESVDSDTDNLQRKGNR

SEQ ID NO: 23665 - protein, 29 aa, Artificial Sequence
  Description of Artificial Sequence: Synthetic peptide
DENEIRTTNPVATEQYGSVSTNLQIGEDN

SEQ ID NO: 23666 - protein, 29 aa, Artificial Sequence
  Description of Artificial Sequence: Synthetic peptide
DEEEIRTTNPVATEQYGVVSTDLEVGENR

SEQ ID NO: 23667 - protein, 31 aa, Artificial Sequence
  Description of Artificial Sequence: Synthetic polypeptide
DEETIRTTNPVATFQYGSVSTNALQQIRGNR

SEQ ID NO: 23668 - protein, 28 aa, Artificial Sequence
  Description of Artificial Sequence: Synthetic peptide
DEEEIRTTNPVASEQYGSTSTPLQAGNS

SEQ ID NO: 23669 - protein, 28 aa, Artificial Sequence
  Description of Artificial Sequence: Synthetic peptide
DEEAIRTTNPVATEQYGHVSMNFDRGNR

SEQ ID NO: 23670 - protein, 30 aa, Artificial Sequence
  Description of Artificial Sequence: Synthetic polypeptide
DEEEIRTTNPEATEQYGSVSTNPDERGNPR

SEQ ID NO: 23671 - protein, 30 aa, Artificial Sequence
  Description of Artificial Sequence: Synthetic polypeptide
WEEEIRTTNPVATEQYGSVSTLNWLTHGNR

SEQ ID NO: 23672 - protein, 29 aa, Artificial Sequence
  Description of Artificial Sequence: Synthetic peptide
DEHEIRTTNPVATEQYGVVDENLQERGNR

SEQ ID NO: 23673 - protein, 28 aa, Artificial Sequence
  Description of Artificial Sequence: Synthetic peptide
DEEEIRTTNIVATESYGSVSTDLQRQND

SEQ ID NO: 23674 - protein, 28 aa, Artificial Sequence
  Description of Artificial Sequence: Synthetic peptide
DDDEIRCTNPVSTEQYGSVSTGLQRGNR

SEQ ID NO: 23675 - protein, 30 aa, Artificial Sequence
  Description of Artificial Sequence: Synthetic polypeptide
DEEEIRTTNPVATEQYGESVSTPLQALGNI

SEQ ID NO: 23676 - protein, 31 aa, Artificial Sequence
  Description of Artificial Sequence: Synthetic polypeptide
DEEEIRTTNPVATEQYGSVSTNDVQREGNDF

SEQ ID NO: 23677 - protein, 28 aa, Artificial Sequence
  Description of Artificial Sequence: Synthetic peptide
DEEEITTTNPVATQQYGSVFTNDQEGNR

SEQ ID NO: 23678 - protein, 31 aa, Artificial Sequence
  Description of Artificial Sequence: Synthetic polypeptide
DEEEIRTTNPVATEQYGSVDTNLPQQLGNYR

SEQ ID NO: 23679 - protein, 28 aa, Artificial Sequence
  Description of Artificial Sequence: Synthetic peptide
DEECIRTTNPVATEQYGSWSTPLQPGER

SEQ ID NO: 23680 - protein, 28 aa, Artificial Sequence
  Description of Artificial Sequence: Synthetic peptide
SEEEIRTTNPAATEQFGSVSTNLQRGTL

SEQ ID NO: 23681 - protein, 32 aa, Artificial Sequence
  Description of Artificial Sequence: Synthetic polypeptide
DEEEIRTTNPVATEQYGSVSCTMDLQDRGNDR

SEQ ID NO: 23682 - protein, 30 aa, Artificial Sequence
  Description of Artificial Sequence: Synthetic polypeptide
DEEEIRTTNPVATECYGSVSATNLQVEGER

SEQ ID NO: 23683 - protein, 30 aa, Artificial Sequence
  Description of Artificial Sequence: Synthetic polypeptide
DEEEIRTTNPVCTEQYGDVSTMDLQRGNDR

SEQ ID NO: 23684 - protein, 28 aa, Artificial Sequence
  Description of Artificial Sequence: Synthetic peptide
DEEEIRTTNPVATEQYGSVSTDDDEGNV

SEQ ID NO: 23685 - protein, 28 aa, Artificial Sequence
  Description of Artificial Sequence: Synthetic peptide
DTEEIRTTNPHATEQYGSVSYNLDRGNW

SEQ ID NO: 23686 - protein, 28 aa, Artificial Sequence
  Description of Artificial Sequence: Synthetic peptide
DEEEIRTTNPFATEQYGSVSTNLNTGEN

SEQ ID NO: 23687 - protein, 31 aa, Artificial Sequence
  Description of Artificial Sequence: Synthetic polypeptide
DEEEIRTTNPVATEQYGSVSTNLEDREGNDL

SEQ ID NO: 23688 - protein, 28 aa, Artificial Sequence
  Description of Artificial Sequence: Synthetic peptide
DEEEIRTTNPVATECWGSVHTNLMRGNA

SEQ ID NO: 23689 - protein, 28 aa, Artificial Sequence
  Description of Artificial Sequence: Synthetic peptide
DEEEVRTTNPCATEPYGAVSNNLQRGNR

SEQ ID NO: 23690 - protein, 28 aa, Artificial Sequence
  Description of Artificial Sequence: Synthetic peptide
DEEEIRTVNPVSTECYGCVGTNLQRGNR

SEQ ID NO: 23691 - protein, 28 aa, Artificial Sequence
  Description of Artificial Sequence: Synthetic peptide
DVEEIRTTNPVATEFYGSVSTNEQQGNV

SEQ ID NO: 23692 - protein, 32 aa, Artificial Sequence
  Description of Artificial Sequence: Synthetic polypeptide
DEEEIRTTNPVATEQYWGWSVDSETDLQRGNR

SEQ ID NO: 23693 - protein, 28 aa, Artificial Sequence
  Description of Artificial Sequence: Synthetic peptide
DEEKIDTTNPVATEQYGSVSTPFQRGNH

SEQ ID NO: 23694 - protein, 28 aa, Artificial Sequence
  Description of Artificial Sequence: Synthetic peptide
DLEEIRTTNPVATHQWGSVSTNLERGNG

SEQ ID NO: 23695 - protein, 28 aa, Artificial Sequence
  Description of Artificial Sequence: Synthetic peptide
YEEEIRTTNPVATEQYGSVSSELQAGNY

SEQ ID NO: 23696 - protein, 28 aa, Artificial Sequence
  Description of Artificial Sequence: Synthetic peptide
DEEEIRTTNPVATEQYGSVSTCLEAGEV

SEQ ID NO: 23697 - protein, 31 aa, Artificial Sequence
  Description of Artificial Sequence: Synthetic polypeptide
HEEEIRTTNPVATEQYGVVSTNNNLQRGINR

SEQ ID NO: 23698 - protein, 28 aa, Artificial Sequence
  Description of Artificial Sequence: Synthetic peptide
DEEEIATTNIVATEQYGVVSENLQRGNI

SEQ ID NO: 23699 - protein, 30 aa, Artificial Sequence
  Description of Artificial Sequence: Synthetic polypeptide
DEEEIRTTNPEATEQYGSVSETDLQRGNPV

SEQ ID NO: 23700 - protein, 31 aa, Artificial Sequence
  Description of Artificial Sequence: Synthetic polypeptide
DEEEIRTTNPVATEQYGSVDSTNLEREGDNW

SEQ ID NO: 23701 - protein, 29 aa, Artificial Sequence
  Description of Artificial Sequence: Synthetic peptide
DENEIRTTNPTATEQYGSVISTNPQNGNR

SEQ ID NO: 23702 - protein, 28 aa, Artificial Sequence
  Description of Artificial Sequence: Synthetic peptide
DEEEIRTTNPEATEQYGSVSTDLERGDI

SEQ ID NO: 23703 - protein, 30 aa, Artificial Sequence
  Description of Artificial Sequence: Synthetic polypeptide
SEEEIRTTNPVATEQYGSVSVTGLQIRGLR

SEQ ID NO: 23704 - protein, 30 aa, Artificial Sequence
  Description of Artificial Sequence: Synthetic polypeptide
DEEEIRTTNPVATEQYGSVETGLQHKGNDR

SEQ ID NO: 23705 - protein, 28 aa, Artificial Sequence
  Description of Artificial Sequence: Synthetic peptide
DENEIRTTNIVATEQYGSVSTNLEHGNS

SEQ ID NO: 23706 - protein, 30 aa, Artificial Sequence
  Description of Artificial Sequence: Synthetic polypeptide
DEEEIRTTNPVCTEQYGSVDCTNLQCHGNR

SEQ ID NO: 23707 - protein, 30 aa, Artificial Sequence
  Description of Artificial Sequence: Synthetic polypeptide
DEEEIRTTNPDATEQYGSVSTNLQRGVLDE

SEQ ID NO: 23708 - protein, 28 aa, Artificial Sequence
  Description of Artificial Sequence: Synthetic peptide
DEECIRTTNPVATEQYGSVSDNGQFGND

SEQ ID NO: 23709 - protein, 31 aa, Artificial Sequence
  Description of Artificial Sequence: Synthetic polypeptide
DEMEIRTTNPVATEIYGSVSITNPLQRAGNR

SEQ ID NO: 23710 - protein, 30 aa, Artificial Sequence
  Description of Artificial Sequence: Synthetic polypeptide
DEEEIRPTNPVCTEQYGSVSSLTELQRGNR

SEQ ID NO: 23711 - protein, 28 aa, Artificial Sequence
  Description of Artificial Sequence: Synthetic peptide
DEEEIVTTNPVATEIYGVVSTNLQRGED

SEQ ID NO: 23712 - protein, 28 aa, Artificial Sequence
  Description of Artificial Sequence: Synthetic peptide
SEEEIRTTNIVATEQYGSVSTNLQAENW

SEQ ID NO: 23713 - protein, 28 aa, Artificial Sequence
  Description of Artificial Sequence: Synthetic peptide
DEEEIRTTNPEATQQYGSVSTELQMGNM

SEQ ID NO: 23714 - protein, 28 aa, Artificial Sequence
  Description of Artificial Sequence: Synthetic peptide
DEEEIRTTNPVATCQWGDVHTNLMRGNR

SEQ ID NO: 23715 - protein, 28 aa, Artificial Sequence
  Description of Artificial Sequence: Synthetic peptide
QEQEIRQTNPVATEQYGSVSTVLQRGGR

SEQ ID NO: 23716 - protein, 29 aa, Artificial Sequence
  Description of Artificial Sequence: Synthetic peptide
DEEEIRTTNPVATEQYGSVSETEEQTGNA

SEQ ID NO: 23717 - protein, 28 aa, Artificial Sequence
  Description of Artificial Sequence: Synthetic peptide
DEQEIRTTNPVATECWGSVSTNEQQGNR

SEQ ID NO: 23718 - protein, 31 aa, Artificial Sequence
  Description of Artificial Sequence: Synthetic polypeptide
DEEEIRTTNPVATEQYGSVSETNLEDDGENR

SEQ ID NO: 23719 - protein, 28 aa, Artificial Sequence
  Description of Artificial Sequence: Synthetic peptide
DEEEIRTTNPEATEQYGSVSTELQMGEY

SEQ ID NO: 23720 - protein, 28 aa, Artificial Sequence
  Description of Artificial Sequence: Synthetic peptide
DEQEIACTNPVATELYGWVSTNLQRGNR

SEQ ID NO: 23721 - protein, 31 aa, Artificial Sequence
  Description of Artificial Sequence: Synthetic polypeptide
DEEEIRTTNPVATEQYGSVSTNLQEVEGNDD

SEQ ID NO: 23722 - protein, 32 aa, Artificial Sequence
  Description of Artificial Sequence: Synthetic polypeptide
DEEEIRTTNPVATEQYGSVESTENPLQRGEKR

SEQ ID NO: 23723 - protein, 30 aa, Artificial Sequence
  Description of Artificial Sequence: Synthetic polypeptide
DENEIRTTNPVATEQYGSVCPTNPLCRGNR

SEQ ID NO: 23724 - protein, 30 aa, Artificial Sequence
  Description of Artificial Sequence: Synthetic polypeptide
SEEEIRTTNPAATEQFGSVSTGNLQRGPNR

SEQ ID NO: 23725 - protein, 31 aa, Artificial Sequence
  Description of Artificial Sequence: Synthetic polypeptide
DEEEIRCTNPVATEQYGSVSTMELQQREGNR

SEQ ID NO: 23726 - protein, 31 aa, Artificial Sequence
  Description of Artificial Sequence: Synthetic polypeptide
DEEEIRTTNPVATEQYGSVSTEELQQGENDR

SEQ ID NO: 23727 - protein, 28 aa, Artificial Sequence
  Description of Artificial Sequence: Synthetic peptide
DEEEIATTNIVATEQYGSVSENEQGGNR

SEQ ID NO: 23728 - protein, 28 aa, Artificial Sequence
  Description of Artificial Sequence: Synthetic peptide
DEEENRSTNIVATEGYGSVSNNLQRGNR

SEQ ID NO: 23729 - protein, 31 aa, Artificial Sequence
  Description of Artificial Sequence: Synthetic polypeptide
DEQEIRTTNPVATEQYGESVSTNPLQVNGNR

SEQ ID NO: 23730 - protein, 31 aa, Artificial Sequence
  Description of Artificial Sequence: Synthetic polypeptide
DEEEIRTTNPFATEQYGSVSTNLQVPMGVNR

SEQ ID NO: 23731 - protein, 30 aa, Artificial Sequence
  Description of Artificial Sequence: Synthetic polypeptide
DEEEIRTTNPVATEQYGNVDETNLQIGYNR

SEQ ID NO: 23732 - protein, 28 aa, Artificial Sequence
  Description of Artificial Sequence: Synthetic peptide
DEEEIRTTNPVATECYGVVSTNLQTGEY

SEQ ID NO: 23733 - protein, 28 aa, Artificial Sequence
  Description of Artificial Sequence: Synthetic peptide
DEEEIRTTNPVATEQYGSASECLQREER

SEQ ID NO: 23734 - protein, 28 aa, Artificial Sequence
  Description of Artificial Sequence: Synthetic peptide
DENEIRTTNPVATELYGWVSTNLQNGNC

SEQ ID NO: 23735 - protein, 28 aa, Artificial Sequence
  Description of Artificial Sequence: Synthetic peptide
DEEEIRTTNPFATEQYGSVSTGLDPGNP

SEQ ID NO: 23736 - protein, 28 aa, Artificial Sequence
  Description of Artificial Sequence: Synthetic peptide
DESEVRTTNPVATEIYGSVSNNLQRLNR

SEQ ID NO: 23737 - protein, 28 aa, Artificial Sequence
  Description of Artificial Sequence: Synthetic peptide
HEEEITTTNPVATELYGQVSTNLQRGNM

SEQ ID NO: 23738 - protein, 29 aa, Artificial Sequence
  Description of Artificial Sequence: Synthetic peptide
DEEEIRTTNPVCTEQYGSVSTCGQQSGNR

SEQ ID NO: 23739 - protein, 30 aa, Artificial Sequence
  Description of Artificial Sequence: Synthetic polypeptide
DNEEIRSTNPVATEQYGSVSTNLQREGDPR

SEQ ID NO: 23740 - protein, 28 aa, Artificial Sequence
  Description of Artificial Sequence: Synthetic peptide
DEEEIRTTNPVATQCYGSVSTPDIRGNR

SEQ ID NO: 23741 - protein, 31 aa, Artificial Sequence
  Description of Artificial Sequence: Synthetic polypeptide
DEEEIRTTNPVATEQYGSVSTNEQQYREGNW

SEQ ID NO: 23742 - protein, 28 aa, Artificial Sequence
  Description of Artificial Sequence: Synthetic peptide
SEEEIRCTNPTGTEQYGVVSTNLQRGNR

SEQ ID NO: 23743 - protein, 28 aa, Artificial Sequence
  Description of Artificial Sequence: Synthetic peptide
DEEEIRTTNPVATEQYGSVETDDQREER

SEQ ID NO: 23744 - protein, 30 aa, Artificial Sequence
  Description of Artificial Sequence: Synthetic polypeptide
DEEEIRTTNPVATEQYGSVSCEDLQCQGNR

SEQ ID NO: 23745 - protein, 28 aa, Artificial Sequence
  Description of Artificial Sequence: Synthetic peptide
DEEEIRTTNPVAGEQYGSVSLNDDRGDR

SEQ ID NO: 23746 - protein, 30 aa, Artificial Sequence
  Description of Artificial Sequence: Synthetic polypeptide
DEEEIRTTNPVATEQYGSVSTDLQDTGNDW

SEQ ID NO: 23747 - protein, 29 aa, Artificial Sequence
  Description of Artificial Sequence: Synthetic peptide
KENEIRTTNPVATECYGSVSTNLQREGNY

SEQ ID NO: 23748 - protein, 30 aa, Artificial Sequence
  Description of Artificial Sequence: Synthetic polypeptide
DEEEIRTTNPVSTELYGSVSATNLQSRGGR

SEQ ID NO: 23749 - protein, 29 aa, Artificial Sequence
  Description of Artificial Sequence: Synthetic peptide
DPEEIRTTNPVATEQYGSVSQNLADGANR

SEQ ID NO: 23750 - protein, 28 aa, Artificial Sequence
  Description of Artificial Sequence: Synthetic peptide
DEEEIRTTNPVATENYGEVVDILQRGNR

SEQ ID NO: 23751 - protein, 28 aa, Artificial Sequence
  Description of Artificial Sequence: Synthetic peptide
DEEEIRCTNPVSTEQYGTVGNNLQRGNR

SEQ ID NO: 23752 - protein, 28 aa, Artificial Sequence
  Description of Artificial Sequence: Synthetic peptide
DEEEIRTTNPVATEQYGSVSTDLEHGEN

SEQ ID NO: 23753 - protein, 28 aa, Artificial Sequence
  Description of Artificial Sequence: Synthetic peptide
DEEEIRTTNPAATEQYGDVSTNEQSGNF

SEQ ID NO: 23754 - protein, 29 aa, Artificial Sequence
  Description of Artificial Sequence: Synthetic peptide
QEQEIRTTNPVATEQYGEVSATLLQRGNR

SEQ ID NO: 23755 - protein, 28 aa, Artificial Sequence
  Description of Artificial Sequence: Synthetic peptide
DEEEIRTTNPDATQQYGSVSTPLDRGNP

SEQ ID NO: 23756 - protein, 29 aa, Artificial Sequence
  Description of Artificial Sequence: Synthetic peptide
DEDELRTTNPVASEQYGSTSTNLQRGNDR

SEQ ID NO: 23757 - protein, 28 aa, Artificial Sequence
  Description of Artificial Sequence: Synthetic peptide
DEIEIRTTNPVATENYGSVPEQLQRGNR

SEQ ID NO: 23758 - protein, 29 aa, Artificial Sequence
  Description of Artificial Sequence: Synthetic peptide
DEDEIRTTNPVAHEQYGSVATNLERKGNR

SEQ ID NO: 23759 - protein, 29 aa, Artificial Sequence
  Description of Artificial Sequence: Synthetic peptide
DEEEIRQTNPVATEQYGSISENLQRGPGR

SEQ ID NO: 23760 - protein, 28 aa, Artificial Sequence
  Description of Artificial Sequence: Synthetic peptide
GDEEIRTTNPVATEQYGVVSTNLDRGNV

SEQ ID NO: 23761 - protein, 30 aa, Artificial Sequence
  Description of Artificial Sequence: Synthetic polypeptide
DEEEIRTTNPFATEQYGSVSTNLQHWGNDM

SEQ ID NO: 23762 - protein, 31 aa, Artificial Sequence
  Description of Artificial Sequence: Synthetic polypeptide
DEEEIRTTNPVATEQYGSVSETEGLERGDNR

SEQ ID NO: 23763 - protein, 28 aa, Artificial Sequence
  Description of Artificial Sequence: Synthetic peptide
DENEIRTTNPVATEQYGVVDTDLQVGNR

SEQ ID NO: 23764 - protein, 30 aa, Artificial Sequence
  Description of Artificial Sequence: Synthetic polypeptide
DEEEIRTTNPVATEQYGDYSTNLQQRGNGA

SEQ ID NO: 23765 - protein, 30 aa, Artificial Sequence
  Description of Artificial Sequence: Synthetic polypeptide
DEEEIRQTNPVATEQYGVVSTTNLQLVGNR

SEQ ID NO: 23766 - protein, 30 aa, Artificial Sequence
  Description of Artificial Sequence: Synthetic polypeptide
DEEEIRQTNPVATEQYGSASATDGLQRGNR

SEQ ID NO: 23767 - protein, 30 aa, Artificial Sequence
  Description of Artificial Sequence: Synthetic polypeptide
QEEEIRTVNPVATEQYGSVSTENLQAGENR

SEQ ID NO: 23768 - protein, 32 aa, Artificial Sequence
  Description of Artificial Sequence: Synthetic polypeptide
DEEEIRTTNPVATEQYGSIVSTPLQIRDGNPR

SEQ ID NO: 23769 - protein, 29 aa, Artificial Sequence
  Description of Artificial Sequence: Synthetic peptide
DEECIRTTNPVATECYGSCWSTNLQDGNR

SEQ ID NO: 23770 - protein, 31 aa, Artificial Sequence
  Description of Artificial Sequence: Synthetic polypeptide
DEEEIRTTNPVATEQYGSVDCTMNDQCRGNR

SEQ ID NO: 23771 - protein, 28 aa, Artificial Sequence
  Description of Artificial Sequence: Synthetic peptide
QEGEIRTTNPVATEGYGSVSTVLQRGMR

SEQ ID NO: 23772 - protein, 28 aa, Artificial Sequence
  Description of Artificial Sequence: Synthetic peptide
DEEEIGTTNPVATESYGYVTTNLMRGNR

SEQ ID NO: 23773 - protein, 29 aa, Artificial Sequence
  Description of Artificial Sequence: Synthetic peptide
DEEEIRTTNPVATEQYGDVSTDLQHGNDM

SEQ ID NO: 23774 - protein, 28 aa, Artificial Sequence
  Description of Artificial Sequence: Synthetic peptide
DEEEIRTTNPVATELWGSVSTNLEQGNA

SEQ ID NO: 23775 - protein, 32 aa, Artificial Sequence
  Description of Artificial Sequence: Synthetic polypeptide
DEEEIRTTNPVATEQYGVSVISHNNLQRGNNR

SEQ ID NO: 23776 - protein, 29 aa, Artificial Sequence
  Description of Artificial Sequence: Synthetic peptide
DEEEIRTTNPVATEIYGVVSMNLEREGNR

SEQ ID NO: 23777 - protein, 29 aa, Artificial Sequence
  Description of Artificial Sequence: Synthetic peptide
DEEEIRTTNPVATEQYGDVSENLQCHGER

SEQ ID NO: 23778 - protein, 30 aa, Artificial Sequence
  Description of Artificial Sequence: Synthetic polypeptide
DEEEIATTNPVATEQYGSVSTNLQDQGNDD

SEQ ID NO: 23779 - protein, 31 aa, Artificial Sequence
  Description of Artificial Sequence: Synthetic polypeptide
DEEEIRTTNPVATEMYGSVSTSNLQRGHNAP

SEQ ID NO: 23780 - protein, 29 aa, Artificial Sequence
  Description of Artificial Sequence: Synthetic peptide
DEEEIRTTNPVATEQWGSVSTNLEWRGTY

SEQ ID NO: 23781 - protein, 28 aa, Artificial Sequence
  Description of Artificial Sequence: Synthetic peptide
DEEEIRTTNPEATEQYGSVSTDDQRENA

SEQ ID NO: 23782 - protein, 30 aa, Artificial Sequence
  Description of Artificial Sequence: Synthetic polypeptide
DEEEIRTTNPVATEQYGSVDSTDLQTGNDQ

SEQ ID NO: 23783 - protein, 30 aa, Artificial Sequence
  Description of Artificial Sequence: Synthetic polypeptide
DEEEIRTTNPVATEQFGSGVEANLQRGDNR

SEQ ID NO: 23784 - protein, 28 aa, Artificial Sequence
  Description of Artificial Sequence: Synthetic peptide
DEEEIRTTNPVATEIYGSVSYCLCRGNQ

SEQ ID NO: 23785 - protein, 28 aa, Artificial Sequence
  Description of Artificial Sequence: Synthetic peptide
DEREIRTTNPVATEGYGSTSANLQRGQR

SEQ ID NO: 23786 - protein, 31 aa, Artificial Sequence
  Description of Artificial Sequence: Synthetic polypeptide
DEEEIRTTNPVATEQYGSKVMSTNAQSPGNR

SEQ ID NO: 23787 - protein, 28 aa, Artificial Sequence
  Description of Artificial Sequence: Synthetic peptide
DEEEIRTTNPEATEQYGSVSTPLQNGYG

SEQ ID NO: 23788 - protein, 30 aa, Artificial Sequence
  Description of Artificial Sequence: Synthetic polypeptide
DEEEIRTTNPVATEQYGSVSTNLQEIGEDL

SEQ ID NO: 23789 - protein, 31 aa, Artificial Sequence
  Description of Artificial Sequence: Synthetic polypeptide
DEEEIRTTNPVATEQYGSVSTNLQELEGNDQ

SEQ ID NO: 23790 - protein, 30 aa, Artificial Sequence
  Description of Artificial Sequence: Synthetic polypeptide
DEEEIRATNPVATEQFGSVSENLQCRGNDR

SEQ ID NO: 23791 - protein, 29 aa, Artificial Sequence
  Description of Artificial Sequence: Synthetic peptide
DEEEIRTTNPVASEQYGSVSNANLQIGNF

SEQ ID NO: 23792 - protein, 28 aa, Artificial Sequence
  Description of Artificial Sequence: Synthetic peptide
DEQEIRQTNPVATEQYGSASENLQHGNR

SEQ ID NO: 23793 - protein, 28 aa, Artificial Sequence
  Description of Artificial Sequence: Synthetic peptide
DEEEISTTNPDATEQYGSVSTNLEWGNT

SEQ ID NO: 23794 - protein, 28 aa, Artificial Sequence
  Description of Artificial Sequence: Synthetic peptide
DEQEIRTTNPVATEQYGSVETDLQREER

SEQ ID NO: 23795 - protein, 28 aa, Artificial Sequence
  Description of Artificial Sequence: Synthetic peptide
DEEEIRTTNPEATEQYGSVSTDLQLGEN

SEQ ID NO: 23796 - protein, 29 aa, Artificial Sequence
  Description of Artificial Sequence: Synthetic peptide
MEEEIETTNPVATEQYGQVSANNLQRGNR

SEQ ID NO: 23797 - protein, 28 aa, Artificial Sequence
  Description of Artificial Sequence: Synthetic peptide
DEEEIRTTNPVATEQYGSFSEFEQRGNN

SEQ ID NO: 23798 - protein, 30 aa, Artificial Sequence
  Description of Artificial Sequence: Synthetic polypeptide
DEEEIRTTNPVATEQYGSVSCTMDLQQGNN

SEQ ID NO: 23799 - protein, 28 aa, Artificial Sequence
  Description of Artificial Sequence: Synthetic peptide
VEEEIRATNPVATETYGSVGNNLQRGNR

SEQ ID NO: 23800 - protein, 30 aa, Artificial Sequence
  Description of Artificial Sequence: Synthetic polypeptide
DEGEIRTTNPVATEQYGEVSTDLQDRGNTR

SEQ ID NO: 23801 - protein, 28 aa, Artificial Sequence
  Description of Artificial Sequence: Synthetic peptide
DEEPIRTTNPVATEQYGFVGKNLQIGNR

SEQ ID NO: 23802 - protein, 28 aa, Artificial Sequence
  Description of Artificial Sequence: Synthetic peptide
AEEEIRQTNPVATEQYGWVSTGLQRGER

SEQ ID NO: 23803 - protein, 28 aa, Artificial Sequence
  Description of Artificial Sequence: Synthetic peptide
DEMEIRATNPVATEQYGWASTNLQQGNR

SEQ ID NO: 23804 - protein, 28 aa, Artificial Sequence
  Description of Artificial Sequence: Synthetic peptide
DDSEIRTTNPVASEQYGSVGTNEQRGNR

SEQ ID NO: 23805 - protein, 28 aa, Artificial Sequence
  Description of Artificial Sequence: Synthetic peptide
AEEEIRTTNPVATEQYGVVSTNQERGND

SEQ ID NO: 23806 - protein, 30 aa, Artificial Sequence
  Description of Artificial Sequence: Synthetic polypeptide
DEEEIRTTNPVATEQYGSVISTNEQESGNV

SEQ ID NO: 23807 - protein, 28 aa, Artificial Sequence
  Description of Artificial Sequence: Synthetic peptide
DEEEIRTTNPFATEQYGSVSTNGLFGNM

SEQ ID NO: 23808 - protein, 32 aa, Artificial Sequence
  Description of Artificial Sequence: Synthetic polypeptide
DEEEIRTTNPVATEQYGSVSTCDLVQCREGNR

SEQ ID NO: 23809 - protein, 29 aa, Artificial Sequence
  Description of Artificial Sequence: Synthetic peptide
DEEEIRSTNPDATEQYGVVSTNLQQLGNR

SEQ ID NO: 23810 - protein, 30 aa, Artificial Sequence
  Description of Artificial Sequence: Synthetic polypeptide
DEEEIRTTNPVATECYGSVSTNLQNNGNDV

SEQ ID NO: 23811 - protein, 31 aa, Artificial Sequence
  Description of Artificial Sequence: Synthetic polypeptide
DEEQIRTTNPVATEQYGSVTSDHNLQRGNPR

SEQ ID NO: 23812 - protein, 28 aa, Artificial Sequence
  Description of Artificial Sequence: Synthetic peptide
MEQEIRTTNPVATEQYGSVSTDLQNGNM

SEQ ID NO: 23813 - protein, 28 aa, Artificial Sequence
  Description of Artificial Sequence: Synthetic peptide
DEEEIRTTNPVATEQYGSVETALQYGPF

SEQ ID NO: 23814 - protein, 28 aa, Artificial Sequence
  Description of Artificial Sequence: Synthetic peptide
DEEEIRTTNPCCHEQYGSVGTNLQRGNQ

SEQ ID NO: 23815 - protein, 31 aa, Artificial Sequence
  Description of Artificial Sequence: Synthetic polypeptide
DEEEIRTTNPTATEQYGSVSTCNLQENGDNR

SEQ ID NO: 23816 - protein, 28 aa, Artificial Sequence
  Description of Artificial Sequence: Synthetic peptide
DEEEIRTTNPFATEQYGSVSYNIFRGND

SEQ ID NO: 23817 - protein, 28 aa, Artificial Sequence
  Description of Artificial Sequence: Synthetic peptide
DDEELRTTNPVSTEQYGSVSMNLQRLNR

SEQ ID NO: 23818 - protein, 28 aa, Artificial Sequence
  Description of Artificial Sequence: Synthetic peptide
DEQEIRTTNPVATEQWGSVSENLMRGNF

SEQ ID NO: 23819 - protein, 28 aa, Artificial Sequence
  Description of Artificial Sequence: Synthetic peptide
DEQEIRTTNPVATEQYGSVDEDLQGGNR

SEQ ID NO: 23820 - protein, 28 aa, Artificial Sequence
  Description of Artificial Sequence: Synthetic peptide
DEEEIRTTNPEATEQYGSVSTPLQSENG

SEQ ID NO: 23821 - protein, 30 aa, Artificial Sequence
  Description of Artificial Sequence: Synthetic polypeptide
DEEEIRTTNPVATEQYGSVSTDLQEVGNDE

SEQ ID NO: 23822 - protein, 28 aa, Artificial Sequence
  Description of Artificial Sequence: Synthetic peptide
DEEEIRATNPVATEQFGSVSTNDQNLNR

SEQ ID NO: 23823 - protein, 28 aa, Artificial Sequence
  Description of Artificial Sequence: Synthetic peptide
REEEIRTTNPVCTEQYGSVSTNIQQGNC

SEQ ID NO: 23824 - protein, 28 aa, Artificial Sequence
  Description of Artificial Sequence: Synthetic peptide
DEDEIVQTNPVATEQYGTVSTNLQHGNR

SEQ ID NO: 23825 - protein, 28 aa, Artificial Sequence
  Description of Artificial Sequence: Synthetic peptide
DEDEIITTNPVATEMFGSVSTNLQRGNL

SEQ ID NO: 23826 - protein, 28 aa, Artificial Sequence
  Description of Artificial Sequence: Synthetic peptide
DEEEVRAVNPVAYEQYGSVGTNLQRGNR

SEQ ID NO: 23827 - protein, 30 aa, Artificial Sequence
  Description of Artificial Sequence: Synthetic polypeptide
DEEEIRTTNPCATEQYGSVSTELQNDGENR

SEQ ID NO: 23828 - protein, 28 aa, Artificial Sequence
  Description of Artificial Sequence: Synthetic peptide
DEEPIRTCNPDATEQYGSVSTNLDDGNR

SEQ ID NO: 23829 - protein, 30 aa, Artificial Sequence
  Description of Artificial Sequence: Synthetic polypeptide
DEEEIRTTNPVATECYGSVSTDLQDRGENE

SEQ ID NO: 23830 - protein, 28 aa, Artificial Sequence
  Description of Artificial Sequence: Synthetic peptide
DEEEIWSTNPVATEQYGSVSENLQHQNR

SEQ ID NO: 23831 - protein, 29 aa, Artificial Sequence
  Description of Artificial Sequence: Synthetic peptide
DEEEIRATNPVATECYGSVGSNLQCRGNR

SEQ ID NO: 23832 - protein, 28 aa, Artificial Sequence
  Description of Artificial Sequence: Synthetic peptide
KEQEIRATNPVATEQYGSVSTNLQVGNT

SEQ ID NO: 23833 - protein, 29 aa, Artificial Sequence
  Description of Artificial Sequence: Synthetic peptide
DEEEIRTTNPIATEQYGSVSTNDERGNPT

SEQ ID NO: 23834 - protein, 28 aa, Artificial Sequence
  Description of Artificial Sequence: Synthetic peptide
DEEEIRTTNPFATEQYGSVSENLQAENN

SEQ ID NO: 23835 - protein, 29 aa, Artificial Sequence
  Description of Artificial Sequence: Synthetic peptide
DEEEIRAVNPVATEQYGVVSTNLQRGNDD

SEQ ID NO: 23836 - protein, 28 aa, Artificial Sequence
  Description of Artificial Sequence: Synthetic peptide
MEEEIRTTNPVATEQYGSVSEDLQNGNM

SEQ ID NO: 23837 - protein, 28 aa, Artificial Sequence
  Description of Artificial Sequence: Synthetic peptide
DEEEIVTTNPDATEQYGSVSTNDQNGNF

SEQ ID NO: 23838 - protein, 29 aa, Artificial Sequence
  Description of Artificial Sequence: Synthetic peptide
DEEEIRTTNPAATEIYGSVSTNLQSGNTY

SEQ ID NO: 23839 - protein, 31 aa, Artificial Sequence
  Description of Artificial Sequence: Synthetic polypeptide
CEEEIRTTNPVSTEQYGSVSTLNLQFRGNER

SEQ ID NO: 23840 - protein, 31 aa, Artificial Sequence
  Description of Artificial Sequence: Synthetic polypeptide
DEEEIRTTNPVATEQYGSVSTANEQIEGDNR

SEQ ID NO: 23841 - protein, 29 aa, Artificial Sequence
  Description of Artificial Sequence: Synthetic peptide
DEEEIRTTNPVATELYGAVSMNLEREGNR

SEQ ID NO: 23842 - protein, 33 aa, Artificial Sequence
  Description of Artificial Sequence: Synthetic polypeptide
DEEEIRTTNPVATEQYGSVSDTENLQREGENDR

SEQ ID NO: 23843 - protein, 32 aa, Artificial Sequence
  Description of Artificial Sequence: Synthetic polypeptide
DEEEIRTTNPVATEQYGSVSTMNLPCCRGDNR

SEQ ID NO: 23844 - protein, 30 aa, Artificial Sequence
  Description of Artificial Sequence: Synthetic polypeptide
DEEEIRTTNPEATEQYGSVSTTPLQRGNEH

SEQ ID NO: 23845 - protein, 31 aa, Artificial Sequence
  Description of Artificial Sequence: Synthetic polypeptide
DEEEIRTTNPVATEQYGSVSTNEQDIGDNDR

SEQ ID NO: 23846 - protein, 28 aa, Artificial Sequence
  Description of Artificial Sequence: Synthetic peptide
DEEEIRTTNPVATEQYGSVETPLDVGNW

SEQ ID NO: 23847 - protein, 28 aa, Artificial Sequence
  Description of Artificial Sequence: Synthetic peptide
AENEIRQTNPVATEQYGSVSTNLQPGNM

SEQ ID NO: 23848 - protein, 28 aa, Artificial Sequence
  Description of Artificial Sequence: Synthetic peptide
DEQEIRTTNPEATEQYGSVSTNEERGDR

SEQ ID NO: 23849 - protein, 29 aa, Artificial Sequence
  Description of Artificial Sequence: Synthetic peptide
QEEEIRTTNPVSTENYGQVSTNLQQRGNR

SEQ ID NO: 23850 - protein, 31 aa, Artificial Sequence
  Description of Artificial Sequence: Synthetic polypeptide
HEEEIRTTNPVATEQYGSVSYNLQQQRNGNR

SEQ ID NO: 23851 - protein, 33 aa, Artificial Sequence
  Description of Artificial Sequence: Synthetic polypeptide
DEEEIRTTNPVATEQYGSVISTLNLPQLREGNR

SEQ ID NO: 23852 - protein, 28 aa, Artificial Sequence
  Description of Artificial Sequence: Synthetic peptide
DEQEIRTTNPEATEQYGSVSTNLEHGNN

SEQ ID NO: 23853 - protein, 29 aa, Artificial Sequence
  Description of Artificial Sequence: Synthetic peptide
DEEEIRTTNPVATEQYGDVSENLQCHGNQ

SEQ ID NO: 23854 - protein, 30 aa, Artificial Sequence
  Description of Artificial Sequence: Synthetic polypeptide
DEEEIRTTNPVATEQYGSVSVDLVLRGNPR

SEQ ID NO: 23855 - protein, 30 aa, Artificial Sequence
  Description of Artificial Sequence: Synthetic polypeptide
DEEEICTTNPMATEQYGSVPTNLQHRGNGR

SEQ ID NO: 23856 - protein, 29 aa, Artificial Sequence
  Description of Artificial Sequence: Synthetic peptide
DDEEVRTTNPVAYEQYGSVGATNLQRGNR

SEQ ID NO: 23857 - protein, 28 aa, Artificial Sequence
  Description of Artificial Sequence: Synthetic peptide
DEEEIRTTNPVATEQYGSVDTEDQLGNV

SEQ ID NO: 23858 - protein, 31 aa, Artificial Sequence
  Description of Artificial Sequence: Synthetic polypeptide
DEEEIRTTNPVATEQYGSVSTNLERNGENDV

SEQ ID NO: 23859 - protein, 31 aa, Artificial Sequence
  Description of Artificial Sequence: Synthetic polypeptide
DEEEIRTTNPVATEQYGSVESCNLPQRAGMR

SEQ ID NO: 23860 - protein, 28 aa, Artificial Sequence
  Description of Artificial Sequence: Synthetic peptide
MEEEIRTTNPVAVEQYGSVSTNLDQGNA

SEQ ID NO: 23861 - protein, 32 aa, Artificial Sequence
  Description of Artificial Sequence: Synthetic polypeptide
WEEEIRTTNPVATEQYGSVSTSNLKQRGENYR

SEQ ID NO: 23862 - protein, 28 aa, Artificial Sequence
  Description of Artificial Sequence: Synthetic peptide
DEEEIATTNIVATEQYGDVSTDLQRGNN

SEQ ID NO: 23863 - protein, 28 aa, Artificial Sequence
  Description of Artificial Sequence: Synthetic peptide
DEEEIRSTNPVASEIYGCVSTNLQRGTR

SEQ ID NO: 23864 - protein, 29 aa, Artificial Sequence
  Description of Artificial Sequence: Synthetic peptide
DEEEIATTNPVATEQYGIVSFTNLQFGNF

SEQ ID NO: 23865 - protein, 31 aa, Artificial Sequence
  Description of Artificial Sequence: Synthetic polypeptide
DEEEIRTTNPVATELYGEVSTNLPQRGDNTR

SEQ ID NO: 23866 - protein, 30 aa, Artificial Sequence
  Description of Artificial Sequence: Synthetic polypeptide
DEEEIRTTNPVAYEQYGSQWSDTNLQRSNR

SEQ ID NO: 23867 - protein, 29 aa, Artificial Sequence
  Description of Artificial Sequence: Synthetic peptide
DEEEIRTTNPIATEHYGSVDSTNLQFGNI

SEQ ID NO: 23868 - protein, 28 aa, Artificial Sequence
  Description of Artificial Sequence: Synthetic peptide
DTEEIRTTNPVATEQWGSWHTNDQRGNR

SEQ ID NO: 23869 - protein, 28 aa, Artificial Sequence
  Description of Artificial Sequence: Synthetic peptide
DEEEIRCTNPAATETYGEVSTNLQRGNN

SEQ ID NO: 23870 - protein, 28 aa, Artificial Sequence
  Description of Artificial Sequence: Synthetic peptide
SEEEIRTTNPEATECYGSVSTNPQRGNQ

SEQ ID NO: 23871 - protein, 29 aa, Artificial Sequence
  Description of Artificial Sequence: Synthetic peptide
DEEEIKTTNPVATFQYGSVSSDLQRGENR

SEQ ID NO: 23872 - protein, 31 aa, Artificial Sequence
  Description of Artificial Sequence: Synthetic polypeptide
CEEEIRTTNPVATEQYGFSSVSTNELQRSNR

SEQ ID NO: 23873 - protein, 28 aa, Artificial Sequence
  Description of Artificial Sequence: Synthetic peptide
DEEEIRTTNPEATEQYGSVDTNLDMGER

SEQ ID NO: 23874 - protein, 28 aa, Artificial Sequence
  Description of Artificial Sequence: Synthetic peptide
DEMEVRTTNPCATEQYGSASTNLQRENR

SEQ ID NO: 23875 - protein, 31 aa, Artificial Sequence
  Description of Artificial Sequence: Synthetic polypeptide
DEEEIRTTNPVATEQYGSVSCTMNLCYGNDR

SEQ ID NO: 23876 - protein, 29 aa, Artificial Sequence
  Description of Artificial Sequence: Synthetic peptide
DEEEIRTTNPVATEQYGSVSITDLDQGER

SEQ ID NO: 23877 - protein, 28 aa, Artificial Sequence
  Description of Artificial Sequence: Synthetic peptide
DEEEIRTTNPVASETYGTVGMNLQRGNR

SEQ ID NO: 23878 - protein, 32 aa, Artificial Sequence
  Description of Artificial Sequence: Synthetic polypeptide
DEEEIRTTNPVATEQYGESVSETNDVQRGNDR

SEQ ID NO: 23879 - protein, 28 aa, Artificial Sequence
  Description of Artificial Sequence: Synthetic peptide
FCEEIRTTNPVATEQYGSQSTNLQRGDC

SEQ ID NO: 23880 - protein, 28 aa, Artificial Sequence
  Description of Artificial Sequence: Synthetic peptide
KEEEIRTTNPVATEQYGSVSEDLDQGNR

SEQ ID NO: 23881 - protein, 28 aa, Artificial Sequence
  Description of Artificial Sequence: Synthetic peptide
DEEEIRTTNPVATEQYGSVETNDDIGER

SEQ ID NO: 23882 - protein, 28 aa, Artificial Sequence
  Description of Artificial Sequence: Synthetic peptide
DEEEIATTNPVATEQYGEASEVLQRGNR

SEQ ID NO: 23883 - protein, 28 aa, Artificial Sequence
  Description of Artificial Sequence: Synthetic peptide
DEEEIKTTNIVATEQYGKVATNLQRGDR

SEQ ID NO: 23884 - protein, 28 aa, Artificial Sequence
  Description of Artificial Sequence: Synthetic peptide
DEEEIRTTNPVATEQYGSVETNLEMGED

SEQ ID NO: 23885 - protein, 29 aa, Artificial Sequence
  Description of Artificial Sequence: Synthetic peptide
DGEEIRTTNPVATEQWGSVTSTLLQRGTR

SEQ ID NO: 23886 - protein, 28 aa, Artificial Sequence
  Description of Artificial Sequence: Synthetic peptide
DEEEIRTTNPVATEQYGSVETDLQDGED

SEQ ID NO: 23887 - protein, 30 aa, Artificial Sequence
  Description of Artificial Sequence: Synthetic polypeptide
DENEIRTTNPEATEQYGSVSSTGLQRDGNR

SEQ ID NO: 23888 - protein, 30 aa, Artificial Sequence
  Description of Artificial Sequence: Synthetic polypeptide
DEEEITTTNPVATEQYGSVSTEELQREGER

SEQ ID NO: 23889 - protein, 30 aa, Artificial Sequence
  Description of Artificial Sequence: Synthetic polypeptide
DEEEIRTTNPVATEQYGSVSTEPLQEFGER

SEQ ID NO: 23890 - protein, 28 aa, Artificial Sequence
  Description of Artificial Sequence: Synthetic peptide
DEEEIATTNPVATEQYGSVSTEDEDGNR

SEQ ID NO: 23891 - protein, 28 aa, Artificial Sequence
  Description of Artificial Sequence: Synthetic peptide
DEEEIRTTNPAATELFGSVSTNLQQGNG

SEQ ID NO: 23892 - protein, 28 aa, Artificial Sequence
  Description of Artificial Sequence: Synthetic peptide
DEEEIRTTNPVATEQYGSVETEDERGER

SEQ ID NO: 23893 - protein, 31 aa, Artificial Sequence
  Description of Artificial Sequence: Synthetic polypeptide
DEEEIRTTNPVATEQYGSVSTNLQEIEGTTR

SEQ ID NO: 23894 - protein, 28 aa, Artificial Sequence
  Description of Artificial Sequence: Synthetic peptide
DEEEIRTTNPFATEQYGSVSTNQQEGDF

SEQ ID NO: 23895 - protein, 29 aa, Artificial Sequence
  Description of Artificial Sequence: Synthetic peptide
DPEEIRTTNPVATEQYGSVSENPDREGNR

SEQ ID NO: 23896 - protein, 31 aa, Artificial Sequence
  Description of Artificial Sequence: Synthetic polypeptide
DEEEIRTTNPVATEMYGSVSTCNLPQDRGNF

SEQ ID NO: 23897 - protein, 31 aa, Artificial Sequence
  Description of Artificial Sequence: Synthetic polypeptide
DEEEIRTTNPVATFQYGSVSDTNLQLPNGNR

SEQ ID NO: 23898 - protein, 29 aa, Artificial Sequence
  Description of Artificial Sequence: Synthetic peptide
DEEEISTTNPVATEVYGDVSTMNLQHGNR

SEQ ID NO: 23899 - protein, 28 aa, Artificial Sequence
  Description of Artificial Sequence: Synthetic peptide
AELEILPTNPVATEQYGSVSTNLQRGER

SEQ ID NO: 23900 - protein, 29 aa, Artificial Sequence
  Description of Artificial Sequence: Synthetic peptide
HECEIRTTNPVACEMYGSVSTNLQRGENR

SEQ ID NO: 23901 - protein, 30 aa, Artificial Sequence
  Description of Artificial Sequence: Synthetic polypeptide
DEEEIRTTNPVATEQYGSVSTNEQENGNTN

SEQ ID NO: 23902 - protein, 28 aa, Artificial Sequence
  Description of Artificial Sequence: Synthetic peptide
SQEEIRTTNPVATEQWGTVSTNLQEGNR

SEQ ID NO: 23903 - protein, 31 aa, Artificial Sequence
  Description of Artificial Sequence: Synthetic polypeptide
DEEEIRTTNPVATEQYGSVDCTMNLQRGNDQ

SEQ ID NO: 23904 - protein, 28 aa, Artificial Sequence
  Description of Artificial Sequence: Synthetic peptide
DEEEIRTTNPVAMEQYGFVSTNLDRENQ

SEQ ID NO: 23905 - protein, 30 aa, Artificial Sequence
  Description of Artificial Sequence: Synthetic polypeptide
DEEEIRTTNPVATEQYGSVTSDTNLDPGNP

SEQ ID NO: 23906 - protein, 29 aa, Artificial Sequence
  Description of Artificial Sequence: Synthetic peptide
DEEEITTTNPVATEQYGSVSTNLEEYGNE

SEQ ID NO: 23907 - protein, 28 aa, Artificial Sequence
  Description of Artificial Sequence: Synthetic peptide
DESEIRTTNPVCSEQYGIVGTNLQRGNR

SEQ ID NO: 23908 - protein, 29 aa, Artificial Sequence
  Description of Artificial Sequence: Synthetic peptide
SEEEIRTTNPVSTEHYGCVSTNGLQRGNR

SEQ ID NO: 23909 - protein, 28 aa, Artificial Sequence
  Description of Artificial Sequence: Synthetic peptide
DEEEIATTNIVATEQYGSVSEELQHGNR

SEQ ID NO: 23910 - protein, 28 aa, Artificial Sequence
  Description of Artificial Sequence: Synthetic peptide
DPEEIRTTNPVAYEQYGSVFTNDQDGNR

SEQ ID NO: 23911 - protein, 28 aa, Artificial Sequence
  Description of Artificial Sequence: Synthetic peptide
DESEIRATNPVATEVYGWVATNLQRGNR

SEQ ID NO: 23912 - protein, 32 aa, Artificial Sequence
  Description of Artificial Sequence: Synthetic polypeptide
DEEEIRTTNPVATEQYGESVSCTCNLERGNPR

SEQ ID NO: 23913 - protein, 28 aa, Artificial Sequence
  Description of Artificial Sequence: Synthetic peptide
DEEEIRTTNPVATQCYGSVSHPLDRGNR

SEQ ID NO: 23914 - protein, 28 aa, Artificial Sequence
  Description of Artificial Sequence: Synthetic peptide
NEEEIRTTNPCATHQYGSVSTNLQYGNE

SEQ ID NO: 23915 - protein, 28 aa, Artificial Sequence
  Description of Artificial Sequence: Synthetic peptide
DEEEIRTTNPVATEQWGDVSTELQREDR

SEQ ID NO: 23916 - protein, 28 aa, Artificial Sequence
  Description of Artificial Sequence: Synthetic peptide
DEEEIRTTNPVCTEVYGSVSTNEQREDR

SEQ ID NO: 23917 - protein, 28 aa, Artificial Sequence
  Description of Artificial Sequence: Synthetic peptide
DEEEIRTTNPFATEQYGSVSTNPIRGEV

SEQ ID NO: 23918 - protein, 29 aa, Artificial Sequence
  Description of Artificial Sequence: Synthetic peptide
MEQEIRTTNPVACEQYGSVSTNLQREGNL

SEQ ID NO: 23919 - protein, 28 aa, Artificial Sequence
  Description of Artificial Sequence: Synthetic peptide
DEEEIRTTNPEATEQYGSVSTNEQIGEY

SEQ ID NO: 23920 - protein, 28 aa, Artificial Sequence
  Description of Artificial Sequence: Synthetic peptide
QEEEIRTTNPVATECYGDVSTCLQRGNN

SEQ ID NO: 23921 - protein, 28 aa, Artificial Sequence
  Description of Artificial Sequence: Synthetic peptide
DDEEIRCTNPVASEQYGCVATNLQRGNR

SEQ ID NO: 23922 - protein, 28 aa, Artificial Sequence
  Description of Artificial Sequence: Synthetic peptide
DEEMIRTTNPVAFEQYGSVDTGLQRGND

SEQ ID NO: 23923 - protein, 30 aa, Artificial Sequence
  Description of Artificial Sequence: Synthetic polypeptide
DEQEIRTTNPVCTEQYGSVSCTNLQCRGNA

SEQ ID NO: 23924 - protein, 28 aa, Artificial Sequence
  Description of Artificial Sequence: Synthetic peptide
DEEEIATTNIVATEQYGVVSENLQRGNA

SEQ ID NO: 23925 - protein, 33 aa, Artificial Sequence
  Description of Artificial Sequence: Synthetic polypeptide
DEEEIRTTNPVATEQYGSVISTCNGLQRGDNTR

SEQ ID NO: 23926 - protein, 28 aa, Artificial Sequence
  Description of Artificial Sequence: Synthetic peptide
DEEEVRTTNPVASEQYGCVASNLQRGNR

SEQ ID NO: 23927 - protein, 28 aa, Artificial Sequence
  Description of Artificial Sequence: Synthetic peptide
NEEEIRATNPVCSEPYGSVSTNLQRGNR

SEQ ID NO: 23928 - protein, 28 aa, Artificial Sequence
  Description of Artificial Sequence: Synthetic peptide
DEEEIRTTNPVATEVYGSVDTDEQAGNR

SEQ ID NO: 23929 - protein, 30 aa, Artificial Sequence
  Description of Artificial Sequence: Synthetic polypeptide
DEEEIRTTNPVATEQYGSWSTNDHVQRGPR

SEQ ID NO: 23930 - protein, 30 aa, Artificial Sequence
  Description of Artificial Sequence: Synthetic polypeptide
DEEEIRTTNPCATEQYGVVCSATDLQRGNR

SEQ ID NO: 23931 - protein, 32 aa, Artificial Sequence
  Description of Artificial Sequence: Synthetic polypeptide
DEEEIRTTNPVATEQYGESVDSETIELQRGNR

SEQ ID NO: 23932 - protein, 28 aa, Artificial Sequence
  Description of Artificial Sequence: Synthetic peptide
DEEEIYTTNPVATEMYGSVSENLQEGNA

SEQ ID NO: 23933 - protein, 29 aa, Artificial Sequence
  Description of Artificial Sequence: Synthetic peptide
SEEEIRTTNPVATEMFGGVSTNLQRGNTR

SEQ ID NO: 23934 - protein, 29 aa, Artificial Sequence
  Description of Artificial Sequence: Synthetic peptide
HEEEIRTTNPVATELYGVVSTQLQSRGNR

SEQ ID NO: 23935 - protein, 32 aa, Artificial Sequence
  Description of Artificial Sequence: Synthetic polypeptide
DEEEIRTTNPVATEQYGSVISTCNGPQRGINR

SEQ ID NO: 23936 - protein, 28 aa, Artificial Sequence
  Description of Artificial Sequence: Synthetic peptide
DAEETQTTNPVAYEQYGSVSNNLQRGNR

SEQ ID NO: 23937 - protein, 28 aa, Artificial Sequence
  Description of Artificial Sequence: Synthetic peptide
AEEEIRSTNPVSTELYGSVATNLQRGNR

SEQ ID NO: 23938 - protein, 30 aa, Artificial Sequence
  Description of Artificial Sequence: Synthetic polypeptide
DEEEIRTTNPVATEQYGSVSTCNEQSGVDR

SEQ ID NO: 23939 - protein, 31 aa, Artificial Sequence
  Description of Artificial Sequence: Synthetic polypeptide
DEEEIRTTNPVATEQYGSVDCTMELQCRGNR

SEQ ID NO: 23940 - protein, 28 aa, Artificial Sequence
  Description of Artificial Sequence: Synthetic peptide
DENEIRTTNPTATEQYGDVSDNLQRGNS

SEQ ID NO: 23941 - protein, 31 aa, Artificial Sequence
  Description of Artificial Sequence: Synthetic polypeptide
DEEEIRTTNPVATEQYGSVSCTMDLQCRGNS

SEQ ID NO: 23942 - protein, 28 aa, Artificial Sequence
  Description of Artificial Sequence: Synthetic peptide
DEMEIRTVNIVATEQGGSVSTNLQRGNT

SEQ ID NO: 23943 - protein, 31 aa, Artificial Sequence
  Description of Artificial Sequence: Synthetic polypeptide
DEEEIRTTNPVATEQYGSVSTENLQEINGNE

SEQ ID NO: 23944 - protein, 30 aa, Artificial Sequence
  Description of Artificial Sequence: Synthetic polypeptide
DEEEIRTTNPVATEQYGSVSTNNLTQREED

SEQ ID NO: 23945 - protein, 28 aa, Artificial Sequence
  Description of Artificial Sequence: Synthetic peptide
DDEEIRTTNPVGTECYGSVSMDLQRGNR

SEQ ID NO: 23946 - protein, 28 aa, Artificial Sequence
  Description of Artificial Sequence: Synthetic peptide
HEEEIRTTNPVATEQYGSASTNQQRGDE

SEQ ID NO: 23947 - protein, 28 aa, Artificial Sequence
  Description of Artificial Sequence: Synthetic peptide
DEEEIRTTNIVATEQYGSVSTNLETGEM

SEQ ID NO: 23948 - protein, 28 aa, Artificial Sequence
  Description of Artificial Sequence: Synthetic peptide
DEEELKTTNPVATEQWGSVSVNLQRLNR

SEQ ID NO: 23949 - protein, 28 aa, Artificial Sequence
  Description of Artificial Sequence: Synthetic peptide
DEIEIRATNPVATEQYGSVSENLQEGNW

SEQ ID NO: 23950 - protein, 30 aa, Artificial Sequence
  Description of Artificial Sequence: Synthetic polypeptide
DEVEIRTTNPVATEMYGSVISENLPQRGNR

SEQ ID NO: 23951 - protein, 28 aa, Artificial Sequence
  Description of Artificial Sequence: Synthetic peptide
YEEEIRTTNPVATDQYGSVSTNDQIGNV

SEQ ID NO: 23952 - protein, 28 aa, Artificial Sequence
  Description of Artificial Sequence: Synthetic peptide
DEEEIRCTNPVSSEQYGVVSTNLQRGTR

SEQ ID NO: 23953 - protein, 30 aa, Artificial Sequence
  Description of Artificial Sequence: Synthetic polypeptide
DEEMIRTTNPVATEWYGSVCSTNLIRNGNR

SEQ ID NO: 23954 - protein, 28 aa, Artificial Sequence
  Description of Artificial Sequence: Synthetic peptide
DEEEIRTVNPVATEQYGFVSENLQSENR

SEQ ID NO: 23955 - protein, 28 aa, Artificial Sequence
  Description of Artificial Sequence: Synthetic peptide
DEEEIVTTNPVATESYGAVSTPLQRGNV

SEQ ID NO: 23956 - protein, 28 aa, Artificial Sequence
  Description of Artificial Sequence: Synthetic peptide
KENEIRTTNPVATECYGSVSEDLQRGNR

SEQ ID NO: 23957 - protein, 32 aa, Artificial Sequence
  Description of Artificial Sequence: Synthetic polypeptide
DEEEIRTTNPVATEQYGSTSMTENLSQRIGNR

SEQ ID NO: 23958 - protein, 31 aa, Artificial Sequence
  Description of Artificial Sequence: Synthetic polypeptide
DEEEIRATNPVATEQYGSVDSATNLQRGINF

SEQ ID NO: 23959 - protein, 28 aa, Artificial Sequence
  Description of Artificial Sequence: Synthetic peptide
DEEEISATNPVATEQYGSVSENLQRGDS

SEQ ID NO: 23960 - protein, 28 aa, Artificial Sequence
  Description of Artificial Sequence: Synthetic peptide
AEEEISQTNPVATEQYGEVSENLQRGNR

SEQ ID NO: 23961 - protein, 29 aa, Artificial Sequence
  Description of Artificial Sequence: Synthetic peptide
DEEEIRTTNPVATENYGEVSENLQRGTQR

SEQ ID NO: 23962 - protein, 28 aa, Artificial Sequence
  Description of Artificial Sequence: Synthetic peptide
DEEEIATTNPVCTEQYGSVFTNLQHGNQ

SEQ ID NO: 23963 - protein, 28 aa, Artificial Sequence
  Description of Artificial Sequence: Synthetic peptide
DEEEIRTTNPVATEQYGSVEEPDQDGNR

SEQ ID NO: 23964 - protein, 28 aa, Artificial Sequence
  Description of Artificial Sequence: Synthetic peptide
DEEEIRTTNPVATEQYGSVETPEERGER

SEQ ID NO: 23965 - protein, 28 aa, Artificial Sequence
  Description of Artificial Sequence: Synthetic peptide
NEEEIITTNIVATEQYGSVSTNLQVSNR

SEQ ID NO: 23966 - protein, 28 aa, Artificial Sequence
  Description of Artificial Sequence: Synthetic peptide
MEEEIATTNPVATEQYGSVSTDLQRGDA

SEQ ID NO: 23967 - protein, 28 aa, Artificial Sequence
  Description of Artificial Sequence: Synthetic peptide
DEEEICTTNPFATEQYGSVFDELQRGNR

SEQ ID NO: 23968 - protein, 28 aa, Artificial Sequence
  Description of Artificial Sequence: Synthetic peptide
DEEEIRQTNPVATEQYGGVSTNLQWPND

SEQ ID NO: 23969 - protein, 31 aa, Artificial Sequence
  Description of Artificial Sequence: Synthetic polypeptide
DEEEIRTTNPVATEQYGSVETDELQRGDNER

SEQ ID NO: 23970 - protein, 28 aa, Artificial Sequence
  Description of Artificial Sequence: Synthetic peptide
SEVEIRTTNPVATEQYGGVSTNPQRGLR

SEQ ID NO: 23971 - protein, 28 aa, Artificial Sequence
  Description of Artificial Sequence: Synthetic peptide
DEEEIRTTNPVATEQYGSVPTNLQLEPI

SEQ ID NO: 23972 - protein, 32 aa, Artificial Sequence
  Description of Artificial Sequence: Synthetic polypeptide
DEEEIRTTNPDATEQYGSVSDTNLTQDRGENR

SEQ ID NO: 23973 - protein, 28 aa, Artificial Sequence
  Description of Artificial Sequence: Synthetic peptide
DEEEIRTTNPVATEQYGSVETELDRGEW

SEQ ID NO: 23974 - protein, 31 aa, Artificial Sequence
  Description of Artificial Sequence: Synthetic polypeptide
DEEEIRTTNPVATEQYGSVSTDLQDREGNDE

SEQ ID NO: 23975 - protein, 28 aa, Artificial Sequence
  Description of Artificial Sequence: Synthetic peptide
DEQEVRATNPVATEQYGSVATNLERGNR

SEQ ID NO: 23976 - protein, 30 aa, Artificial Sequence
  Description of Artificial Sequence: Synthetic polypeptide
DEEEIRTTNPVATEQYGSVSTNPQELGNTL

SEQ ID NO: 23977 - protein, 28 aa, Artificial Sequence
  Description of Artificial Sequence: Synthetic peptide
GEEEIRTTNPVATEQYGWVATDLQRGNI

SEQ ID NO: 23978 - protein, 30 aa, Artificial Sequence
  Description of Artificial Sequence: Synthetic polypeptide
DEEEIRTVNPVATEQYGSVYSVNLQREANR

SEQ ID NO: 23979 - protein, 28 aa, Artificial Sequence
  Description of Artificial Sequence: Synthetic peptide
MEQEIRTVNPVATEMYGSVSTNLQRGDR

SEQ ID NO: 23980 - protein, 28 aa, Artificial Sequence
  Description of Artificial Sequence: Synthetic peptide
DEEEIRTTNPEATELYGSVSTNLQSGDV

SEQ ID NO: 23981 - protein, 31 aa, Artificial Sequence
  Description of Artificial Sequence: Synthetic polypeptide
DEEEIRTTNPVATEQYGSVSETEDQERDGNR

SEQ ID NO: 23982 - protein, 31 aa, Artificial Sequence
  Description of Artificial Sequence: Synthetic polypeptide
DEEEIRTTNPVATEQYWGSYVSTPPLDRGNR

SEQ ID NO: 23983 - protein, 28 aa, Artificial Sequence
  Description of Artificial Sequence: Synthetic peptide
DEGEIRTTNPAATEQYGSVSVALQRGNG

SEQ ID NO: 23984 - protein, 29 aa, Artificial Sequence
  Description of Artificial Sequence: Synthetic peptide
DEQEIRTTNPVATEQYGSVDTNLMIRGNL

SEQ ID NO: 23985 - protein, 28 aa, Artificial Sequence
  Description of Artificial Sequence: Synthetic peptide
DEEEIRTTNPFATEQYGSVSTPLDPGNP

SEQ ID NO: 23986 - protein, 29 aa, Artificial Sequence
  Description of Artificial Sequence: Synthetic peptide
DEQEIRTTNPVATEQWGSVSTNEQMRGNW

SEQ ID NO: 23987 - protein, 32 aa, Artificial Sequence
  Description of Artificial Sequence: Synthetic polypeptide
DEEEIRTTNPVATEQYGSVDSQNLSQTRNGNR

SEQ ID NO: 23988 - protein, 28 aa, Artificial Sequence
  Description of Artificial Sequence: Synthetic peptide
DAEEIRTTNPFATEQYGVVSTNLDRGND

SEQ ID NO: 23989 - protein, 28 aa, Artificial Sequence
  Description of Artificial Sequence: Synthetic peptide
DEEEIRTTNPVATEQYGSVSTDLEDGEH

SEQ ID NO: 23990 - protein, 30 aa, Artificial Sequence
  Description of Artificial Sequence: Synthetic polypeptide
DEEEIRTTNPVATEQYGSVSTDLQERKGED

SEQ ID NO: 23991 - protein, 29 aa, Artificial Sequence
  Description of Artificial Sequence: Synthetic peptide
DMEEIRCTNPVATEQYGSVSTNLQREPNP

SEQ ID NO: 23992 - protein, 31 aa, Artificial Sequence
  Description of Artificial Sequence: Synthetic polypeptide
DEEEIRTTNPVATEQYGSVSTDLQEREGENQ

SEQ ID NO: 23993 - protein, 28 aa, Artificial Sequence
  Description of Artificial Sequence: Synthetic peptide
DEEEIRTTNPVATEQYGSVSTDDDWGNV

SEQ ID NO: 23994 - protein, 30 aa, Artificial Sequence
  Description of Artificial Sequence: Synthetic polypeptide
DEEEIRTTNPVATECYGSVSTDLQERGNDN

SEQ ID NO: 23995 - protein, 28 aa, Artificial Sequence
  Description of Artificial Sequence: Synthetic peptide
DEEEIRTTNIVATEQYGSVSTDDERGNT

SEQ ID NO: 23996 - protein, 28 aa, Artificial Sequence
  Description of Artificial Sequence: Synthetic peptide
DDECIRTTNPVATTQYGSVSTNLGLGNR

SEQ ID NO: 23997 - protein, 28 aa, Artificial Sequence
  Description of Artificial Sequence: Synthetic peptide
DEQEIRCTNPVATEIYGSVAMNLQRGNR

SEQ ID NO: 23998 - protein, 28 aa, Artificial Sequence
  Description of Artificial Sequence: Synthetic peptide
DEEEIRTTNPVATEQYGIVSTALQVGDL

SEQ ID NO: 23999 - protein, 29 aa, Artificial Sequence
  Description of Artificial Sequence: Synthetic peptide
DEEMIRTTNPVATEQYGSVSQENLQEGNP

SEQ ID NO: 24000 - protein, 29 aa, Artificial Sequence
  Description of Artificial Sequence: Synthetic peptide
DEEEIRTVNPVATEQYGSASAEVLQRGNR

SEQ ID NO: 24001 - protein, 29 aa, Artificial Sequence
  Description of Artificial Sequence: Synthetic peptide
DEQEIRTTNPVASEIYGSVATNLQRNGNR

SEQ ID NO: 24002 - protein, 31 aa, Artificial Sequence
  Description of Artificial Sequence: Synthetic polypeptide
DEEEIRTTNPVATEQYGDVSTTNLQLRGEND

SEQ ID NO: 24003 - protein, 28 aa, Artificial Sequence
  Description of Artificial Sequence: Synthetic peptide
DEEEIRPTNPEATEMFGSVSTNLQRGNH

SEQ ID NO: 24004 - protein, 28 aa, Artificial Sequence
  Description of Artificial Sequence: Synthetic peptide
DEVEIRTTNPVATEQYGLVSTNLQLLNA

SEQ ID NO: 24005 - protein, 28 aa, Artificial Sequence
  Description of Artificial Sequence: Synthetic peptide
SEEEIRTTNPIAFEQYGSVSTNLGRLNR

SEQ ID NO: 24006 - protein, 30 aa, Artificial Sequence
  Description of Artificial Sequence: Synthetic polypeptide
DEAEIRGTNPVATEQYGSVSAMNLQRAGNR

SEQ ID NO: 24007 - protein, 31 aa, Artificial Sequence
  Description of Artificial Sequence: Synthetic polypeptide
DEEEIRTTNPVATEAYGSVCLTNLQHRTGNR

SEQ ID NO: 24008 - protein, 30 aa, Artificial Sequence
  Description of Artificial Sequence: Synthetic polypeptide
DEEEIRTTNPVATEQYGSVSTVIPLQTGNF

SEQ ID NO: 24009 - protein, 28 aa, Artificial Sequence
  Description of Artificial Sequence: Synthetic peptide
DEEEIRTTNPEATEHYGEVSTNLQRGDS

SEQ ID NO: 24010 - protein, 30 aa, Artificial Sequence
  Description of Artificial Sequence: Synthetic polypeptide
DEEEIRTTNPFATEQYGSVSTINPQMRENR

SEQ ID NO: 24011 - protein, 28 aa, Artificial Sequence
  Description of Artificial Sequence: Synthetic peptide
DEEEIRTTNPVATEQYGSVETPDQIGNW

SEQ ID NO: 24012 - protein, 28 aa, Artificial Sequence
  Description of Artificial Sequence: Synthetic peptide
DEREIATTNPVATEQYGSVGMNLQRGSR

SEQ ID NO: 24013 - protein, 32 aa, Artificial Sequence
  Description of Artificial Sequence: Synthetic polypeptide
DEEEIRTTNPVATEQYGSVSTPNPLQRDGDER

SEQ ID NO: 24014 - protein, 28 aa, Artificial Sequence
  Description of Artificial Sequence: Synthetic peptide
DEVEIVTTNPVSTECYGSVSMNLQRGNR

SEQ ID NO: 24015 - protein, 28 aa, Artificial Sequence
  Description of Artificial Sequence: Synthetic peptide
DIEEIRTTNPVATEQYGSVAMNLQDGNY

SEQ ID NO: 24016 - protein, 28 aa, Artificial Sequence
  Description of Artificial Sequence: Synthetic peptide
DMEEIRSTNPVATEQYGSSSTNMQRGNN

SEQ ID NO: 24017 - protein, 28 aa, Artificial Sequence
  Description of Artificial Sequence: Synthetic peptide
DEEEIRTTNIVGTEQYGVVVTNLQRGNF

SEQ ID NO: 24018 - protein, 28 aa, Artificial Sequence
  Description of Artificial Sequence: Synthetic peptide
DEEEIATTNPVATEQYGSVSTDLQVGET

SEQ ID NO: 24019 - protein, 28 aa, Artificial Sequence
  Description of Artificial Sequence: Synthetic peptide
DETEIRCVNPVATEQYGAVSTNLQRGNQ

SEQ ID NO: 24020 - protein, 31 aa, Artificial Sequence
  Description of Artificial Sequence: Synthetic polypeptide
DEEEIRTTNPVATEQYGSVETENLEREGNDR

SEQ ID NO: 24021 - protein, 29 aa, Artificial Sequence
  Description of Artificial Sequence: Synthetic peptide
DEQEVRTTNPVASEQYGCVSTNLQRNGNR

SEQ ID NO: 24022 - protein, 28 aa, Artificial Sequence
  Description of Artificial Sequence: Synthetic peptide
NEEEIRTTNPDATEQYGSVFTNDQAGNR

SEQ ID NO: 24023 - protein, 30 aa, Artificial Sequence
  Description of Artificial Sequence: Synthetic polypeptide
DEEEIRTTNPVATEQYGSVSCENLQCYGNI

SEQ ID NO: 24024 - protein, 28 aa, Artificial Sequence
  Description of Artificial Sequence: Synthetic peptide
DTEEIRTTNPYATEKYGSVSEGLQRGNR

SEQ ID NO: 24025 - protein, 28 aa, Artificial Sequence
  Description of Artificial Sequence: Synthetic peptide
DEEEIRTTNPVATEQYGSVSDELDRGDI

SEQ ID NO: 24026 - protein, 28 aa, Artificial Sequence
  Description of Artificial Sequence: Synthetic peptide
DEEEIRTTNPEATEQYWSVSTNDERGNM

SEQ ID NO: 24027 - protein, 30 aa, Artificial Sequence
  Description of Artificial Sequence: Synthetic polypeptide
DEEEIRTTNPVATEPYGSVSTNLQELGENT

SEQ ID NO: 24028 - protein, 28 aa, Artificial Sequence
  Description of Artificial Sequence: Synthetic peptide
NEREIRTTNPVATEQYGSVWTNLQIGSR

SEQ ID NO: 24029 - protein, 31 aa, Artificial Sequence
  Description of Artificial Sequence: Synthetic polypeptide
DEEEIRTTNPVATEQYGSVDCTMNLCRGNDR

SEQ ID NO: 24030 - protein, 31 aa, Artificial Sequence
  Description of Artificial Sequence: Synthetic polypeptide
DEEEIRSTNPVATEQYGSVDSTNIQRGDNPR

SEQ ID NO: 24031 - protein, 28 aa, Artificial Sequence
  Description of Artificial Sequence: Synthetic peptide
DEQEIVSTNPVATETYGWVSTNLQRGNR

SEQ ID NO: 24032 - protein, 29 aa, Artificial Sequence
  Description of Artificial Sequence: Synthetic peptide
SEEEIMTTNPVATEQYGSVISTAGQRGNR

SEQ ID NO: 24033 - protein, 29 aa, Artificial Sequence
  Description of Artificial Sequence: Synthetic peptide
QEEEIVTTNPVATEQYGVVSATNLQVGNR

SEQ ID NO: 24034 - protein, 32 aa, Artificial Sequence
  Description of Artificial Sequence: Synthetic polypeptide
DEEEIRTTNPEATEQYGSVTSTANLQRAGNER

SEQ ID NO: 24035 - protein, 32 aa, Artificial Sequence
  Description of Artificial Sequence: Synthetic polypeptide
DEEEIRTTNPVATEQYGASVSSDHNLQREGNR

SEQ ID NO: 24036 - protein, 31 aa, Artificial Sequence
  Description of Artificial Sequence: Synthetic polypeptide
DEEEIRTTNPVATECYGSVSTNLQIRKGNDI

SEQ ID NO: 24037 - protein, 28 aa, Artificial Sequence
  Description of Artificial Sequence: Synthetic peptide
RENEVRTTNPVCTEQYGSVSTNLQRGNQ

SEQ ID NO: 24038 - protein, 30 aa, Artificial Sequence
  Description of Artificial Sequence: Synthetic polypeptide
DEEEIRTTNPVATEGFGSVSATNCQRAGNR

SEQ ID NO: 24039 - protein, 29 aa, Artificial Sequence
  Description of Artificial Sequence: Synthetic peptide
DEEEIRTTNPVCTEQYGSASTNEVTRGNR

SEQ ID NO: 24040 - protein, 28 aa, Artificial Sequence
  Description of Artificial Sequence: Synthetic peptide
DENEIRTTNPVATEQYGDVSENEQRENR

SEQ ID NO: 24041 - protein, 30 aa, Artificial Sequence
  Description of Artificial Sequence: Synthetic polypeptide
NDEEIRTTNPVATEMYGSVSATNLQRNGNR

SEQ ID NO: 24042 - protein, 30 aa, Artificial Sequence
  Description of Artificial Sequence: Synthetic polypeptide
DEEEIRTTNPVATEQYGSWSITNPLQDENR

SEQ ID NO: 24043 - protein, 29 aa, Artificial Sequence
  Description of Artificial Sequence: Synthetic peptide
DEEEIRTTNPVASEIYGCVSSNLQFRGNR

SEQ ID NO: 24044 - protein, 28 aa, Artificial Sequence
  Description of Artificial Sequence: Synthetic peptide
DEEEIRTTNPVATEQYGSVETNDQEGEA

SEQ ID NO: 24045 - protein, 28 aa, Artificial Sequence
  Description of Artificial Sequence: Synthetic peptide
DEEEIRTTNPDATQQYGSVSTNDEFGNR

SEQ ID NO: 24046 - protein, 30 aa, Artificial Sequence
  Description of Artificial Sequence: Synthetic polypeptide
DEQEIRTTNPVATEQYGSVESTEDQRGNPR

SEQ ID NO: 24047 - protein, 30 aa, Artificial Sequence
  Description of Artificial Sequence: Synthetic polypeptide
SEEEIRTTNPVATEQYGSVSTANEQRGDDR

SEQ ID NO: 24048 - protein, 30 aa, Artificial Sequence
  Description of Artificial Sequence: Synthetic polypeptide
DEECIRTTNPVATEQYGSWSDTNLVQRGNP

SEQ ID NO: 24049 - protein, 30 aa, Artificial Sequence
  Description of Artificial Sequence: Synthetic polypeptide
DEEEIMTTNPVATEQYGSVSTCNLQTGDNQ

SEQ ID NO: 24050 - protein, 28 aa, Artificial Sequence
  Description of Artificial Sequence: Synthetic peptide
DEEEITTTNPVATEQYGVVSTNLQGGEL

SEQ ID NO: 24051 - protein, 28 aa, Artificial Sequence
  Description of Artificial Sequence: Synthetic peptide
DDEEIRTVNPVATEQYGTVSTELQRGNF

SEQ ID NO: 24052 - protein, 28 aa, Artificial Sequence
  Description of Artificial Sequence: Synthetic peptide
DEEEIRTTNIVATEQYGSVSTDLQIGEM

SEQ ID NO: 24053 - protein, 29 aa, Artificial Sequence
  Description of Artificial Sequence: Synthetic peptide
DEEEIRTTNPVATEQYGSVSDNLQEHGEM

SEQ ID NO: 24054 - protein, 30 aa, Artificial Sequence
  Description of Artificial Sequence: Synthetic polypeptide
DEEEIRCTNPVASEQYGSVSAMNLQRNGNR

SEQ ID NO: 24055 - protein, 31 aa, Artificial Sequence
  Description of Artificial Sequence: Synthetic polypeptide
SEEEIRTTNPVATEQYGSVSTNLQCRKGNDG

SEQ ID NO: 24056 - protein, 30 aa, Artificial Sequence
  Description of Artificial Sequence: Synthetic polypeptide
DEEEIRTTNPVATEQYGSVETENDQAGDNR

SEQ ID NO: 24057 - protein, 31 aa, Artificial Sequence
  Description of Artificial Sequence: Synthetic polypeptide
DEEEIRTTNPVATEQYGSVLAHTENLQRMNR

SEQ ID NO: 24058 - protein, 30 aa, Artificial Sequence
  Description of Artificial Sequence: Synthetic polypeptide
DEEEIRTTNPVSTEIYGSVSCTNLQCDGNR

SEQ ID NO: 24059 - protein, 30 aa, Artificial Sequence
  Description of Artificial Sequence: Synthetic polypeptide
DEEEITTTNPVATEQYGSVNSTNLDRGNDN

SEQ ID NO: 24060 - protein, 28 aa, Artificial Sequence
  Description of Artificial Sequence: Synthetic peptide
DEEEIRTTNPEATEQYGSVSTDDQHGNN

SEQ ID NO: 24061 - protein, 28 aa, Artificial Sequence
  Description of Artificial Sequence: Synthetic peptide
DEEEIRTTNPVSTETYGSVFTDLQRLNR

SEQ ID NO: 24062 - protein, 28 aa, Artificial Sequence
  Description of Artificial Sequence: Synthetic peptide
GEEELRTTNPVATECYGTVSTNLQRGTR

SEQ ID NO: 24063 - protein, 30 aa, Artificial Sequence
  Description of Artificial Sequence: Synthetic polypeptide
DEEEIRTTNPVATEQYGSIVGINALQRGFR

SEQ ID NO: 24064 - protein, 28 aa, Artificial Sequence
  Description of Artificial Sequence: Synthetic peptide
DEEEIRTTNPVATEQYGSVETPLQAGDE

SEQ ID NO: 24065 - protein, 30 aa, Artificial Sequence
  Description of Artificial Sequence: Synthetic polypeptide
DEEEIRTTNPVATEQYGSVSCTMDLQQGNE

SEQ ID NO: 24066 - protein, 30 aa, Artificial Sequence
  Description of Artificial Sequence: Synthetic polypeptide
DEEEIRTTNPVATEQYGSVSDTELEERGNY

SEQ ID NO: 24067 - protein, 30 aa, Artificial Sequence
  Description of Artificial Sequence: Synthetic polypeptide
DEEEIAATNPVATEQYGSVSTNLQDREGNE

SEQ ID NO: 24068 - protein, 30 aa, Artificial Sequence
  Description of Artificial Sequence: Synthetic polypeptide
DEEEIRTTNPFATEQYGAVSTNNLQLGNDR

SEQ ID NO: 24069 - protein, 28 aa, Artificial Sequence
  Description of Artificial Sequence: Synthetic peptide
DEMEIATTNIVATENYGVVSTNLQRGNR

SEQ ID NO: 24070 - protein, 29 aa, Artificial Sequence
  Description of Artificial Sequence: Synthetic peptide
DEEEIRTTNPVATEQYGHSYSENLQRGDA

SEQ ID NO: 24071 - protein, 28 aa, Artificial Sequence
  Description of Artificial Sequence: Synthetic peptide
DEEEIRQTNPVATEQYGDVSENPQRENR

SEQ ID NO: 24072 - protein, 30 aa, Artificial Sequence
  Description of Artificial Sequence: Synthetic polypeptide
DEEEIRTTNPVATEQYGSVSTMNEQQGDNA

SEQ ID NO: 24073 - protein, 30 aa, Artificial Sequence
  Description of Artificial Sequence: Synthetic polypeptide
DEEEIRTTNPVATEQYGSVSCENLQCQGNV

SEQ ID NO: 24074 - protein, 30 aa, Artificial Sequence
  Description of Artificial Sequence: Synthetic polypeptide
DEEEIRTTNPEATEQYGSVSTNGDQIEGNR

SEQ ID NO: 24075 - protein, 31 aa, Artificial Sequence
  Description of Artificial Sequence: Synthetic polypeptide
DEEEIRTTNPVASEQYGSVSQTNQQREGTNR

SEQ ID NO: 24076 - protein, 28 aa, Artificial Sequence
  Description of Artificial Sequence: Synthetic peptide
DDEELRTTNPVATEQYGSMSTAVQRGNR

SEQ ID NO: 24077 - protein, 31 aa, Artificial Sequence
  Description of Artificial Sequence: Synthetic polypeptide
DSEEIRTTNPVATEQYGSVDSAPNLQRGHNR

SEQ ID NO: 24078 - protein, 28 aa, Artificial Sequence
  Description of Artificial Sequence: Synthetic peptide
DEEEIRTTNPEATEQYGSVSTNLDAEND

SEQ ID NO: 24079 - protein, 28 aa, Artificial Sequence
  Description of Artificial Sequence: Synthetic peptide
SEEEIRCTNPAATELYGSVSTNDQRGNR

SEQ ID NO: 24080 - protein, 28 aa, Artificial Sequence
  Description of Artificial Sequence: Synthetic peptide
DEMEIRTTNPVATEQYGSVDADIQRGNR

SEQ ID NO: 24081 - protein, 28 aa, Artificial Sequence
  Description of Artificial Sequence: Synthetic peptide
DEEEIRTTNPVATEQYGEASEVLQRGGR

SEQ ID NO: 24082 - protein, 31 aa, Artificial Sequence
  Description of Artificial Sequence: Synthetic polypeptide
DEEEIRTTNPVATEQYGSVSTNLQEQEGNDM

SEQ ID NO: 24083 - protein, 28 aa, Artificial Sequence
  Description of Artificial Sequence: Synthetic peptide
DEDEVRTTNPVATEGYGSVAMNLQRGNR

SEQ ID NO: 24084 - protein, 31 aa, Artificial Sequence
  Description of Artificial Sequence: Synthetic polypeptide
DEEEIRTTNPVATEQYGSVEETNEQRNGDNR

SEQ ID NO: 24085 - protein, 28 aa, Artificial Sequence
  Description of Artificial Sequence: Synthetic peptide
DDEEIKTTNPVAYEQYGSTSMNLQRGNR

SEQ ID NO: 24086 - protein, 29 aa, Artificial Sequence
  Description of Artificial Sequence: Synthetic peptide
DEVEIRCTNPVATEQYGSVSMNLQDRGNN

SEQ ID NO: 24087 - protein, 28 aa, Artificial Sequence
  Description of Artificial Sequence: Synthetic peptide
DEEEIRTTNPDATEQYGSVSTEEQNGER

SEQ ID NO: 24088 - protein, 28 aa, Artificial Sequence
  Description of Artificial Sequence: Synthetic peptide
DEEEIRTTNPVDTDQYGTVSTNLQGGNG

SEQ ID NO: 24089 - protein, 28 aa, Artificial Sequence
  Description of Artificial Sequence: Synthetic peptide
NEEELRTTNPVASEQYGSVAMNLQRGNR

SEQ ID NO: 24090 - protein, 31 aa, Artificial Sequence
  Description of Artificial Sequence: Synthetic polypeptide
DEEEIRTTNPVATEQYGSVSTNLQEIEGEER

SEQ ID NO: 24091 - protein, 31 aa, Artificial Sequence
  Description of Artificial Sequence: Synthetic polypeptide
DEEEIRTTNPVATEQYGSVSETNLEDEGENR

SEQ ID NO: 24092 - protein, 29 aa, Artificial Sequence
  Description of Artificial Sequence: Synthetic peptide
DESEIRTVNPVATEQYGVVSTNLQRGNDC

SEQ ID NO: 24093 - protein, 30 aa, Artificial Sequence
  Description of Artificial Sequence: Synthetic polypeptide
DEEEIRTTNPDATEQYGSVSTNPLTQPGND

SEQ ID NO: 24094 - protein, 28 aa, Artificial Sequence
  Description of Artificial Sequence: Synthetic peptide
DEEEIRTTNPVATEQYGSVETDEQRGEA

SEQ ID NO: 24095 - protein, 28 aa, Artificial Sequence
  Description of Artificial Sequence: Synthetic peptide
DEEEIRTTNPVATEQYWSVSTNEDRENQ

SEQ ID NO: 24096 - protein, 30 aa, Artificial Sequence
  Description of Artificial Sequence: Synthetic polypeptide
DHEEIRTTNPVATEQYGSVSHGLQRGENDR

SEQ ID NO: 24097 - protein, 28 aa, Artificial Sequence
  Description of Artificial Sequence: Synthetic peptide
DEAEIRTTNPVATELFGSVPTNCQRGNR

SEQ ID NO: 24098 - protein, 30 aa, Artificial Sequence
  Description of Artificial Sequence: Synthetic polypeptide
GEEEIRTTNPVATELYGSVCSTNLQREGNA

SEQ ID NO: 24099 - protein, 30 aa, Artificial Sequence
  Description of Artificial Sequence: Synthetic polypeptide
DEEEIRTTNPVATEQYGSVDSTELQDEGNE

SEQ ID NO: 24100 - protein, 28 aa, Artificial Sequence
  Description of Artificial Sequence: Synthetic peptide
NEEEIRTTNPCATEQYGSVDTNWERGNR

SEQ ID NO: 24101 - protein, 28 aa, Artificial Sequence
  Description of Artificial Sequence: Synthetic peptide
DEEEIRTTNIVATEQYGSVSTNDEHGER

SEQ ID NO: 24102 - protein, 28 aa, Artificial Sequence
  Description of Artificial Sequence: Synthetic peptide
DEEEIRTTNIVATEQYGSASENDQRGNF

SEQ ID NO: 24103 - protein, 29 aa, Artificial Sequence
  Description of Artificial Sequence: Synthetic peptide
SEEEIRTTNPVATELYGSVSTMNLYRGNG

SEQ ID NO: 24104 - protein, 29 aa, Artificial Sequence
  Description of Artificial Sequence: Synthetic peptide
DEEEIRTTNPVATECYGSMSTNLQDNGNA

SEQ ID NO: 24105 - protein, 28 aa, Artificial Sequence
  Description of Artificial Sequence: Synthetic peptide
DEMELSTTNPVATENYGSVSENLQRGNR

SEQ ID NO: 24106 - protein, 28 aa, Artificial Sequence
  Description of Artificial Sequence: Synthetic peptide
DEEEIRSTNIVATMQYGSVSTLEQRGNR

SEQ ID NO: 24107 - protein, 28 aa, Artificial Sequence
  Description of Artificial Sequence: Synthetic peptide
DEEEIRTTNPVATEQYGSVETDDQRENF

SEQ ID NO: 24108 - protein, 30 aa, Artificial Sequence
  Description of Artificial Sequence: Synthetic polypeptide
DEEEIRTTNPVATEQYGSVDSTNLEDDGND

SEQ ID NO: 24109 - protein, 31 aa, Artificial Sequence
  Description of Artificial Sequence: Synthetic polypeptide
DEEEIRATNPVATEQYGSVSVTMNLQLQGNR

SEQ ID NO: 24110 - protein, 33 aa, Artificial Sequence
  Description of Artificial Sequence: Synthetic polypeptide
DEEEIRTTNPVATEQYGSVESDTNPLQRDGDNR

SEQ ID NO: 24111 - protein, 32 aa, Artificial Sequence
  Description of Artificial Sequence: Synthetic polypeptide
DEEEIRTTNPVATEQYGSVSTCNLQDVEGNTR

SEQ ID NO: 24112 - protein, 28 aa, Artificial Sequence
  Description of Artificial Sequence: Synthetic peptide
DEEEIRTTNPDATEQYGSVDTGLQGGNS

SEQ ID NO: 24113 - protein, 29 aa, Artificial Sequence
  Description of Artificial Sequence: Synthetic peptide
DEQEIRTTNPVSTEVYGSVSTVLQRAGNR

SEQ ID NO: 24114 - protein, 28 aa, Artificial Sequence
  Description of Artificial Sequence: Synthetic peptide
DEEEIRTTNPEATEQYGSVSTDEQTGNA

SEQ ID NO: 24115 - protein, 30 aa, Artificial Sequence
  Description of Artificial Sequence: Synthetic polypeptide
DEEEIRTTNPTATEQYGSVSTMNEQNGDNR

SEQ ID NO: 24116 - protein, 28 aa, Artificial Sequence
  Description of Artificial Sequence: Synthetic peptide
DEEEIATTNIVATEQYGSVSENDQRENR

SEQ ID NO: 24117 - protein, 28 aa, Artificial Sequence
  Description of Artificial Sequence: Synthetic peptide
DEEEIRTVNPAATEQYGSVSTDLQQGDR

SEQ ID NO: 24118 - protein, 28 aa, Artificial Sequence
  Description of Artificial Sequence: Synthetic peptide
DEDEIRSTNPVATELYGCVSMNLQRGNR

SEQ ID NO: 24119 - protein, 28 aa, Artificial Sequence
  Description of Artificial Sequence: Synthetic peptide
DEEEIRCVNPVATEQYGSVSTNYQQGNA

SEQ ID NO: 24120 - protein, 32 aa, Artificial Sequence
  Description of Artificial Sequence: Synthetic polypeptide
DEEEIRTTNPFATEQYGSVSTLNLTQRGDNPR

SEQ ID NO: 24121 - protein, 28 aa, Artificial Sequence
  Description of Artificial Sequence: Synthetic peptide
DEEELRAVNPVATEQYGVVSTNLQRLNR

SEQ ID NO: 24122 - protein, 28 aa, Artificial Sequence
  Description of Artificial Sequence: Synthetic peptide
DEEEIRTTNPEATEQYGSVSDNLEIENR

SEQ ID NO: 24123 - protein, 28 aa, Artificial Sequence
  Description of Artificial Sequence: Synthetic peptide
DEEEIRTTNPEATEQYGSVSEGLQMGNV

SEQ ID NO: 24124 - protein, 30 aa, Artificial Sequence
  Description of Artificial Sequence: Synthetic polypeptide
DEEEIRTTNPVATEQYGSVSTDLQETGNDN

SEQ ID NO: 24125 - protein, 28 aa, Artificial Sequence
  Description of Artificial Sequence: Synthetic peptide
LEEEVRTTNPMATEQWGSVSTNVQRGNR

SEQ ID NO: 24126 - protein, 28 aa, Artificial Sequence
  Description of Artificial Sequence: Synthetic peptide
DEEEIRSTNIVSTAQYGSVSTNKQRGNR

SEQ ID NO: 24127 - protein, 29 aa, Artificial Sequence
  Description of Artificial Sequence: Synthetic peptide
DEEEIRTTNPVATEQYGSVSENLQENENA

SEQ ID NO: 24128 - protein, 28 aa, Artificial Sequence
  Description of Artificial Sequence: Synthetic peptide
YEEELRSVNPVATEQYGSVSTNLQRGMR

SEQ ID NO: 24129 - protein, 30 aa, Artificial Sequence
  Description of Artificial Sequence: Synthetic polypeptide
DEWEIRTTNPVATEQYGSSVSTNLVQRGED

SEQ ID NO: 24130 - protein, 30 aa, Artificial Sequence
  Description of Artificial Sequence: Synthetic polypeptide
DHEEIRTTNPVATEQYGSVSTNLVDPGENR

SEQ ID NO: 24131 - protein, 29 aa, Artificial Sequence
  Description of Artificial Sequence: Synthetic peptide
DEEEIRTTNPVATECYGVVSETELQRGNS

SEQ ID NO: 24132 - protein, 32 aa, Artificial Sequence
  Description of Artificial Sequence: Synthetic polypeptide
DEEEIRTTNPVATEQYGSVCPCTNLQIRGNDR

SEQ ID NO: 24133 - protein, 31 aa, Artificial Sequence
  Description of Artificial Sequence: Synthetic polypeptide
DEEEIRTTNPVATEQYGSVSTDLEEREGENR

SEQ ID NO: 24134 - protein, 28 aa, Artificial Sequence
  Description of Artificial Sequence: Synthetic peptide
DEMEIATTNPVATELYGSTSENLQRGNR

SEQ ID NO: 24135 - protein, 28 aa, Artificial Sequence
  Description of Artificial Sequence: Synthetic peptide
DEEEIMSTNPVATEQYGSVSTNLPFGNV

SEQ ID NO: 24136 - protein, 28 aa, Artificial Sequence
  Description of Artificial Sequence: Synthetic peptide
NEEEIRSTNPVATEQYGGVGNNLQRGNR

SEQ ID NO: 24137 - protein, 31 aa, Artificial Sequence
  Description of Artificial Sequence: Synthetic polypeptide
DEEEIRTTNPVATEQYGSVSTNLQDREGEDD

SEQ ID NO: 24138 - protein, 28 aa, Artificial Sequence
  Description of Artificial Sequence: Synthetic peptide
HECEISTTNPVATEQYGSVSNNVQRGNR

SEQ ID NO: 24139 - protein, 31 aa, Artificial Sequence
  Description of Artificial Sequence: Synthetic polypeptide
DEEEIRTTNPVATEQYGECVSTCNLQMGDNR

SEQ ID NO: 24140 - protein, 28 aa, Artificial Sequence
  Description of Artificial Sequence: Synthetic peptide
DEEEITSTNPVATEQYGSVSMELQMGNR

SEQ ID NO: 24141 - protein, 28 aa, Artificial Sequence
  Description of Artificial Sequence: Synthetic peptide
YEMEIRTTNPVSTEPYGSVSTNLQAGNR

SEQ ID NO: 24142 - protein, 31 aa, Artificial Sequence
  Description of Artificial Sequence: Synthetic polypeptide
DEEEIRTTNPVATEQYGSVETGNLQVDKGNR

SEQ ID NO: 24143 - protein, 30 aa, Artificial Sequence
  Description of Artificial Sequence: Synthetic polypeptide
DEEEIRTTNPVATEQYGSVSTDLQEQGNDI

SEQ ID NO: 24144 - protein, 31 aa, Artificial Sequence
  Description of Artificial Sequence: Synthetic polypeptide
DEQEIRTTNPVATEQYGYVDSTGNLPQRGNR

SEQ ID NO: 24145 - protein, 28 aa, Artificial Sequence
  Description of Artificial Sequence: Synthetic peptide
DENEIRTTNIVATEQYGSVSTNDQQGNL

SEQ ID NO: 24146 - protein, 31 aa, Artificial Sequence
  Description of Artificial Sequence: Synthetic polypeptide
DEEEIRTTNPVATEQYGISVSSTNEQDQGNR

SEQ ID NO: 24147 - protein, 28 aa, Artificial Sequence
  Description of Artificial Sequence: Synthetic peptide
DEEEIRCTNPECTEVYGSVSTNEQRGNR

SEQ ID NO: 24148 - protein, 31 aa, Artificial Sequence
  Description of Artificial Sequence: Synthetic polypeptide
DEEEIRTTNPVATEQYGESVESTNEQDGNPR

SEQ ID NO: 24149 - protein, 31 aa, Artificial Sequence
  Description of Artificial Sequence: Synthetic polypeptide
DEEEIRTTNPVATEQYGSVSETNLEEDDGNR

SEQ ID NO: 24150 - protein, 28 aa, Artificial Sequence
  Description of Artificial Sequence: Synthetic peptide
DEEEIRTTNPECTEQYGSVSTGLQRGTD

SEQ ID NO: 24151 - protein, 31 aa, Artificial Sequence
  Description of Artificial Sequence: Synthetic polypeptide
DEEEIRTTNPVATEQYGSVSCTMNLCLGNDR

SEQ ID NO: 24152 - protein, 30 aa, Artificial Sequence
  Description of Artificial Sequence: Synthetic polypeptide
DEEEIRTTNPVATEQYGSVSTNLEERGEDF

SEQ ID NO: 24153 - protein, 30 aa, Artificial Sequence
  Description of Artificial Sequence: Synthetic polypeptide
DEEEIRTTNPVATECYGSVSDTNLQNGENI

SEQ ID NO: 24154 - protein, 28 aa, Artificial Sequence
  Description of Artificial Sequence: Synthetic peptide
DEEEIITTNPVATEQYGSVSTDLQEGDA

SEQ ID NO: 24155 - protein, 28 aa, Artificial Sequence
  Description of Artificial Sequence: Synthetic peptide
DEEEIATTNPVATECYGSVSTDLEHGNR

SEQ ID NO: 24156 - protein, 28 aa, Artificial Sequence
  Description of Artificial Sequence: Synthetic peptide
DEEEIRTTNIVATEQYGWVSAGLQRGNT

SEQ ID NO: 24157 - protein, 28 aa, Artificial Sequence
  Description of Artificial Sequence: Synthetic peptide
DEEEIRTTNIVATEQYGSVSTNLENGTQ

SEQ ID NO: 24158 - protein, 28 aa, Artificial Sequence
  Description of Artificial Sequence: Synthetic peptide
KENCIRTTNPVATEQYGSVSTNPDRGNR

SEQ ID NO: 24159 - protein, 29 aa, Artificial Sequence
  Description of Artificial Sequence: Synthetic peptide
DEEEIRTTNPVATEQWGSVSTNEMIQGNR

SEQ ID NO: 24160 - protein, 28 aa, Artificial Sequence
  Description of Artificial Sequence: Synthetic peptide
QEEEIRTVNPVSTEQYGEVSTNLQRLNR

SEQ ID NO: 24161 - protein, 28 aa, Artificial Sequence
  Description of Artificial Sequence: Synthetic peptide
DEEEIVTTNPVATETYGSVSTALQNGPR

SEQ ID NO: 24162 - protein, 32 aa, Artificial Sequence
  Description of Artificial Sequence: Synthetic polypeptide
DEEEIRTTNPVATEQYGSVSCTCNLPQRGELR

SEQ ID NO: 24163 - protein, 28 aa, Artificial Sequence
  Description of Artificial Sequence: Synthetic peptide
DEEEIRTTNPVCTEQYGMVSDHLQFGNR

SEQ ID NO: 24164 - protein, 29 aa, Artificial Sequence
  Description of Artificial Sequence: Synthetic peptide
DEDEIRCTNPVAVEQYGAVSTNLQREGNR

SEQ ID NO: 24165 - protein, 31 aa, Artificial Sequence
  Description of Artificial Sequence: Synthetic polypeptide
SEREIRTTNPVATEQYGSVSTNLQLRKGNDR

SEQ ID NO: 24166 - protein, 28 aa, Artificial Sequence
  Description of Artificial Sequence: Synthetic peptide
DEEQINTVNPVATEQYGSVSTNLQGGPR

SEQ ID NO: 24167 - protein, 30 aa, Artificial Sequence
  Description of Artificial Sequence: Synthetic polypeptide
DEDEIRTTNPVATELYGSVISTNLPQRGDR

SEQ ID NO: 24168 - protein, 31 aa, Artificial Sequence
  Description of Artificial Sequence: Synthetic polypeptide
DEEEIRTTNPDATEQYGSVSETNLQRDENER

SEQ ID NO: 24169 - protein, 31 aa, Artificial Sequence
  Description of Artificial Sequence: Synthetic polypeptide
DEEEIRTTNPVATEQYGSVDSYWNLPQLGNR

SEQ ID NO: 24170 - protein, 29 aa, Artificial Sequence
  Description of Artificial Sequence: Synthetic peptide
DEEEIRCTNPVASEQYGSVSANNLERGNR

SEQ ID NO: 24171 - protein, 28 aa, Artificial Sequence
  Description of Artificial Sequence: Synthetic peptide
DEEEIATTNPDATEQYGSVGTNEQRGNQ

SEQ ID NO: 24172 - protein, 28 aa, Artificial Sequence
  Description of Artificial Sequence: Synthetic peptide
DPEEIRTTNPVATEQYGSVFHNDQRGER

SEQ ID NO: 24173 - protein, 28 aa, Artificial Sequence
  Description of Artificial Sequence: Synthetic peptide
EEEEIRTTNPVAHEQFGSVSTNLQFGNN

SEQ ID NO: 24174 - protein, 28 aa, Artificial Sequence
  Description of Artificial Sequence: Synthetic peptide
DEEEIATTNPVATEMYGSMSDNLQVGNR

SEQ ID NO: 24175 - protein, 28 aa, Artificial Sequence
  Description of Artificial Sequence: Synthetic peptide
DEEEIATTNIVAWEQYGSVSDALQRGNR

SEQ ID NO: 24176 - protein, 30 aa, Artificial Sequence
  Description of Artificial Sequence: Synthetic polypeptide
DEEEIRTTNPVATEQYGMVSTINLQLGGNE

SEQ ID NO: 24177 - protein, 28 aa, Artificial Sequence
  Description of Artificial Sequence: Synthetic peptide
DEEEIRATNPDATEQYGSVSTNLQGGEI

SEQ ID NO: 24178 - protein, 28 aa, Artificial Sequence
  Description of Artificial Sequence: Synthetic peptide
DEQEIVATNPVATEIYGWVSTNLQRGNR

SEQ ID NO: 24179 - protein, 28 aa, Artificial Sequence
  Description of Artificial Sequence: Synthetic peptide
DEDEIATTNPFATEQYGSVSTNLERPNR

SEQ ID NO: 24180 - protein, 28 aa, Artificial Sequence
  Description of Artificial Sequence: Synthetic peptide
DETEVRTTNIVATEQYGCVATNLQRGNR

SEQ ID NO: 24181 - protein, 32 aa, Artificial Sequence
  Description of Artificial Sequence: Synthetic polypeptide
DEEEIRTTNPVATEQYGSVSTINLPQSRGPNN

SEQ ID NO: 24182 - protein, 29 aa, Artificial Sequence
  Description of Artificial Sequence: Synthetic peptide
DEEEIRTTNPVATEQYGSVETIEDQRGNA

SEQ ID NO: 24183 - protein, 28 aa, Artificial Sequence
  Description of Artificial Sequence: Synthetic peptide
DEEEIRTTNPVATEWYGSVDTNEQQGNM

SEQ ID NO: 24184 - protein, 29 aa, Artificial Sequence
  Description of Artificial Sequence: Synthetic peptide
DEEEITTTNPVATEQYGDVSTNLERFGNQ

SEQ ID NO: 24185 - protein, 30 aa, Artificial Sequence
  Description of Artificial Sequence: Synthetic polypeptide
DEEEIRTTNPVATEQYGSVSTNLQDQGEDM

SEQ ID NO: 24186 - protein, 28 aa, Artificial Sequence
  Description of Artificial Sequence: Synthetic peptide
SEEEIRTTNPTATEQYGSVSTNEQPGNF

SEQ ID NO: 24187 - protein, 30 aa, Artificial Sequence
  Description of Artificial Sequence: Synthetic polypeptide
DEEEIRTTNPVATEQYGSVETNLQDDGENE

SEQ ID NO: 24188 - protein, 30 aa, Artificial Sequence
  Description of Artificial Sequence: Synthetic polypeptide
DEEEIRTTNPVAVEQYGSVSCNMNLQRGND

SEQ ID NO: 24189 - protein, 29 aa, Artificial Sequence
  Description of Artificial Sequence: Synthetic peptide
DEHEIRTTNPVATEQYGSVSQNLFRNMNR

SEQ ID NO: 24190 - protein, 32 aa, Artificial Sequence
  Description of Artificial Sequence: Synthetic polypeptide
DEEEIATTNPVATEQYGSVDSATNGLVQRGNR

SEQ ID NO: 24191 - protein, 28 aa, Artificial Sequence
  Description of Artificial Sequence: Synthetic peptide
GEEEIVTTNPVATEQYGDVSDNLQTGNR

SEQ ID NO: 24192 - protein, 28 aa, Artificial Sequence
  Description of Artificial Sequence: Synthetic peptide
DEEEIRTTNPFATEQYGSVSEPLQYGNG

SEQ ID NO: 24193 - protein, 28 aa, Artificial Sequence
  Description of Artificial Sequence: Synthetic peptide
QEQEIRTTNPVATEVYGSVSEVLQRGNR

SEQ ID NO: 24194 - protein, 28 aa, Artificial Sequence
  Description of Artificial Sequence: Synthetic peptide
DEEEIRTTNPFATEQYGSVSTGLDDGNP

SEQ ID NO: 24195 - protein, 31 aa, Artificial Sequence
  Description of Artificial Sequence: Synthetic polypeptide
DEEEIRTTNPVATEQYGSVSTNLEDVNGNDR

SEQ ID NO: 24196 - protein, 28 aa, Artificial Sequence
  Description of Artificial Sequence: Synthetic peptide
DEEEIRTTNIVATEQYGSVSENLQHGTD

SEQ ID NO: 24197 - protein, 28 aa, Artificial Sequence
  Description of Artificial Sequence: Synthetic peptide
VEEEIRTTNPVATEQYGSVSTDLQVGDH

SEQ ID NO: 24198 - protein, 31 aa, Artificial Sequence
  Description of Artificial Sequence: Synthetic polypeptide
DEEEIRTTNPFATEQYGSVASTNQQVRGDNR

SEQ ID NO: 24199 - protein, 30 aa, Artificial Sequence
  Description of Artificial Sequence: Synthetic polypeptide
DEEEIRTTNPVATEQYGSVSTNGLDRKGES

SEQ ID NO: 24200 - protein, 28 aa, Artificial Sequence
  Description of Artificial Sequence: Synthetic peptide
DEEEIRTTNPEATQQYGSVSTNLLHGND

SEQ ID NO: 24201 - protein, 28 aa, Artificial Sequence
  Description of Artificial Sequence: Synthetic peptide
DEEEIRTTNPVSTEQYGSASTVLMRENR

SEQ ID NO: 24202 - protein, 28 aa, Artificial Sequence
  Description of Artificial Sequence: Synthetic peptide
KENEIRTVNPVATEQYGSVSENLQHGNR

SEQ ID NO: 24203 - protein, 31 aa, Artificial Sequence
  Description of Artificial Sequence: Synthetic polypeptide
DEEEIRTTNPDATEQYGSVSCTNNLNRGVNR

SEQ ID NO: 24204 - protein, 32 aa, Artificial Sequence
  Description of Artificial Sequence: Synthetic polypeptide
DEEEIRTTNPEATEQYGSVSETLNGLTQRGNR

SEQ ID NO: 24205 - protein, 29 aa, Artificial Sequence
  Description of Artificial Sequence: Synthetic peptide
DEEEIRTTNPVATEQYGDYSTILQNRGDR

SEQ ID NO: 24206 - protein, 28 aa, Artificial Sequence
  Description of Artificial Sequence: Synthetic peptide
DDEEIRTTNPVATECYGSVANNLQRGTR

SEQ ID NO: 24207 - protein, 28 aa, Artificial Sequence
  Description of Artificial Sequence: Synthetic peptide
DEWEIRTTNIVATEQYGCVSTNLNRGQR

SEQ ID NO: 24208 - protein, 29 aa, Artificial Sequence
  Description of Artificial Sequence: Synthetic peptide
DEEEIRTTNPVATCYYGDVSTGLQRGNNR

SEQ ID NO: 24209 - protein, 28 aa, Artificial Sequence
  Description of Artificial Sequence: Synthetic peptide
DEQEITTTNPVATEQYGVVSNNLQRGLR

SEQ ID NO: 24210 - protein, 28 aa, Artificial Sequence
  Description of Artificial Sequence: Synthetic peptide
DEEEIRTTNPDAYEQYGSVFTGPQRGNR

SEQ ID NO: 24211 - protein, 28 aa, Artificial Sequence
  Description of Artificial Sequence: Synthetic peptide
SSEEIRTTNPVATHQYGSVSTWLQRGNF

SEQ ID NO: 24212 - protein, 31 aa, Artificial Sequence
  Description of Artificial Sequence: Synthetic polypeptide
DEEEIRTTNPFATEQYGSVYSDTMNLQRGNQ

SEQ ID NO: 24213 - protein, 29 aa, Artificial Sequence
  Description of Artificial Sequence: Synthetic peptide
DEEEIRTTNPVATAIYGSVNQTNLSRGNR

SEQ ID NO: 24214 - protein, 28 aa, Artificial Sequence
  Description of Artificial Sequence: Synthetic peptide
ESEEIRCVNPVATEQYGSVSTNLQRGNE

SEQ ID NO: 24215 - protein, 28 aa, Artificial Sequence
  Description of Artificial Sequence: Synthetic peptide
HEEEIRPTNPVCTEQYGSVSTNDQRGNN

SEQ ID NO: 24216 - protein, 28 aa, Artificial Sequence
  Description of Artificial Sequence: Synthetic peptide
QEQEIRTTNPVSTEMYGSVSTNLQRGGR

SEQ ID NO: 24217 - protein, 31 aa, Artificial Sequence
  Description of Artificial Sequence: Synthetic polypeptide
DEEEIRTTNPVATEQYGESWSTNLIQIRENR

SEQ ID NO: 24218 - protein, 28 aa, Artificial Sequence
  Description of Artificial Sequence: Synthetic peptide
DENEIRTTNPVATECWGSVSTNEQQGNR

SEQ ID NO: 24219 - protein, 28 aa, Artificial Sequence
  Description of Artificial Sequence: Synthetic peptide
DEEEIRQTNPVATEQYGDVSTAPQTGNR

SEQ ID NO: 24220 - protein, 28 aa, Artificial Sequence
  Description of Artificial Sequence: Synthetic peptide
DEEEIRTTNPFATEQYGSVSTEQQPGNF

SEQ ID NO: 24221 - protein, 29 aa, Artificial Sequence
  Description of Artificial Sequence: Synthetic peptide
DEEEIRTTNPVATECYGSVSTDLQERGDE

SEQ ID NO: 24222 - protein, 31 aa, Artificial Sequence
  Description of Artificial Sequence: Synthetic polypeptide
DEEEIRTTNPVATEQYGSVSENNPQRAGNDR

SEQ ID NO: 24223 - protein, 28 aa, Artificial Sequence
  Description of Artificial Sequence: Synthetic peptide
DEEEIRTTNPDATEQYGSVSTNEDQENR

SEQ ID NO: 24224 - protein, 32 aa, Artificial Sequence
  Description of Artificial Sequence: Synthetic polypeptide
IEEEIRTTNPVATEQYGSVSVTNNLSQRGNTR

SEQ ID NO: 24225 - protein, 28 aa, Artificial Sequence
  Description of Artificial Sequence: Synthetic peptide
DEQEIRTTNPVATENYGIVGTNLQRGLR

SEQ ID NO: 24226 - protein, 31 aa, Artificial Sequence
  Description of Artificial Sequence: Synthetic polypeptide
DEEEIRTTNPVATEQYGSVSTENLERGEEDR

SEQ ID NO: 24227 - protein, 31 aa, Artificial Sequence
  Description of Artificial Sequence: Synthetic polypeptide
DEEEIRTTNPTATEQYGSVSTNPQLREGNDR

SEQ ID NO: 24228 - protein, 28 aa, Artificial Sequence
  Description of Artificial Sequence: Synthetic peptide
DEEEIRTTNPDATEQYGSVSTNEEPGNM

SEQ ID NO: 24229 - protein, 31 aa, Artificial Sequence
  Description of Artificial Sequence: Synthetic polypeptide
DEEQIRTTNPVATEQYWGSVSTPNLDREGNR

SEQ ID NO: 24230 - protein, 28 aa, Artificial Sequence
  Description of Artificial Sequence: Synthetic peptide
SLECIRTTNPVATEQYGSVSTNPQRGNG

SEQ ID NO: 24231 - protein, 28 aa, Artificial Sequence
  Description of Artificial Sequence: Synthetic peptide
DEEEIRTTNPVATELYGDVSTEDQRGDR

SEQ ID NO: 24232 - protein, 29 aa, Artificial Sequence
  Description of Artificial Sequence: Synthetic peptide
DPEEIRTTNPVATEQYGAVSTNLVLRGNP

SEQ ID NO: 24233 - protein, 28 aa, Artificial Sequence
  Description of Artificial Sequence: Synthetic peptide
SEFEIRTTNPVATEIFGSVSTNLQRGNA

SEQ ID NO: 24234 - protein, 28 aa, Artificial Sequence
  Description of Artificial Sequence: Synthetic peptide
DEEEVRTTNPVAGEQYGCVSTNLNPGNR

SEQ ID NO: 24235 - protein, 28 aa, Artificial Sequence
  Description of Artificial Sequence: Synthetic peptide
NEEEIRTTNPVCTEGYGSVSTNLQHGNC

SEQ ID NO: 24236 - protein, 28 aa, Artificial Sequence
  Description of Artificial Sequence: Synthetic peptide
AENEIRTTNPFATEQYGSVSTNLQRGED

SEQ ID NO: 24237 - protein, 31 aa, Artificial Sequence
  Description of Artificial Sequence: Synthetic polypeptide
DEEEIRTTNPVATEQYGSVSATNLQEVNGNE

SEQ ID NO: 24238 - protein, 28 aa, Artificial Sequence
  Description of Artificial Sequence: Synthetic peptide
QEQEIRTTNPVATECYGSVSMNLQRGNC

SEQ ID NO: 24239 - protein, 28 aa, Artificial Sequence
  Description of Artificial Sequence: Synthetic peptide
DEEEIETTNIVALLQYGSVSTNLQNGNR

SEQ ID NO: 24240 - protein, 29 aa, Artificial Sequence
  Description of Artificial Sequence: Synthetic peptide
DEEEIRTTNPTATEQYGGVATNLQRGEND

SEQ ID NO: 24241 - protein, 30 aa, Artificial Sequence
  Description of Artificial Sequence: Synthetic polypeptide
DEEEIRTTNPFAYEQYGSSVSDTPLQRGNR

SEQ ID NO: 24242 - protein, 28 aa, Artificial Sequence
  Description of Artificial Sequence: Synthetic peptide
DEEEIRTVNIVATEQYGCTATNLQRGNR

SEQ ID NO: 24243 - protein, 28 aa, Artificial Sequence
  Description of Artificial Sequence: Synthetic peptide
DEEEIRTCNPVATEQYGSVSTRLQRNQE

SEQ ID NO: 24244 - protein, 28 aa, Artificial Sequence
  Description of Artificial Sequence: Synthetic peptide
DNEEISTTNPVATTQYGSVSTNPMRGNR

SEQ ID NO: 24245 - protein, 28 aa, Artificial Sequence
  Description of Artificial Sequence: Synthetic peptide
DEEEIRTTNPFATEQYGSVSTDLQVGEM

SEQ ID NO: 24246 - protein, 28 aa, Artificial Sequence
  Description of Artificial Sequence: Synthetic peptide
DEEEIRTTNPDATEQYGSVSTPLEFGNL

SEQ ID NO: 24247 - protein, 28 aa, Artificial Sequence
  Description of Artificial Sequence: Synthetic peptide
DEQEIRTTNPVATEQYGDVDTNLQHGNA

SEQ ID NO: 24248 - protein, 28 aa, Artificial Sequence
  Description of Artificial Sequence: Synthetic peptide
SEEEISTTNPVATEQWGSVSTNLQTGDR

SEQ ID NO: 24249 - protein, 31 aa, Artificial Sequence
  Description of Artificial Sequence: Synthetic polypeptide
DEEEIRTTNPVATEQYGSVDCTMDLQCRGNR

SEQ ID NO: 24250 - protein, 29 aa, Artificial Sequence
  Description of Artificial Sequence: Synthetic peptide
DEEEIATTNPVATECYGSVSTDLEDRGNR

SEQ ID NO: 24251 - protein, 28 aa, Artificial Sequence
  Description of Artificial Sequence: Synthetic peptide
DENEIRTTNIVATEQYGEVSTNLQRGEF

SEQ ID NO: 24252 - protein, 28 aa, Artificial Sequence
  Description of Artificial Sequence: Synthetic peptide
DEHEIRTTNPVCTEQYGSASTNEQHGNR

SEQ ID NO: 24253 - protein, 30 aa, Artificial Sequence
  Description of Artificial Sequence: Synthetic polypeptide
HEEEIRTTNPFATEQYGSVASTNLQREGND

SEQ ID NO: 24254 - protein, 28 aa, Artificial Sequence
  Description of Artificial Sequence: Synthetic peptide
DEVEIRTTNPVATELYGSVSENLQQGNF

SEQ ID NO: 24255 - protein, 28 aa, Artificial Sequence
  Description of Artificial Sequence: Synthetic peptide
DEEEIRPTNPMATEQYGSISTNLQEPNR

SEQ ID NO: 24256 - protein, 28 aa, Artificial Sequence
  Description of Artificial Sequence: Synthetic peptide
DEQEIRCTNPVATEVYGGVSTNLQRPNR

SEQ ID NO: 24257 - protein, 28 aa, Artificial Sequence
  Description of Artificial Sequence: Synthetic peptide
DEEEIRTTNPVATEQYGSVNESLYRGLR

SEQ ID NO: 24258 - protein, 28 aa, Artificial Sequence
  Description of Artificial Sequence: Synthetic peptide
DEEEIRTTNPVATEQYGSVETDLERDNW

SEQ ID NO: 24259 - protein, 28 aa, Artificial Sequence
  Description of Artificial Sequence: Synthetic peptide
DEEEIRTTNIVATECYGSVSTNDQRGDF

SEQ ID NO: 24260 - protein, 29 aa, Artificial Sequence
  Description of Artificial Sequence: Synthetic peptide
DEEEIRTTNPVATEQYGSVSTNLEDGEEQ

SEQ ID NO: 24261 - protein, 30 aa, Artificial Sequence
  Description of Artificial Sequence: Synthetic polypeptide
DEEEIRTTNPVAFEQYGFVSDTNLQRYGSR

SEQ ID NO: 24262 - protein, 28 aa, Artificial Sequence
  Description of Artificial Sequence: Synthetic peptide
DEHEIRTVNPVATEMYGEVSTNLQRQNR

SEQ ID NO: 24263 - protein, 29 aa, Artificial Sequence
  Description of Artificial Sequence: Synthetic peptide
KEEEIRTTNPVATECYGSVSTDLQREGNN

SEQ ID NO: 24264 - protein, 28 aa, Artificial Sequence
  Description of Artificial Sequence: Synthetic peptide
MENEIRTTNPVATECYGSVSTDLQRGNL

SEQ ID NO: 24265 - protein, 28 aa, Artificial Sequence
  Description of Artificial Sequence: Synthetic peptide
DEEEIRTTNPVATEQYGSVSTALFFGEF

SEQ ID NO: 24266 - protein, 32 aa, Artificial Sequence
  Description of Artificial Sequence: Synthetic polypeptide
DEEEIRTTNPVATEQYGSVDSTINGLQYDGNR

SEQ ID NO: 24267 - protein, 32 aa, Artificial Sequence
  Description of Artificial Sequence: Synthetic polypeptide
DEEEIRTTNPVATEQYGSVSSATCNLQPGQNR

SEQ ID NO: 24268 - protein, 28 aa, Artificial Sequence
  Description of Artificial Sequence: Synthetic peptide
DEEEIRTTNPVATECYGSVSTNDDDGER

SEQ ID NO: 24269 - protein, 28 aa, Artificial Sequence
  Description of Artificial Sequence: Synthetic peptide
DEEEIRTVNPVASEQYGSVSNNLQRGTQ

SEQ ID NO: 24270 - protein, 28 aa, Artificial Sequence
  Description of Artificial Sequence: Synthetic peptide
DENEIRTTNPVSSECYGSCSTNLQRGNR

SEQ ID NO: 24271 - protein, 31 aa, Artificial Sequence
  Description of Artificial Sequence: Synthetic polypeptide
DEEEIRTTNPVATEQYWSVSTPNPLQRGDER

SEQ ID NO: 24272 - protein, 29 aa, Artificial Sequence
  Description of Artificial Sequence: Synthetic peptide
DEEEIRTTNPVATECYGIVATCELQRGNR

SEQ ID NO: 24273 - protein, 31 aa, Artificial Sequence
  Description of Artificial Sequence: Synthetic polypeptide
DEEEIRTTNPVCTEQYGSVSCENLQCRGNDR

SEQ ID NO: 24274 - protein, 28 aa, Artificial Sequence
  Description of Artificial Sequence: Synthetic peptide
DEEEIRCTNPVAVEQYGSVATNLDRGER

SEQ ID NO: 24275 - protein, 28 aa, Artificial Sequence
  Description of Artificial Sequence: Synthetic peptide
DEEEISTVNPVATELYGSVSSNLQWGNR

SEQ ID NO: 24276 - protein, 28 aa, Artificial Sequence
  Description of Artificial Sequence: Synthetic peptide
AEEEIRQTNPVATEQYGTVSTPQQRGNR

SEQ ID NO: 24277 - protein, 28 aa, Artificial Sequence
  Description of Artificial Sequence: Synthetic peptide
DEEEIRCTNPDATENYGSVSTNLEHGNR

SEQ ID NO: 24278 - protein, 28 aa, Artificial Sequence
  Description of Artificial Sequence: Synthetic peptide
QEEEIGTTNPVATEQYGWASDNLQRGNR

SEQ ID NO: 24279 - protein, 28 aa, Artificial Sequence
  Description of Artificial Sequence: Synthetic peptide
DEEEISTTNPVATEQYGGVSTNLETGNQ

SEQ ID NO: 24280 - protein, 28 aa, Artificial Sequence
  Description of Artificial Sequence: Synthetic peptide
YEVEIRTTNPVATEQYGSVAENEQRGNR

SEQ ID NO: 24281 - protein, 30 aa, Artificial Sequence
  Description of Artificial Sequence: Synthetic polypeptide
DEEEIRTTNPVCTECFGSVSTNLQFREGNR

SEQ ID NO: 24282 - protein, 30 aa, Artificial Sequence
  Description of Artificial Sequence: Synthetic polypeptide
DEEEIRTTNPVATEQYGSVSTTNLEDEGNL

SEQ ID NO: 24283 - protein, 28 aa, Artificial Sequence
  Description of Artificial Sequence: Synthetic peptide
DENEIRCTNPVATEQYGWIATNLQRGNR

SEQ ID NO: 24284 - protein, 30 aa, Artificial Sequence
  Description of Artificial Sequence: Synthetic polypeptide
DEEEIRTTNPVATEQYGSVSCENLQQGNDL

SEQ ID NO: 24285 - protein, 28 aa, Artificial Sequence
  Description of Artificial Sequence: Synthetic peptide
DEEEIRTTNIVATEQYGSVSTDLQIGEI

SEQ ID NO: 24286 - protein, 28 aa, Artificial Sequence
  Description of Artificial Sequence: Synthetic peptide
DEVEIRTTNPTATEQYGGVSTNLQQGTR

SEQ ID NO: 24287 - protein, 30 aa, Artificial Sequence
  Description of Artificial Sequence: Synthetic polypeptide
DEEEIRTTNPEATEQYGSVSTINDQRKGNN

SEQ ID NO: 24288 - protein, 28 aa, Artificial Sequence
  Description of Artificial Sequence: Synthetic peptide
DEEEVCTTNPCATELYGSVSTNLQRGER

SEQ ID NO: 24289 - protein, 29 aa, Artificial Sequence
  Description of Artificial Sequence: Synthetic peptide
DEEEIRTTNPVATEQYGVVSTELQDNGNY

SEQ ID NO: 24290 - protein, 28 aa, Artificial Sequence
  Description of Artificial Sequence: Synthetic peptide
DEEEIRTVNPVATELYGSTSTNLQMGER

SEQ ID NO: 24291 - protein, 30 aa, Artificial Sequence
  Description of Artificial Sequence: Synthetic polypeptide
DEEEIRTTNPIATEVYGSVMSTANLSRGNR

SEQ ID NO: 24292 - protein, 29 aa, Artificial Sequence
  Description of Artificial Sequence: Synthetic peptide
DEEEIRTTNPVATEQYGSVESTEDQYGDR

SEQ ID NO: 24293 - protein, 30 aa, Artificial Sequence
  Description of Artificial Sequence: Synthetic polypeptide
DEEEIRQTNPVATEQYGSVDETGLQRGENR

SEQ ID NO: 24294 - protein, 30 aa, Artificial Sequence
  Description of Artificial Sequence: Synthetic polypeptide
DDEEIRTTNPVATEQYGSVSTMNIQRFGNL

SEQ ID NO: 24295 - protein, 28 aa, Artificial Sequence
  Description of Artificial Sequence: Synthetic peptide
DEEEIVTTNPVATEQYGDVSTNLMRGQQ

SEQ ID NO: 24296 - protein, 31 aa, Artificial Sequence
  Description of Artificial Sequence: Synthetic polypeptide
DEEEIRTTNPVAWTQYGSVVSSTNLQRLGNR

SEQ ID NO: 24297 - protein, 28 aa, Artificial Sequence
  Description of Artificial Sequence: Synthetic peptide
DEEEIRTTNPVATEQYGSVSDCGQPGNW

SEQ ID NO: 24298 - protein, 31 aa, Artificial Sequence
  Description of Artificial Sequence: Synthetic polypeptide
DEEEIRSTNPVATEQYGSVSTNGLQFRLDNR

SEQ ID NO: 24299 - protein, 30 aa, Artificial Sequence
  Description of Artificial Sequence: Synthetic polypeptide
DESEHIRTTNNVATEQYGESVSTNLQRGSR

SEQ ID NO: 24300 - protein, 28 aa, Artificial Sequence
  Description of Artificial Sequence: Synthetic peptide
DEEEIRQTNPVATEMYGTVANNLQRGNR

SEQ ID NO: 24301 - protein, 28 aa, Artificial Sequence
  Description of Artificial Sequence: Synthetic peptide
NTEEIRTTNPVAYEQYGSVSHNLQRGLR

SEQ ID NO: 24302 - protein, 32 aa, Artificial Sequence
  Description of Artificial Sequence: Synthetic polypeptide
DEEEIRTTNPVATEQYGSVGSTLPLQSRNGNR

SEQ ID NO: 24303 - protein, 32 aa, Artificial Sequence
  Description of Artificial Sequence: Synthetic polypeptide
DEEEIRTTNPVATEQYGSVSTNLQEREGPNQH

SEQ ID NO: 24304 - protein, 28 aa, Artificial Sequence
  Description of Artificial Sequence: Synthetic peptide
DEEEIGTTNITATEQYGSVSTNEQIGNR

SEQ ID NO: 24305 - protein, 29 aa, Artificial Sequence
  Description of Artificial Sequence: Synthetic peptide
DEEEIRTTNPTATEQYGSVSTNEQQGDNF

SEQ ID NO: 24306 - protein, 31 aa, Artificial Sequence
  Description of Artificial Sequence: Synthetic polypeptide
DEEEIRTTNPVATEQYGSVSDTNLERKGENM

SEQ ID NO: 24307 - protein, 28 aa, Artificial Sequence
  Description of Artificial Sequence: Synthetic peptide
DEQEIRTTNPEATEQYGSVSTNDQVGER

SEQ ID NO: 24308 - protein, 29 aa, Artificial Sequence
  Description of Artificial Sequence: Synthetic peptide
DEEEIATTNPVATEQYGSVSTNLQEQGEM

SEQ ID NO: 24309 - protein, 31 aa, Artificial Sequence
  Description of Artificial Sequence: Synthetic polypeptide
DEEEIRTTNPVATEQYGSVSTANPQERGNTN

SEQ ID NO: 24310 - protein, 31 aa, Artificial Sequence
  Description of Artificial Sequence: Synthetic polypeptide
DEEEIRTTNPVSTECYGSVSTNLQRAGENDR

SEQ ID NO: 24311 - protein, 28 aa, Artificial Sequence
  Description of Artificial Sequence: Synthetic peptide
DENEIRTTNPVATELYGSVSTNLMQGNF

SEQ ID NO: 24312 - protein, 28 aa, Artificial Sequence
  Description of Artificial Sequence: Synthetic peptide
DEEEIRTTNPVATEQYGSVETDEQRGEE

SEQ ID NO: 24313 - protein, 29 aa, Artificial Sequence
  Description of Artificial Sequence: Synthetic peptide
DEDEIRTTNPVAWEQYGSVSTNLQDRGDS

SEQ ID NO: 24314 - protein, 30 aa, Artificial Sequence
  Description of Artificial Sequence: Synthetic polypeptide
DEEEIRTTNPVATFQYGSVSTMTDQRGNHR

SEQ ID NO: 24315 - protein, 28 aa, Artificial Sequence
  Description of Artificial Sequence: Synthetic peptide
DEEEIRTTNPDATEQYGSVSTPLDDGNF

SEQ ID NO: 24316 - protein, 31 aa, Artificial Sequence
  Description of Artificial Sequence: Synthetic polypeptide
DEEEIRTTNPVATEQYGSVSETNLEERGEND

SEQ ID NO: 24317 - protein, 31 aa, Artificial Sequence
  Description of Artificial Sequence: Synthetic polypeptide
DEEEIRTTNPVATEQYGSVESTNLEIQGNER

SEQ ID NO: 24318 - protein, 29 aa, Artificial Sequence
  Description of Artificial Sequence: Synthetic peptide
DEEEIRPTNPVATECYGSVSTNLFDGDNR

SEQ ID NO: 24319 - protein, 28 aa, Artificial Sequence
  Description of Artificial Sequence: Synthetic peptide
DEEEIRTTNPAATETYGSVSTNLQTGDF

SEQ ID NO: 24320 - protein, 28 aa, Artificial Sequence
  Description of Artificial Sequence: Synthetic peptide
DEEEIRTTNPVATEQYGSVETNLDAGEQ

SEQ ID NO: 24321 - protein, 28 aa, Artificial Sequence
  Description of Artificial Sequence: Synthetic peptide
FEEEIRTTNPVATEQYGWVSTELQRGTL

SEQ ID NO: 24322 - protein, 31 aa, Artificial Sequence
  Description of Artificial Sequence: Synthetic polypeptide
DEEEIRATNPVATEQYGSVDSTMNLPQTGNR

SEQ ID NO: 24323 - protein, 33 aa, Artificial Sequence
  Description of Artificial Sequence: Synthetic polypeptide
DEEEIRTTNPVATEQYGSYVSVTMNNLQRGTNR

SEQ ID NO: 24324 - protein, 32 aa, Artificial Sequence
  Description of Artificial Sequence: Synthetic polypeptide
DEEEIRTTNPVATEQYGSVSETNLEDREGDNR

SEQ ID NO: 24325 - protein, 28 aa, Artificial Sequence
  Description of Artificial Sequence: Synthetic peptide
DEEIIRTTNIVATEQYGSVSTNLERGQT

SEQ ID NO: 24326 - protein, 29 aa, Artificial Sequence
  Description of Artificial Sequence: Synthetic peptide
DEQEIATTNPVATEQYGEVSADNLQRGNR

SEQ ID NO: 24327 - protein, 28 aa, Artificial Sequence
  Description of Artificial Sequence: Synthetic peptide
DEFVIRTTNPVATEQYGCVETNPQRGNR

SEQ ID NO: 24328 - protein, 28 aa, Artificial Sequence
  Description of Artificial Sequence: Synthetic peptide
DEEEIRTTNPVATEQYGSVETNLCHGDS

SEQ ID NO: 24329 - protein, 28 aa, Artificial Sequence
  Description of Artificial Sequence: Synthetic peptide
DEETIRTTNPDATEQYGSVSTPLDRGER

SEQ ID NO: 24330 - protein, 28 aa, Artificial Sequence
  Description of Artificial Sequence: Synthetic peptide
QEQEIVTTNPVATEQYGIVSENLQRGNR

SEQ ID NO: 24331 - protein, 28 aa, Artificial Sequence
  Description of Artificial Sequence: Synthetic peptide
DEEEIRTTNIVATEQYGSVSLQLQRNNC

SEQ ID NO: 24332 - protein, 31 aa, Artificial Sequence
  Description of Artificial Sequence: Synthetic polypeptide
DEEEIRTTNPFATEQYGSVSVTDGLQRGDNR

SEQ ID NO: 24333 - protein, 28 aa, Artificial Sequence
  Description of Artificial Sequence: Synthetic peptide
DEEEIATVNPVATEQYGSVSEDLQIGNR

SEQ ID NO: 24334 - protein, 28 aa, Artificial Sequence
  Description of Artificial Sequence: Synthetic peptide
NEEECKTTNSVATEQYGSVSSNLQRGNR

SEQ ID NO: 24335 - protein, 28 aa, Artificial Sequence
  Description of Artificial Sequence: Synthetic peptide
SEEEIATTNIVATEQYGSASTNLQHGNR

SEQ ID NO: 24336 - protein, 28 aa, Artificial Sequence
  Description of Artificial Sequence: Synthetic peptide
DEEEIRTTNPVATEQYGSVSTNGFGGPW

SEQ ID NO: 24337 - protein, 29 aa, Artificial Sequence
  Description of Artificial Sequence: Synthetic peptide
DEEMIRTTNPVATEQYGSVDSGLVQRGNR

SEQ ID NO: 24338 - protein, 28 aa, Artificial Sequence
  Description of Artificial Sequence: Synthetic peptide
DEEEIRTTNPDATEQYGSVSTPLDDGND

SEQ ID NO: 24339 - protein, 29 aa, Artificial Sequence
  Description of Artificial Sequence: Synthetic peptide
DEEEIRCTNPCATELYGSVSTNLQLQGNR

SEQ ID NO: 24340 - protein, 28 aa, Artificial Sequence
  Description of Artificial Sequence: Synthetic peptide
SEEEIRTTNCVATECYGSVSTNLTRGNY

SEQ ID NO: 24341 - protein, 28 aa, Artificial Sequence
  Description of Artificial Sequence: Synthetic peptide
DEEEIRTTNPVATEQYGSVSTDLEMGEG

SEQ ID NO: 24342 - protein, 29 aa, Artificial Sequence
  Description of Artificial Sequence: Synthetic peptide
DEEEIRTTNPVATEQYGDASTDLQHQGNR

SEQ ID NO: 24343 - protein, 31 aa, Artificial Sequence
  Description of Artificial Sequence: Synthetic polypeptide
DEEEIRTTNPTATEQYGSVSTCNLQERGNDI

SEQ ID NO: 24344 - protein, 28 aa, Artificial Sequence
  Description of Artificial Sequence: Synthetic peptide
DEEEIRTTNPVATEQYGSVETNLDAGEW

SEQ ID NO: 24345 - protein, 30 aa, Artificial Sequence
  Description of Artificial Sequence: Synthetic polypeptide
DEEEIRTTNPVATEQYGSVSCENLQCQGNI

SEQ ID NO: 24346 - protein, 28 aa, Artificial Sequence
  Description of Artificial Sequence: Synthetic peptide
DEEEIVSTNPVATEQYGFVSDNLQYGNR

SEQ ID NO: 24347 - protein, 29 aa, Artificial Sequence
  Description of Artificial Sequence: Synthetic peptide
DEEEIRTTNPVATENYGWVSCQLQRAGNR

SEQ ID NO: 24348 - protein, 28 aa, Artificial Sequence
  Description of Artificial Sequence: Synthetic peptide
DEQEISTTNPVATDQYGSVSPNLQRGVR

SEQ ID NO: 24349 - protein, 30 aa, Artificial Sequence
  Description of Artificial Sequence: Synthetic polypeptide
DEEEIRTTNPVATEQYGSVDSETNLEDGNW

SEQ ID NO: 24350 - protein, 30 aa, Artificial Sequence
  Description of Artificial Sequence: Synthetic polypeptide
DEEEIRTTNPVATEQYGSVSTMNEPQQGNF

SEQ ID NO: 24351 - protein, 28 aa, Artificial Sequence
  Description of Artificial Sequence: Synthetic peptide
DEGEIRATNPVATEMYGSVSTDLQRGNT

SEQ ID NO: 24352 - protein, 30 aa, Artificial Sequence
  Description of Artificial Sequence: Synthetic polypeptide
DEEEIRTVNPVSTEQYGSVSATNLQHAGNR

SEQ ID NO: 24353 - protein, 30 aa, Artificial Sequence
  Description of Artificial Sequence: Synthetic polypeptide
DEEEIRTTNPVATEQYGSVASTNPCHGNDR

SEQ ID NO: 24354 - protein, 28 aa, Artificial Sequence
  Description of Artificial Sequence: Synthetic peptide
YEEEIRTTNPVATEQYGSADTNLERGNI

SEQ ID NO: 24355 - protein, 28 aa, Artificial Sequence
  Description of Artificial Sequence: Synthetic peptide
QEEEIGTTNPVATEQYGIVSDVLQRGNR

SEQ ID NO: 24356 - protein, 28 aa, Artificial Sequence
  Description of Artificial Sequence: Synthetic peptide
MEEEIRTVNPVATEQYGSVATNLQLGDR

SEQ ID NO: 24357 - protein, 28 aa, Artificial Sequence
  Description of Artificial Sequence: Synthetic peptide
DEEEIVTTNPVSTEVYGSVSTNLQQGLR

SEQ ID NO: 24358 - protein, 28 aa, Artificial Sequence
  Description of Artificial Sequence: Synthetic peptide
DEQEIRATNPVATEHYGTVATNLQRGNR

SEQ ID NO: 24359 - protein, 28 aa, Artificial Sequence
  Description of Artificial Sequence: Synthetic peptide
DEEEVRATNPVATEIYGTVATNLQRGNR

SEQ ID NO: 24360 - protein, 30 aa, Artificial Sequence
  Description of Artificial Sequence: Synthetic polypeptide
GEEEIRTTNPVATEQYGSVSTNLQSEGEDR

SEQ ID NO: 24361 - protein, 29 aa, Artificial Sequence
  Description of Artificial Sequence: Synthetic peptide
DEEEIRTTNPCATYQYGWVATNLQRNGNR

SEQ ID NO: 24362 - protein, 28 aa, Artificial Sequence
  Description of Artificial Sequence: Synthetic peptide
DESEIRTVNPVASEVYGSVSTNLQRGTR

SEQ ID NO: 24363 - protein, 29 aa, Artificial Sequence
  Description of Artificial Sequence: Synthetic peptide
DEQEIRQTNPVATEQYGSVSTVLQRALNR

SEQ ID NO: 24364 - protein, 28 aa, Artificial Sequence
  Description of Artificial Sequence: Synthetic peptide
SEECIRATNPVATEMYGDVSTNLQRGNR

SEQ ID NO: 24365 - protein, 29 aa, Artificial Sequence
  Description of Artificial Sequence: Synthetic peptide
DEEEIRTTNPDATEQYGSVSTLGQRWGER

SEQ ID NO: 24366 - protein, 29 aa, Artificial Sequence
  Description of Artificial Sequence: Synthetic peptide
DEEEIRTTNPVATEQYGSVDTMNLCTGNC

SEQ ID NO: 24367 - protein, 28 aa, Artificial Sequence
  Description of Artificial Sequence: Synthetic peptide
DEQEVRTTNPCATEQYGCISTNLQRGNR

SEQ ID NO: 24368 - protein, 32 aa, Artificial Sequence
  Description of Artificial Sequence: Synthetic polypeptide
DEEEIRCTNPVATEQYGSVSTINLPQREGNWR

SEQ ID NO: 24369 - protein, 28 aa, Artificial Sequence
  Description of Artificial Sequence: Synthetic peptide
DEEEIRTTNIVATEMYGEASTNLQRGGR

SEQ ID NO: 24370 - protein, 29 aa, Artificial Sequence
  Description of Artificial Sequence: Synthetic peptide
DEQEIRTTNPVATELWGSVSTNLQWRGNF

SEQ ID NO: 24371 - protein, 31 aa, Artificial Sequence
  Description of Artificial Sequence: Synthetic polypeptide
DEEEIRTTNPEATEQYGSVSTENLQRKGEER

SEQ ID NO: 24372 - protein, 28 aa, Artificial Sequence
  Description of Artificial Sequence: Synthetic peptide
DEEEIRTTNPFATEGYGSVPTCLQRGNT

SEQ ID NO: 24373 - protein, 28 aa, Artificial Sequence
  Description of Artificial Sequence: Synthetic peptide
EEEEIRTTNPVATEQYGIVSENLQRGYM

SEQ ID NO: 24374 - protein, 32 aa, Artificial Sequence
  Description of Artificial Sequence: Synthetic polypeptide
DEEEIRTTNPVATEQYGSVSCTMNLQCHGNDR

SEQ ID NO: 24375 - protein, 29 aa, Artificial Sequence
  Description of Artificial Sequence: Synthetic peptide
DEEEIRTTNPVATEQYGSVETELEEGDNR

SEQ ID NO: 24376 - protein, 28 aa, Artificial Sequence
  Description of Artificial Sequence: Synthetic peptide
DEEEIRTTNPVATEQYGSVETNEQDGES

SEQ ID NO: 24377 - protein, 28 aa, Artificial Sequence
  Description of Artificial Sequence: Synthetic peptide
DEEEINTTNPVATECYGEVSTNLQRPPR

SEQ ID NO: 24378 - protein, 28 aa, Artificial Sequence
  Description of Artificial Sequence: Synthetic peptide
QEEEIRTTNPVATEQYGSVPTNCQHGQR

SEQ ID NO: 24379 - protein, 31 aa, Artificial Sequence
  Description of Artificial Sequence: Synthetic polypeptide
DEEEIRTTNPVATEQYGSVSTCNEQRGDNTQ

SEQ ID NO: 24380 - protein, 29 aa, Artificial Sequence
  Description of Artificial Sequence: Synthetic peptide
DEEEINTTNPVATEQYGSVSTNLQMNGEA

SEQ ID NO: 24381 - protein, 28 aa, Artificial Sequence
  Description of Artificial Sequence: Synthetic peptide
QEEEIRTVNPVATEVYGSVSTLLQRGNM

SEQ ID NO: 24382 - protein, 28 aa, Artificial Sequence
  Description of Artificial Sequence: Synthetic peptide
DEEEIRTTNPVATEQYGSWSTNLENGEQ

SEQ ID NO: 24383 - protein, 28 aa, Artificial Sequence
  Description of Artificial Sequence: Synthetic peptide
DEESIRTTNPVATQQYGVVSHNLDRGNR

SEQ ID NO: 24384 - protein, 28 aa, Artificial Sequence
  Description of Artificial Sequence: Synthetic peptide
DEEEIRTTNPDATEKYGSVSTNLQEGEP

SEQ ID NO: 24385 - protein, 28 aa, Artificial Sequence
  Description of Artificial Sequence: Synthetic peptide
DEEEIAQTNPVATEQYGSVSTPLERGNH

SEQ ID NO: 24386 - protein, 28 aa, Artificial Sequence
  Description of Artificial Sequence: Synthetic peptide
REEEIRATNPVASEQYGSVSNNDQRGNR

SEQ ID NO: 24387 - protein, 31 aa, Artificial Sequence
  Description of Artificial Sequence: Synthetic polypeptide
DEREIRTTNPVATEQYGSVSSTLNLQRVENR

SEQ ID NO: 24388 - protein, 28 aa, Artificial Sequence
  Description of Artificial Sequence: Synthetic peptide
CEEEIRCTNPVAHEQFGSVSMNLQRGNR

SEQ ID NO: 24389 - protein, 29 aa, Artificial Sequence
  Description of Artificial Sequence: Synthetic peptide
DEEEIRTTNPVATEQYGSVDTNEMWRGTR

SEQ ID NO: 24390 - protein, 30 aa, Artificial Sequence
  Description of Artificial Sequence: Synthetic polypeptide
DEEEIRTTNPTATEQYGSVSTMNLQNGDNS

SEQ ID NO: 24391 - protein, 28 aa, Artificial Sequence
  Description of Artificial Sequence: Synthetic peptide
DEEEIAQTNPVATEQYGEVSTNLMRGER

SEQ ID NO: 24392 - protein, 30 aa, Artificial Sequence
  Description of Artificial Sequence: Synthetic polypeptide
DEEEIRTTNPFATEQYGSVTSTNLDRMENR

SEQ ID NO: 24393 - protein, 28 aa, Artificial Sequence
  Description of Artificial Sequence: Synthetic peptide
DEHEIRTTNPCCTEQYGSVSEDLQRGNR

SEQ ID NO: 24394 - protein, 28 aa, Artificial Sequence
  Description of Artificial Sequence: Synthetic peptide
DEEEIRTTNPVAWEQYGSVYTNLVRGKY

SEQ ID NO: 24395 - protein, 31 aa, Artificial Sequence
  Description of Artificial Sequence: Synthetic polypeptide
DEEEIRTTNPVATENYGSVQSTTNHLQRGLR

SEQ ID NO: 24396 - protein, 29 aa, Artificial Sequence
  Description of Artificial Sequence: Synthetic peptide
DEEELRTTNPVATEQFGSVSNNLQPNGNR

SEQ ID NO: 24397 - protein, 28 aa, Artificial Sequence
  Description of Artificial Sequence: Synthetic peptide
DEEEIRTTNPVATEQYWSWSDNEFRGNR

SEQ ID NO: 24398 - protein, 29 aa, Artificial Sequence
  Description of Artificial Sequence: Synthetic peptide
DEEEVRTTNPVATEQYGVASTNLQSRGNL

SEQ ID NO: 24399 - protein, 28 aa, Artificial Sequence
  Description of Artificial Sequence: Synthetic peptide
DESEIRGVNPVATEQFGSVSTNLQRGNQ

SEQ ID NO: 24400 - protein, 28 aa, Artificial Sequence
  Description of Artificial Sequence: Synthetic peptide
DEEEIVTTNPAATEQYGSVSVNEQRGNH

SEQ ID NO: 24401 - protein, 28 aa, Artificial Sequence
  Description of Artificial Sequence: Synthetic peptide
WEEETRTTNPVATEIYGSVSTNLQIENR

SEQ ID NO: 24402 - protein, 28 aa, Artificial Sequence
  Description of Artificial Sequence: Synthetic peptide
DEEEIRTTNPVATEQYGSWSTNEMPGNP

SEQ ID NO: 24403 - protein, 28 aa, Artificial Sequence
  Description of Artificial Sequence: Synthetic peptide
DEECIRTTNPVATECYGSVSTGLQDGNP

SEQ ID NO: 24404 - protein, 29 aa, Artificial Sequence
  Description of Artificial Sequence: Synthetic peptide
DEEEIRTTNPVATSQYGSVNSTELDRGNE

SEQ ID NO: 24405 - protein, 28 aa, Artificial Sequence
  Description of Artificial Sequence: Synthetic peptide
DEEEIRCVNPVAYENYGAVSTNLQRGNR

SEQ ID NO: 24406 - protein, 30 aa, Artificial Sequence
  Description of Artificial Sequence: Synthetic polypeptide
DENEIRTTNPVATECYGSVSTNLQDRGNDM

SEQ ID NO: 24407 - protein, 28 aa, Artificial Sequence
  Description of Artificial Sequence: Synthetic peptide
DEEEVRCTNPVATEIYGCVSTNLERGNR

SEQ ID NO: 24408 - protein, 29 aa, Artificial Sequence
  Description of Artificial Sequence: Synthetic peptide
GEEEIRTVNPVATEQYGSVSTDLQYGNDR

SEQ ID NO: 24409 - protein, 28 aa, Artificial Sequence
  Description of Artificial Sequence: Synthetic peptide
DEEEIRPTNPVATQQYGSVFTNLDRGNN

SEQ ID NO: 24410 - protein, 28 aa, Artificial Sequence
  Description of Artificial Sequence: Synthetic peptide
DEMEIRTTNPVATQQYGCVSTNLERGNP

SEQ ID NO: 24411 - protein, 28 aa, Artificial Sequence
  Description of Artificial Sequence: Synthetic peptide
YDEEVRTTNPVATEVYGSVSTNLQQGNR

SEQ ID NO: 24412 - protein, 32 aa, Artificial Sequence
  Description of Artificial Sequence: Synthetic polypeptide
DEEEIRTTNPVATEQYGSVSTNLEEREGENDR

SEQ ID NO: 24413 - protein, 28 aa, Artificial Sequence
  Description of Artificial Sequence: Synthetic peptide
DEEEIRTTNPVATEQYGSVETDLQLGEI

SEQ ID NO: 24414 - protein, 29 aa, Artificial Sequence
  Description of Artificial Sequence: Synthetic peptide
DEEEIRTTNPEATEQYGSVSTELQIQGER

SEQ ID NO: 24415 - protein, 28 aa, Artificial Sequence
  Description of Artificial Sequence: Synthetic peptide
DEEEIRSVNPVATEHYGSVAMNLQRGNR

SEQ ID NO: 24416 - protein, 31 aa, Artificial Sequence
  Description of Artificial Sequence: Synthetic polypeptide
DEEEIRTTNPVATEQYGSHWHDTNPLQRGNR

SEQ ID NO: 24417 - protein, 28 aa, Artificial Sequence
  Description of Artificial Sequence: Synthetic peptide
STEEIRTTNPVATEQNGSVSENLQTGNR

SEQ ID NO: 24418 - protein, 29 aa, Artificial Sequence
  Description of Artificial Sequence: Synthetic peptide
DEEELRTTNPVATEGYGSVSDNLQRGAGR

SEQ ID NO: 24419 - protein, 30 aa, Artificial Sequence
  Description of Artificial Sequence: Synthetic polypeptide
DSEEIRTTNPFATEQYGSVSTMNPSQRGNR

SEQ ID NO: 24420 - protein, 29 aa, Artificial Sequence
  Description of Artificial Sequence: Synthetic peptide
QENEIRTTNPVATEQYGWVSADNLQRGNR

SEQ ID NO: 24421 - protein, 28 aa, Artificial Sequence
  Description of Artificial Sequence: Synthetic peptide
DEEEIRTTNPVAYEVYGVVASNLQRGNR

SEQ ID NO: 24422 - protein, 31 aa, Artificial Sequence
  Description of Artificial Sequence: Synthetic polypeptide
DEEEIRTTNPVATEQWGSVSTLNLQDRGMNS

SEQ ID NO: 24423 - protein, 28 aa, Artificial Sequence
  Description of Artificial Sequence: Synthetic peptide
DEEEIRTTNIVASEEYGSVSTNLDRLNR

SEQ ID NO: 24424 - protein, 28 aa, Artificial Sequence
  Description of Artificial Sequence: Synthetic peptide
DENELRATNPVATEQYGSVGTNLQRGTR

SEQ ID NO: 24425 - protein, 29 aa, Artificial Sequence
  Description of Artificial Sequence: Synthetic peptide
DEEEIRTTNPVATEQYGDVSTCLQVAGER

SEQ ID NO: 24426 - protein, 29 aa, Artificial Sequence
  Description of Artificial Sequence: Synthetic peptide
DEQEIRTTNPVATEQYGWVSTDLQREGNN

SEQ ID NO: 24427 - protein, 31 aa, Artificial Sequence
  Description of Artificial Sequence: Synthetic polypeptide
DEEEIRTTNPVATEQYGSVDCTCNLERGENR

SEQ ID NO: 24428 - protein, 28 aa, Artificial Sequence
  Description of Artificial Sequence: Synthetic peptide
DEEEIRATNPVATEQWGGTSTNWQRGNR

SEQ ID NO: 24429 - protein, 28 aa, Artificial Sequence
  Description of Artificial Sequence: Synthetic peptide
DEEEIRTTNPVATEQYGSWSTELQREEN

SEQ ID NO: 24430 - protein, 31 aa, Artificial Sequence
  Description of Artificial Sequence: Synthetic polypeptide
DEEEIRTTNPVATEQYGSVWSDTNLQYIGNF

SEQ ID NO: 24431 - protein, 28 aa, Artificial Sequence
  Description of Artificial Sequence: Synthetic peptide
DENEIRTTNIVATECYGDVSENLQRGNR

SEQ ID NO: 24432 - protein, 28 aa, Artificial Sequence
  Description of Artificial Sequence: Synthetic peptide
DEEEITTTNPVATEQYGSCSTRLQKGNT

SEQ ID NO: 24433 - protein, 28 aa, Artificial Sequence
  Description of Artificial Sequence: Synthetic peptide
DEEEIRTTNPCATEQYGAVSSNLCRGNV

SEQ ID NO: 24434 - protein, 28 aa, Artificial Sequence
  Description of Artificial Sequence: Synthetic peptide
DEVEIRTTNPTATEQYGSVSTNEQNGNF

SEQ ID NO: 24435 - protein, 28 aa, Artificial Sequence
  Description of Artificial Sequence: Synthetic peptide
DEEEIRTTNPVATEQYGSVDTDDERGER

SEQ ID NO: 24436 - protein, 31 aa, Artificial Sequence
  Description of Artificial Sequence: Synthetic polypeptide
DEEEIRTTNPVATEQYGSVEDTLPLQRGDNR

SEQ ID NO: 24437 - protein, 28 aa, Artificial Sequence
  Description of Artificial Sequence: Synthetic peptide
QEVEIRTTNPVATENYGDVSTNLQRGQR

SEQ ID NO: 24438 - protein, 28 aa, Artificial Sequence
  Description of Artificial Sequence: Synthetic peptide
DEEEIRTTNPAATEQYGTVSTNLQNGDE

SEQ ID NO: 24439 - protein, 28 aa, Artificial Sequence
  Description of Artificial Sequence: Synthetic peptide
DESETRTTNPVATAQYGSVSTDLQRGNE

SEQ ID NO: 24440 - protein, 31 aa, Artificial Sequence
  Description of Artificial Sequence: Synthetic polypeptide
DHEEIRTTNPVATEQYGSVHSTNLPQEDGNR

SEQ ID NO: 24441 - protein, 28 aa, Artificial Sequence
  Description of Artificial Sequence: Synthetic peptide
DEEEIRSTNPVATFQYGSVSSNWQRGNP

SEQ ID NO: 24442 - protein, 29 aa, Artificial Sequence
  Description of Artificial Sequence: Synthetic peptide
DEEEIRTTNPVATEQYGSVDTYGQELGNR

SEQ ID NO: 24443 - protein, 28 aa, Artificial Sequence
  Description of Artificial Sequence: Synthetic peptide
DEDEIRATNPVATEMYGTVATNLQRGNR

SEQ ID NO: 24444 - protein, 28 aa, Artificial Sequence
  Description of Artificial Sequence: Synthetic peptide
DEQEIRCTNPVASEIYGSVSTNLERGNR

SEQ ID NO: 24445 - protein, 31 aa, Artificial Sequence
  Description of Artificial Sequence: Synthetic polypeptide
DEEEIRTTNPVATEQYGSWTDTNLVQRDGNR

SEQ ID NO: 24446 - protein, 28 aa, Artificial Sequence
  Description of Artificial Sequence: Synthetic peptide
DEEEINTTNPVATEMYGGVSTNLQIGNS

SEQ ID NO: 24447 - protein, 28 aa, Artificial Sequence
  Description of Artificial Sequence: Synthetic peptide
DEEEVRTTNPCATEQYGVVSTNGQCGNR

SEQ ID NO: 24448 - protein, 28 aa, Artificial Sequence
  Description of Artificial Sequence: Synthetic peptide
DEEEIRTTNPFATEQYGSVSECLQREER

SEQ ID NO: 24449 - protein, 28 aa, Artificial Sequence
  Description of Artificial Sequence: Synthetic peptide
DCTEIRTTNPCSTEQYGSVSENLQRGNR

SEQ ID NO: 24450 - protein, 28 aa, Artificial Sequence
  Description of Artificial Sequence: Synthetic peptide
DEVEIATTNPVATIQYGMVSTALQRGNR

SEQ ID NO: 24451 - protein, 28 aa, Artificial Sequence
  Description of Artificial Sequence: Synthetic peptide
DEEYIRTTNPDATEQYGFVSTPLQRENR

SEQ ID NO: 24452 - protein, 29 aa, Artificial Sequence
  Description of Artificial Sequence: Synthetic peptide
DEEEIRTTNPVATEQYGSVPTCEQRGNDQ

SEQ ID NO: 24453 - protein, 28 aa, Artificial Sequence
  Description of Artificial Sequence: Synthetic peptide
KEEEIRTTNPVATEQYGVVSTNLCTGNQ

SEQ ID NO: 24454 - protein, 30 aa, Artificial Sequence
  Description of Artificial Sequence: Synthetic polypeptide
DEEEIRTTNPEATEQYGSVACTALQIRGNR

SEQ ID NO: 24455 - protein, 28 aa, Artificial Sequence
  Description of Artificial Sequence: Synthetic peptide
DEQEIRTTNPVATEQYGSVSTEDQEGER

SEQ ID NO: 24456 - protein, 28 aa, Artificial Sequence
  Description of Artificial Sequence: Synthetic peptide
NEESIRTTNPVATEQFGSVSPNLQRGTR

SEQ ID NO: 24457 - protein, 29 aa, Artificial Sequence
  Description of Artificial Sequence: Synthetic peptide
VEEEIRTTNPVGTEQYGSVSMNLVQRGAR

SEQ ID NO: 24458 - protein, 28 aa, Artificial Sequence
  Description of Artificial Sequence: Synthetic peptide
AEEEIRTTNPDATEQYGSVSTDLERGER

SEQ ID NO: 24459 - protein, 31 aa, Artificial Sequence
  Description of Artificial Sequence: Synthetic polypeptide
DEEEIRTTNPVATEQYGSVSTNPLVWIAGNR

SEQ ID NO: 24460 - protein, 29 aa, Artificial Sequence
  Description of Artificial Sequence: Synthetic peptide
DEEEIRTTNPVAIEQYGHVVTNLTQRGDR

SEQ ID NO: 24461 - protein, 29 aa, Artificial Sequence
  Description of Artificial Sequence: Synthetic peptide
QEEEIRQTNPVATEQYGEVSAENLQRGNR

SEQ ID NO: 24462 - protein, 30 aa, Artificial Sequence
  Description of Artificial Sequence: Synthetic polypeptide
DEVEIRTTNPVATEQYGSVSTMNLQIGDNE

SEQ ID NO: 24463 - protein, 31 aa, Artificial Sequence
  Description of Artificial Sequence: Synthetic polypeptide
DEEEIRTTNPVATEQYGSVSETNDQDHGNER

SEQ ID NO: 24464 - protein, 28 aa, Artificial Sequence
  Description of Artificial Sequence: Synthetic peptide
FEEEIACTNPVATELYGSVGTNLQRGNR

SEQ ID NO: 24465 - protein, 28 aa, Artificial Sequence
  Description of Artificial Sequence: Synthetic peptide
DEEEIRTTNPVCTELYGYVSTNGQTGNR

SEQ ID NO: 24466 - protein, 28 aa, Artificial Sequence
  Description of Artificial Sequence: Synthetic peptide
DEEEIRTTNPDATEQYGSVSTDDQRGDV

SEQ ID NO: 24467 - protein, 28 aa, Artificial Sequence
  Description of Artificial Sequence: Synthetic peptide
GEHEIRTTNPVATEQYGVVSTDLQRGNW

SEQ ID NO: 24468 - protein, 28 aa, Artificial Sequence
  Description of Artificial Sequence: Synthetic peptide
DEEEIVTTNPVATEQYGVVDTALQHGNR

SEQ ID NO: 24469 - protein, 31 aa, Artificial Sequence
  Description of Artificial Sequence: Synthetic polypeptide
DEEEIRTTNPVATEQYGHSVHQTNLQIRGNP

SEQ ID NO: 24470 - protein, 29 aa, Artificial Sequence
  Description of Artificial Sequence: Synthetic peptide
DEEEIATVNPVATEQFGSVSTPLQRGENR

SEQ ID NO: 24471 - protein, 28 aa, Artificial Sequence
  Description of Artificial Sequence: Synthetic peptide
DEEEIRTTNPVATEQCGSVSSGLQPGLR

SEQ ID NO: 24472 - protein, 28 aa, Artificial Sequence
  Description of Artificial Sequence: Synthetic peptide
DEEEIRTTNPDAVEQYGSVSSGLDRGNR

SEQ ID NO: 24473 - protein, 28 aa, Artificial Sequence
  Description of Artificial Sequence: Synthetic peptide
DEEEIRTTNPVATEQYGSVETNDEIENR

SEQ ID NO: 24474 - protein, 28 aa, Artificial Sequence
  Description of Artificial Sequence: Synthetic peptide
DEEEIRTTNISADEDYGSVSTNLQFGNR

SEQ ID NO: 24475 - protein, 30 aa, Artificial Sequence
  Description of Artificial Sequence: Synthetic polypeptide
DEEEIRTTNPVATEQYGSVSTNPQLLGDNV

SEQ ID NO: 24476 - protein, 30 aa, Artificial Sequence
  Description of Artificial Sequence: Synthetic polypeptide
SEEEIRTTNPFATEQYGSVSTPNLQRGDER

SEQ ID NO: 24477 - protein, 28 aa, Artificial Sequence
  Description of Artificial Sequence: Synthetic peptide
DEEEIRTTNPEATEQYGSVSTNDEIGER

SEQ ID NO: 24478 - protein, 29 aa, Artificial Sequence
  Description of Artificial Sequence: Synthetic peptide
HEEEIRTVNPVATEQYGSVGTGLQERGNR

SEQ ID NO: 24479 - protein, 30 aa, Artificial Sequence
  Description of Artificial Sequence: Synthetic polypeptide
DEEEIRTTNPVATEQYGSVGAENLQRFMNR

SEQ ID NO: 24480 - protein, 28 aa, Artificial Sequence
  Description of Artificial Sequence: Synthetic peptide
QEEEIRTTNPVATENYGSVSTVLMRENR

SEQ ID NO: 24481 - protein, 31 aa, Artificial Sequence
  Description of Artificial Sequence: Synthetic polypeptide
DEFEIRTTNPVATEQYGMSVSDTNLQRTGNW

SEQ ID NO: 24482 - protein, 31 aa, Artificial Sequence
  Description of Artificial Sequence: Synthetic polypeptide
DEEEIRTTNPFATEQYGSVSTLNLDLRGNPR

SEQ ID NO: 24483 - protein, 28 aa, Artificial Sequence
  Description of Artificial Sequence: Synthetic peptide
GEEEIRTTNPVATEIYGSVGTNLQRGDD

SEQ ID NO: 24484 - protein, 30 aa, Artificial Sequence
  Description of Artificial Sequence: Synthetic polypeptide
DEEEIRTTNPVATEQYGSVSTGLSVRGMNP

SEQ ID NO: 24485 - protein, 28 aa, Artificial Sequence
  Description of Artificial Sequence: Synthetic peptide
DEEEIRTTNPVATEQYGSVDTCGQRGDN

SEQ ID NO: 24486 - protein, 30 aa, Artificial Sequence
  Description of Artificial Sequence: Synthetic polypeptide
DEEEIRTTNPVATEQYGSVSTDLEDRGENE

SEQ ID NO: 24487 - protein, 30 aa, Artificial Sequence
  Description of Artificial Sequence: Synthetic polypeptide
DEEEIRTTNPVATEVYGSVSTALQCRGNDQ

SEQ ID NO: 24488 - protein, 30 aa, Artificial Sequence
  Description of Artificial Sequence: Synthetic polypeptide
DEQEIATTNPVATEQYGSVSCTNLQRGNDQ

SEQ ID NO: 24489 - protein, 28 aa, Artificial Sequence
  Description of Artificial Sequence: Synthetic peptide
DHEEIRTTNPVATEQYGSVSTNDQPLNE

SEQ ID NO: 24490 - protein, 30 aa, Artificial Sequence
  Description of Artificial Sequence: Synthetic polypeptide
DEEEIRTTNPVATEQYGSVSTEPLQINGNG

SEQ ID NO: 24491 - protein, 28 aa, Artificial Sequence
  Description of Artificial Sequence: Synthetic peptide
DEEEIRTTNPEATEQYGSVSTEEERGNF

SEQ ID NO: 24492 - protein, 28 aa, Artificial Sequence
  Description of Artificial Sequence: Synthetic peptide
DEEEIRTTNPEATEQYGSVETNLEIGNQ

SEQ ID NO: 24493 - protein, 28 aa, Artificial Sequence
  Description of Artificial Sequence: Synthetic peptide
DEEEIRATNPFATEQYGSVSTDDQVGNR

SEQ ID NO: 24494 - protein, 28 aa, Artificial Sequence
  Description of Artificial Sequence: Synthetic peptide
NDEEIRTTNPVATENYGSNSTNLQRGNE

SEQ ID NO: 24495 - protein, 28 aa, Artificial Sequence
  Description of Artificial Sequence: Synthetic peptide
DEEEISGTNPVATEQYGSVTDNLQRGER

SEQ ID NO: 24496 - protein, 28 aa, Artificial Sequence
  Description of Artificial Sequence: Synthetic peptide
DEEEIRATNPTSTEQYGSVSTNPQRENR

SEQ ID NO: 24497 - protein, 32 aa, Artificial Sequence
  Description of Artificial Sequence: Synthetic polypeptide
DEEEIRTTNPVATEQYGSVDSETNLQRGENDA

SEQ ID NO: 24498 - protein, 29 aa, Artificial Sequence
  Description of Artificial Sequence: Synthetic peptide
DEEEIRTTNPVATEMYGEVSTNDVQRGND

SEQ ID NO: 24499 - protein, 29 aa, Artificial Sequence
  Description of Artificial Sequence: Synthetic peptide
DEDEIRTTNPEATEQYGSVSTNEQGGENR

SEQ ID NO: 24500 - protein, 29 aa, Artificial Sequence
  Description of Artificial Sequence: Synthetic peptide
DEEEIRTTNPVATEQYGSVETDLQREDNN

SEQ ID NO: 24501 - protein, 28 aa, Artificial Sequence
  Description of Artificial Sequence: Synthetic peptide
DEEPIRTTNPVATEQHGSVVTNLQVGND

SEQ ID NO: 24502 - protein, 29 aa, Artificial Sequence
  Description of Artificial Sequence: Synthetic peptide
DEGEIRTTNPVATECYGSVSTGNLQQGNP

SEQ ID NO: 24503 - protein, 32 aa, Artificial Sequence
  Description of Artificial Sequence: Synthetic polypeptide
DEEEIRTTNPVATETYGSVISTINLQRGPNDR

SEQ ID NO: 24504 - protein, 29 aa, Artificial Sequence
  Description of Artificial Sequence: Synthetic peptide
DEEEIRTTNPVATEHYGSVSTNEQRLNWF

SEQ ID NO: 24505 - protein, 28 aa, Artificial Sequence
  Description of Artificial Sequence: Synthetic peptide
DDEEIRTVNPVATEQYGVVATNLERGNR

SEQ ID NO: 24506 - protein, 28 aa, Artificial Sequence
  Description of Artificial Sequence: Synthetic peptide
DEEEIRCTNPVSTEIYGCVGTNLQRGNR

SEQ ID NO: 24507 - protein, 28 aa, Artificial Sequence
  Description of Artificial Sequence: Synthetic peptide
DEEEIRTTNIVATNQYGSVHTNIQDGNR

SEQ ID NO: 24508 - protein, 28 aa, Artificial Sequence
  Description of Artificial Sequence: Synthetic peptide
DEEEIRATNCIATEGYGSVSTNIQRGNR

SEQ ID NO: 24509 - protein, 28 aa, Artificial Sequence
  Description of Artificial Sequence: Synthetic peptide
YENEIRTTNPVATEQYGSVATDLERGNR

SEQ ID NO: 24510 - protein, 28 aa, Artificial Sequence
  Description of Artificial Sequence: Synthetic peptide
DDQEIRCTNPVATEQYGCVSTNLERGNR

SEQ ID NO: 24511 - protein, 28 aa, Artificial Sequence
  Description of Artificial Sequence: Synthetic peptide
DEQEIRTTNPVATELYGSVSTNLMIGNF

SEQ ID NO: 24512 - protein, 28 aa, Artificial Sequence
  Description of Artificial Sequence: Synthetic peptide
DENEIVATNPVATEVYGWVSTNLQRGNR

SEQ ID NO: 24513 - protein, 32 aa, Artificial Sequence
  Description of Artificial Sequence: Synthetic polypeptide
DEEEIRTTNPVATEQYGSVESTNLCQMGENDR

SEQ ID NO: 24514 - protein, 30 aa, Artificial Sequence
  Description of Artificial Sequence: Synthetic polypeptide
DEEEIRTTNPDATEQYGSVSTPLQSRDDNR

SEQ ID NO: 24515 - protein, 28 aa, Artificial Sequence
  Description of Artificial Sequence: Synthetic peptide
DENEIYTTNPAATEMYGSVSTNLQRGNL

SEQ ID NO: 24516 - protein, 28 aa, Artificial Sequence
  Description of Artificial Sequence: Synthetic peptide
DEQEIVCTNPVATETYGWVSTNLQRGNR

SEQ ID NO: 24517 - protein, 28 aa, Artificial Sequence
  Description of Artificial Sequence: Synthetic peptide
DEEEIRTTNPCATYQYGTVSNNLQRPNR

SEQ ID NO: 24518 - protein, 30 aa, Artificial Sequence
  Description of Artificial Sequence: Synthetic polypeptide
DEEEIRTTNPEATEQYGTVSTDLQIRGVNR

SEQ ID NO: 24519 - protein, 28 aa, Artificial Sequence
  Description of Artificial Sequence: Synthetic peptide
AESEIRQTNPVATEMYGSVSTVLQRGNR

SEQ ID NO: 24520 - protein, 28 aa, Artificial Sequence
  Description of Artificial Sequence: Synthetic peptide
DEEEIRPTNPVATEQYWSVSTNPQDGER

SEQ ID NO: 24521 - protein, 30 aa, Artificial Sequence
  Description of Artificial Sequence: Synthetic polypeptide
DEEEIRTTNPVATEQYGSVSTNLQEDDGEN

SEQ ID NO: 24522 - protein, 28 aa, Artificial Sequence
  Description of Artificial Sequence: Synthetic peptide
DEQEIRTTNIVATEQYGSVSTDLERGER

SEQ ID NO: 24523 - protein, 29 aa, Artificial Sequence
  Description of Artificial Sequence: Synthetic peptide
YEEEIRTTNPVATEQYGSVSTTPLQDGNF

SEQ ID NO: 24524 - protein, 29 aa, Artificial Sequence
  Description of Artificial Sequence: Synthetic peptide
DEQEIRTTNPVATECYGSVSTNLEHGNDR

SEQ ID NO: 24525 - protein, 28 aa, Artificial Sequence
  Description of Artificial Sequence: Synthetic peptide
DEEEIRTVNPVATEQYGSMSTDLQFGNV

SEQ ID NO: 24526 - protein, 28 aa, Artificial Sequence
  Description of Artificial Sequence: Synthetic peptide
DEQEIRTTNIVATEQYGSVSENLQQGNL

SEQ ID NO: 24527 - protein, 28 aa, Artificial Sequence
  Description of Artificial Sequence: Synthetic peptide
DEEEIRTTNPDATQQYGSVSTNDDRGND

SEQ ID NO: 24528 - protein, 29 aa, Artificial Sequence
  Description of Artificial Sequence: Synthetic peptide
DEEEIRTTNPAATEQYGTVSTDGQERGNR

SEQ ID NO: 24529 - protein, 28 aa, Artificial Sequence
  Description of Artificial Sequence: Synthetic peptide
GEEEIRATNPVATEMYGSVSTELQLGNR

SEQ ID NO: 24530 - protein, 29 aa, Artificial Sequence
  Description of Artificial Sequence: Synthetic peptide
DEECIRTTNPVATEQWYGSVSTNLDPGER

SEQ ID NO: 24531 - protein, 28 aa, Artificial Sequence
  Description of Artificial Sequence: Synthetic peptide
DGGEIRTTNPVATEQYGNAMTNLQRGNR

SEQ ID NO: 24532 - protein, 30 aa, Artificial Sequence
  Description of Artificial Sequence: Synthetic polypeptide
DEEEIRTTNPVATEQYGSWSLPNMLQRDNR

SEQ ID NO: 24533 - protein, 32 aa, Artificial Sequence
  Description of Artificial Sequence: Synthetic polypeptide
NEEEIRTTNPVATEQYGSVSTENLQQLRGNDR

SEQ ID NO: 24534 - protein, 32 aa, Artificial Sequence
  Description of Artificial Sequence: Synthetic polypeptide
DEEEIRTTNPVATEQYGSVSTTAANPQLRGNR

SEQ ID NO: 24535 - protein, 28 aa, Artificial Sequence
  Description of Artificial Sequence: Synthetic peptide
QESEIRTTNPVATEQYGSVSYNLERGNM

SEQ ID NO: 24536 - protein, 30 aa, Artificial Sequence
  Description of Artificial Sequence: Synthetic polypeptide
GEEEIRTTNPVATEQYGSVNDNLQRIGNER

SEQ ID NO: 24537 - protein, 28 aa, Artificial Sequence
  Description of Artificial Sequence: Synthetic peptide
GEEEIRTTNPCATEVYGSVSNNLQRGTR

SEQ ID NO: 24538 - protein, 28 aa, Artificial Sequence
  Description of Artificial Sequence: Synthetic peptide
DEDEIATTNPVATEQYWSVSTNLQRGEN

SEQ ID NO: 24539 - protein, 29 aa, Artificial Sequence
  Description of Artificial Sequence: Synthetic peptide
DEEEIRTTNPVATEQFGSVSTDGLQNGDR

SEQ ID NO: 24540 - protein, 31 aa, Artificial Sequence
  Description of Artificial Sequence: Synthetic polypeptide
DEEEIATTNPVATEQYGSVISTMNLPQQGNR

SEQ ID NO: 24541 - protein, 30 aa, Artificial Sequence
  Description of Artificial Sequence: Synthetic polypeptide
DEEEIRTTNPVATECYGSVSTNLQDSGNDV

SEQ ID NO: 24542 - protein, 28 aa, Artificial Sequence
  Description of Artificial Sequence: Synthetic peptide
DEEEIRTTNPVATQQYGSVSTDDQNGNG

SEQ ID NO: 24543 - protein, 29 aa, Artificial Sequence
  Description of Artificial Sequence: Synthetic peptide
DENEIRQTNPVATEQYGDVPTNLQRGNDR

SEQ ID NO: 24544 - protein, 28 aa, Artificial Sequence
  Description of Artificial Sequence: Synthetic peptide
DENEIRTVNPVATEIYGTVATNLQRGNR

SEQ ID NO: 24545 - protein, 32 aa, Artificial Sequence
  Description of Artificial Sequence: Synthetic polypeptide
DEEEIRTTNPVATEQYGESVETNNLVQRGDNR

SEQ ID NO: 24546 - protein, 30 aa, Artificial Sequence
  Description of Artificial Sequence: Synthetic polypeptide
DEEEIRTTNPVATEQYGSVSTDLQDVGEDR

SEQ ID NO: 24547 - protein, 28 aa, Artificial Sequence
  Description of Artificial Sequence: Synthetic peptide
AENEITQTNPVATEQYGSVSTNLQYGNR

SEQ ID NO: 24548 - protein, 29 aa, Artificial Sequence
  Description of Artificial Sequence: Synthetic peptide
QENEIRTTNPVATECYGSVSTDLQRNGNR

SEQ ID NO: 24549 - protein, 30 aa, Artificial Sequence
  Description of Artificial Sequence: Synthetic polypeptide
DEEEIRTTNPEATEQYGSVDSTNLQNEGNF

SEQ ID NO: 24550 - protein, 28 aa, Artificial Sequence
  Description of Artificial Sequence: Synthetic peptide
DDEEIRTTNPVAYFQYGSVSTNLERGTR

SEQ ID NO: 24551 - protein, 28 aa, Artificial Sequence
  Description of Artificial Sequence: Synthetic peptide
DEEEIRTTNPVASEQYGSVSNGGQRGGR

SEQ ID NO: 24552 - protein, 29 aa, Artificial Sequence
  Description of Artificial Sequence: Synthetic peptide
DEEEITTTNPVATEQYGSVSTALQLNGMR

SEQ ID NO: 24553 - protein, 28 aa, Artificial Sequence
  Description of Artificial Sequence: Synthetic peptide
DLECIRTTNPVATEQWGSVSTNLIRGNP

SEQ ID NO: 24554 - protein, 30 aa, Artificial Sequence
  Description of Artificial Sequence: Synthetic polypeptide
DEEEIRTTNPVATEQYGSVSTPEEDRDGNR

SEQ ID NO: 24555 - protein, 28 aa, Artificial Sequence
  Description of Artificial Sequence: Synthetic peptide
DEHEIRTTNPVATEQYGDVSENLQGGNC

SEQ ID NO: 24556 - protein, 29 aa, Artificial Sequence
  Description of Artificial Sequence: Synthetic peptide
DEQEITTTNPVATEQYGDVSADNLQRGNR

SEQ ID NO: 24557 - protein, 28 aa, Artificial Sequence
  Description of Artificial Sequence: Synthetic peptide
DEEEIRTTNPCATEVYGCVGSNLQRGNR

SEQ ID NO: 24558 - protein, 28 aa, Artificial Sequence
  Description of Artificial Sequence: Synthetic peptide
DEQEIRTTNPCATEQYGDVSTNLCSGNR

SEQ ID NO: 24559 - protein, 28 aa, Artificial Sequence
  Description of Artificial Sequence: Synthetic peptide
DEEEIVTTNPVATEQYGQVSTCQDRGNR

SEQ ID NO: 24560 - protein, 28 aa, Artificial Sequence
  Description of Artificial Sequence: Synthetic peptide
AEEEIWTTNPVATEQYGSVSTGDQRGND

SEQ ID NO: 24561 - protein, 28 aa, Artificial Sequence
  Description of Artificial Sequence: Synthetic peptide
SEGEIRTTNPVASEQYGSVSTNLIRGNP

SEQ ID NO: 24562 - protein, 32 aa, Artificial Sequence
  Description of Artificial Sequence: Synthetic polypeptide
DEEEIRTTNPVATEQYGSVSTNPLQERGDEPR

SEQ ID NO: 24563 - protein, 28 aa, Artificial Sequence
  Description of Artificial Sequence: Synthetic peptide
DEEEIRTTNPFATEQYGSVSTCLIDGER

SEQ ID NO: 24564 - protein, 28 aa, Artificial Sequence
  Description of Artificial Sequence: Synthetic peptide
DEEEIRTTNPVCTECFGVVSANLQRGNR

SEQ ID NO: 24565 - protein, 28 aa, Artificial Sequence
  Description of Artificial Sequence: Synthetic peptide
DEEEIRTTNPVATEQYGSVETPLQHENW

SEQ ID NO: 24566 - protein, 29 aa, Artificial Sequence
  Description of Artificial Sequence: Synthetic peptide
DEQEIRTTNPVASEIYGCVSATNLQRGNR

SEQ ID NO: 24567 - protein, 30 aa, Artificial Sequence
  Description of Artificial Sequence: Synthetic polypeptide
DEEEIRTVNPVATEQYGSVSETCDDQRGNR

SEQ ID NO: 24568 - protein, 28 aa, Artificial Sequence
  Description of Artificial Sequence: Synthetic peptide
DENEIRTTNPDATEQYGSASTNLQVGND

SEQ ID NO: 24569 - protein, 30 aa, Artificial Sequence
  Description of Artificial Sequence: Synthetic polypeptide
DEEEIRTTNPVASEQYGSASTCNLQDRGNA

SEQ ID NO: 24570 - protein, 32 aa, Artificial Sequence
  Description of Artificial Sequence: Synthetic polypeptide
DEEEIRTTNPVATEQYGSVDSETDLQRDGENR

SEQ ID NO: 24571 - protein, 28 aa, Artificial Sequence
  Description of Artificial Sequence: Synthetic peptide
DEMEIRTTNPVATEQYGLVSYNEQAGNR

SEQ ID NO: 24572 - protein, 30 aa, Artificial Sequence
  Description of Artificial Sequence: Synthetic polypeptide
DEEEIRTTNPVATEQYGSVSCTNGGQRGKF

SEQ ID NO: 24573 - protein, 28 aa, Artificial Sequence
  Description of Artificial Sequence: Synthetic peptide
GENEIRTVNPVATEQYGVVATNLQRGNR

SEQ ID NO: 24574 - protein, 30 aa, Artificial Sequence
  Description of Artificial Sequence: Synthetic polypeptide
DEQEIRTTNPVATEQYGSVDDTGNDQRGNR

SEQ ID NO: 24575 - protein, 30 aa, Artificial Sequence
  Description of Artificial Sequence: Synthetic polypeptide
SEEEIRTTNPVATELYGSVSTNLMLRGENR

SEQ ID NO: 24576 - protein, 30 aa, Artificial Sequence
  Description of Artificial Sequence: Synthetic polypeptide
DEEVIRTTNPVATEQWYGEVSTPLQRHGNR

SEQ ID NO: 24577 - protein, 31 aa, Artificial Sequence
  Description of Artificial Sequence: Synthetic polypeptide
DEEEIRTTNPVATEQYGSVECTENPQRGNER

SEQ ID NO: 24578 - protein, 28 aa, Artificial Sequence
  Description of Artificial Sequence: Synthetic peptide
DEEEIRTTNPCATESYGSVSSELCRGNR

SEQ ID NO: 24579 - protein, 30 aa, Artificial Sequence
  Description of Artificial Sequence: Synthetic polypeptide
DEEEIRTTNPFATEQYGSVSTNNLFREGND

SEQ ID NO: 24580 - protein, 29 aa, Artificial Sequence
  Description of Artificial Sequence: Synthetic peptide
DEEELRTTNPVATGQYGSVSITNLQEGNV

SEQ ID NO: 24581 - protein, 28 aa, Artificial Sequence
  Description of Artificial Sequence: Synthetic peptide
DENEIRTTNPDATEQYGAVSTELQRGND

SEQ ID NO: 24582 - protein, 31 aa, Artificial Sequence
  Description of Artificial Sequence: Synthetic polypeptide
DEEEIRTTNPEATEQYGSVSTNNLTQQEGNR

SEQ ID NO: 24583 - protein, 31 aa, Artificial Sequence
  Description of Artificial Sequence: Synthetic polypeptide
DEEEIRTTNPVATETYGSVISTNLPQDRGNS

SEQ ID NO: 24584 - protein, 30 aa, Artificial Sequence
  Description of Artificial Sequence: Synthetic polypeptide
DEEEIRTTNPMATEQYGSVSTDLQDREGNM

SEQ ID NO: 24585 - protein, 28 aa, Artificial Sequence
  Description of Artificial Sequence: Synthetic peptide
SEEEIRATNPAATEQYGSVSVNPQRGNR

SEQ ID NO: 24586 - protein, 28 aa, Artificial Sequence
  Description of Artificial Sequence: Synthetic peptide
AEQEIRTTNPVATEQYGSMSTNLQDGNC

SEQ ID NO: 24587 - protein, 28 aa, Artificial Sequence
  Description of Artificial Sequence: Synthetic peptide
DEEQIRTTNPVAFEQYGSVDTNLQRGTY

SEQ ID NO: 24588 - protein, 29 aa, Artificial Sequence
  Description of Artificial Sequence: Synthetic peptide
DEEEIRTVNPVATECYGDVSTNLQHEGNR

SEQ ID NO: 24589 - protein, 28 aa, Artificial Sequence
  Description of Artificial Sequence: Synthetic peptide
DTEEIRTTNPVATEQWGDWSTNEQRGNR

SEQ ID NO: 24590 - protein, 29 aa, Artificial Sequence
  Description of Artificial Sequence: Synthetic peptide
DEEEIYTTNPVATEQYGSVSCTNLQSEND

SEQ ID NO: 24591 - protein, 32 aa, Artificial Sequence
  Description of Artificial Sequence: Synthetic polypeptide
DEEEIRTTNPVATEQYGSVSCTMNLQCRGNDI

SEQ ID NO: 24592 - protein, 28 aa, Artificial Sequence
  Description of Artificial Sequence: Synthetic peptide
DEEEIRTTNPVATEQYGSVHTALMRGDA

SEQ ID NO: 24593 - protein, 28 aa, Artificial Sequence
  Description of Artificial Sequence: Synthetic peptide
DEEEIRPTNPVATEQYGSVETNGQPGNP

SEQ ID NO: 24594 - protein, 30 aa, Artificial Sequence
  Description of Artificial Sequence: Synthetic polypeptide
DEEEIATTNPTATEQYGSVSTNLQLQGDNR

SEQ ID NO: 24595 - protein, 30 aa, Artificial Sequence
  Description of Artificial Sequence: Synthetic polypeptide
DEEEIMTTNPVATESYGSVDTGNLQRGNDR

SEQ ID NO: 24596 - protein, 28 aa, Artificial Sequence
  Description of Artificial Sequence: Synthetic peptide
DEQEIRTTNPEATEQYGSVSTNLEIGER

SEQ ID NO: 24597 - protein, 28 aa, Artificial Sequence
  Description of Artificial Sequence: Synthetic peptide
DENEVATTNPVATEQYGSVGSNLQRGNR

SEQ ID NO: 24598 - protein, 28 aa, Artificial Sequence
  Description of Artificial Sequence: Synthetic peptide
DENEIVATNPVATEMYGWVSTNLQRGNR

SEQ ID NO: 24599 - protein, 29 aa, Artificial Sequence
  Description of Artificial Sequence: Synthetic peptide
DDQEIRATNPVATEQYGVVSATNLQRGNR

SEQ ID NO: 24600 - protein, 29 aa, Artificial Sequence
  Description of Artificial Sequence: Synthetic peptide
DEEEIRTTNPVCTEQYGSISCTNLQHGNN

SEQ ID NO: 24601 - protein, 28 aa, Artificial Sequence
  Description of Artificial Sequence: Synthetic peptide
DEEEVACTNPVASEQYGSVATNLQRGNR

SEQ ID NO: 24602 - protein, 29 aa, Artificial Sequence
  Description of Artificial Sequence: Synthetic peptide
DEEEIRTTNPTATETYGSVSDNLQTRGNF

SEQ ID NO: 24603 - protein, 28 aa, Artificial Sequence
  Description of Artificial Sequence: Synthetic peptide
DEEEIRTTNPFATEQYGSVSTEDQEGER

SEQ ID NO: 24604 - protein, 30 aa, Artificial Sequence
  Description of Artificial Sequence: Synthetic polypeptide
DEEEIATTNPTATEQYGSVSTNLQREGDNV

SEQ ID NO: 24605 - protein, 30 aa, Artificial Sequence
  Description of Artificial Sequence: Synthetic polypeptide
DEEEIRTTNPVATEQYGSVDTMNDQRGNDV

SEQ ID NO: 24606 - protein, 28 aa, Artificial Sequence
  Description of Artificial Sequence: Synthetic peptide
DEEEIRTTNPVATEQYGSVSTDLEDGEL

SEQ ID NO: 24607 - protein, 32 aa, Artificial Sequence
  Description of Artificial Sequence: Synthetic polypeptide
DEEEIRTTNPVATEQYGESVDSDTNLQRGNED

SEQ ID NO: 24608 - protein, 29 aa, Artificial Sequence
  Description of Artificial Sequence: Synthetic peptide
DEQEIRTTNPVATEQYGDVSTNLQEHGNI

SEQ ID NO: 24609 - protein, 28 aa, Artificial Sequence
  Description of Artificial Sequence: Synthetic peptide
DEEEIRTTNPVATEQYGSVETNDDPGER

SEQ ID NO: 24610 - protein, 28 aa, Artificial Sequence
  Description of Artificial Sequence: Synthetic peptide
DEEEIRTTNIVATEQVGSTTTNLQGGNR

SEQ ID NO: 24611 - protein, 29 aa, Artificial Sequence
  Description of Artificial Sequence: Synthetic peptide
DEVEITTTNPVATEQYGSVSCENLQYGNR

SEQ ID NO: 24612 - protein, 30 aa, Artificial Sequence
  Description of Artificial Sequence: Synthetic polypeptide
GEEEIRTVNPVATEQYGSVSTNGLPQRGDR

SEQ ID NO: 24613 - protein, 28 aa, Artificial Sequence
  Description of Artificial Sequence: Synthetic peptide
DEQEIRTVNPVASEMYGSVSTNLQRGNQ

SEQ ID NO: 24614 - protein, 28 aa, Artificial Sequence
  Description of Artificial Sequence: Synthetic peptide
DEQEIVTTNPVATEMYGWVGTNLQRGNR

SEQ ID NO: 24615 - protein, 28 aa, Artificial Sequence
  Description of Artificial Sequence: Synthetic peptide
DEVEIRTTNPVATEQYGDVSEELQYGNR

SEQ ID NO: 24616 - protein, 28 aa, Artificial Sequence
  Description of Artificial Sequence: Synthetic peptide
HEEEIMTTNPIATEQYGFVATNLQRGNR

SEQ ID NO: 24617 - protein, 28 aa, Artificial Sequence
  Description of Artificial Sequence: Synthetic peptide
QEFEIRTTNPVATEQYGTVSTNLQIGNL

SEQ ID NO: 24618 - protein, 30 aa, Artificial Sequence
  Description of Artificial Sequence: Synthetic polypeptide
DEVEIRTTNPVATEQYGGVSTMNEQRGNTR

SEQ ID NO: 24619 - protein, 28 aa, Artificial Sequence
  Description of Artificial Sequence: Synthetic peptide
DEDEITTTNPVATELYGSVSTNLQHGND

SEQ ID NO: 24620 - protein, 30 aa, Artificial Sequence
  Description of Artificial Sequence: Synthetic polypeptide
DEEEIRTTNPDATEQYGSDSTNLQERGINV

SEQ ID NO: 24621 - protein, 29 aa, Artificial Sequence
  Description of Artificial Sequence: Synthetic peptide
NEEEIRATNPVATEQYGTVDTENLQRGNR

SEQ ID NO: 24622 - protein, 28 aa, Artificial Sequence
  Description of Artificial Sequence: Synthetic peptide
DEEEIRTTNPVATEQYGSVETNLDEGDN

SEQ ID NO: 24623 - protein, 30 aa, Artificial Sequence
  Description of Artificial Sequence: Synthetic polypeptide
DEEEIRCTNPVATEQYGGVSTPNPQLRGNR

SEQ ID NO: 24624 - protein, 31 aa, Artificial Sequence
  Description of Artificial Sequence: Synthetic polypeptide
DEEEIRTTNPVATEQYGSVDSTNLQFKGNPL

SEQ ID NO: 24625 - protein, 28 aa, Artificial Sequence
  Description of Artificial Sequence: Synthetic peptide
DEEEIVTTNPVATEQYGDVSTNLQLGMM

SEQ ID NO: 24626 - protein, 32 aa, Artificial Sequence
  Description of Artificial Sequence: Synthetic polypeptide
DEEEIRTTNPVATEQYGSVSTNGLPQRKGTWR

SEQ ID NO: 24627 - protein, 28 aa, Artificial Sequence
  Description of Artificial Sequence: Synthetic peptide
QEQEIRTTNPVATEHYGEGSTNLQRGNR

SEQ ID NO: 24628 - protein, 28 aa, Artificial Sequence
  Description of Artificial Sequence: Synthetic peptide
AELEIRTTNPVATEQYGLVSENLQRGER

SEQ ID NO: 24629 - protein, 28 aa, Artificial Sequence
  Description of Artificial Sequence: Synthetic peptide
DEIEIRPTNPVATEQYGSVAENLQRGNS

SEQ ID NO: 24630 - protein, 28 aa, Artificial Sequence
  Description of Artificial Sequence: Synthetic peptide
CEVEIRTTNCVATEQYGSVSMNLQRGDR

SEQ ID NO: 24631 - protein, 28 aa, Artificial Sequence
  Description of Artificial Sequence: Synthetic peptide
DEEEIRTTNPDATEQYGSVSTPLDIGER

SEQ ID NO: 24632 - protein, 32 aa, Artificial Sequence
  Description of Artificial Sequence: Synthetic polypeptide
DDEEIRTTNPVATEQYGSVCSTYNLVQRGVNR

SEQ ID NO: 24633 - protein, 28 aa, Artificial Sequence
  Description of Artificial Sequence: Synthetic peptide
DEEEIRTTNPVATEIFGAVGTNLQRPNR

SEQ ID NO: 24634 - protein, 29 aa, Artificial Sequence
  Description of Artificial Sequence: Synthetic peptide
DEEEIRQTNPVSTEQYGSVSATNLQHGGR

SEQ ID NO: 24635 - protein, 28 aa, Artificial Sequence
  Description of Artificial Sequence: Synthetic peptide
DEEEIRQTNPVATEQYGSVETNEENGNR

SEQ ID NO: 24636 - protein, 28 aa, Artificial Sequence
  Description of Artificial Sequence: Synthetic peptide
DEEEIAQTNPVATEQYGSVSTNLEVGNF

SEQ ID NO: 24637 - protein, 28 aa, Artificial Sequence
  Description of Artificial Sequence: Synthetic peptide
DEEEIGTVNPVATEQYGNVSENLQRGQR

SEQ ID NO: 24638 - protein, 29 aa, Artificial Sequence
  Description of Artificial Sequence: Synthetic peptide
QEEEISTTNPVATEQYGDVSADNLQRGNR

SEQ ID NO: 24639 - protein, 30 aa, Artificial Sequence
  Description of Artificial Sequence: Synthetic polypeptide
DEEEIRTTNPVATECYGSVSTCNLQQNGTR

SEQ ID NO: 24640 - protein, 28 aa, Artificial Sequence
  Description of Artificial Sequence: Synthetic peptide
DEGELRTTNPVATEWYGSAGTNLQRGNR

SEQ ID NO: 24641 - protein, 28 aa, Artificial Sequence
  Description of Artificial Sequence: Synthetic peptide
DEEEIRTTNPVATEQWGSVSENLETGNL

SEQ ID NO: 24642 - protein, 30 aa, Artificial Sequence
  Description of Artificial Sequence: Synthetic polypeptide
DEEEIRTTNPVATEQYGSVSTELQEYEGNS

SEQ ID NO: 24643 - protein, 28 aa, Artificial Sequence
  Description of Artificial Sequence: Synthetic peptide
DEEEIVATNPVATEQFGSISTNLQVGNR

SEQ ID NO: 24644 - protein, 28 aa, Artificial Sequence
  Description of Artificial Sequence: Synthetic peptide
DEEEIRTTNPVATEQYGSVDTEEERGNQ

SEQ ID NO: 24645 - protein, 28 aa, Artificial Sequence
  Description of Artificial Sequence: Synthetic peptide
DEEEIRQTNPVSTEQYGSVSTVLQRENK

SEQ ID NO: 24646 - protein, 28 aa, Artificial Sequence
  Description of Artificial Sequence: Synthetic peptide
DEEEIRTTNPIATEQYGSWSTNLQPGII

SEQ ID NO: 24647 - protein, 29 aa, Artificial Sequence
  Description of Artificial Sequence: Synthetic peptide
DEEEIRTTNPVATEQYGDVSEDLQRGNDH

SEQ ID NO: 24648 - protein, 30 aa, Artificial Sequence
  Description of Artificial Sequence: Synthetic polypeptide
DEEEIRTTNPVATEQYGSVSCENLQCHGNM

SEQ ID NO: 24649 - protein, 28 aa, Artificial Sequence
  Description of Artificial Sequence: Synthetic peptide
SEEEIRTTNPVATEIFGSVSTNWQRGTR

SEQ ID NO: 24650 - protein, 28 aa, Artificial Sequence
  Description of Artificial Sequence: Synthetic peptide
DEEMIRTTNPVATEQYGCVETGLQRPNR

SEQ ID NO: 24651 - protein, 28 aa, Artificial Sequence
  Description of Artificial Sequence: Synthetic peptide
GEEEIRTVNPVATEVYGIVSTNLQAGNR

SEQ ID NO: 24652 - protein, 31 aa, Artificial Sequence
  Description of Artificial Sequence: Synthetic polypeptide
DEEEIRTTNPVATEQYGSVSTEEDQRGENER

SEQ ID NO: 24653 - protein, 31 aa, Artificial Sequence
  Description of Artificial Sequence: Synthetic polypeptide
DEEEIRTTNPVATEQYGGSVASTNLQEDGNN

SEQ ID NO: 24654 - protein, 28 aa, Artificial Sequence
  Description of Artificial Sequence: Synthetic peptide
DEEEIATTNPTATEQYGSVSTNEQQGNG

SEQ ID NO: 24655 - protein, 30 aa, Artificial Sequence
  Description of Artificial Sequence: Synthetic polypeptide
DEEEIRTTNPVATEQYGAFVWTNDQRDGNR

SEQ ID NO: 24656 - protein, 30 aa, Artificial Sequence
  Description of Artificial Sequence: Synthetic polypeptide
SEEEIRTTNPVATEQYGEVSTCNLQREGNA

SEQ ID NO: 24657 - protein, 28 aa, Artificial Sequence
  Description of Artificial Sequence: Synthetic peptide
DEEEIRTTNPVATEQYGSVETNDQVENF

SEQ ID NO: 24658 - protein, 30 aa, Artificial Sequence
  Description of Artificial Sequence: Synthetic polypeptide
DEEEIRTTNPVATEQYGSVETDLPQHGNDR

SEQ ID NO: 24659 - protein, 28 aa, Artificial Sequence
  Description of Artificial Sequence: Synthetic peptide
DEEEIRTTNPDATQQYGSVSTPLQRGEP

SEQ ID NO: 24660 - protein, 28 aa, Artificial Sequence
  Description of Artificial Sequence: Synthetic peptide
DEEEVSTVNPVATEQYGSVSNNLQVGNR

SEQ ID NO: 24661 - protein, 30 aa, Artificial Sequence
  Description of Artificial Sequence: Synthetic polypeptide
DEEEIRTTNPVATEQYGSVSTNLQEQGEDN

SEQ ID NO: 24662 - protein, 30 aa, Artificial Sequence
  Description of Artificial Sequence: Synthetic polypeptide
DEEEIRTTNPVATEQYWSFVSTPNLQRENP

SEQ ID NO: 24663 - protein, 28 aa, Artificial Sequence
  Description of Artificial Sequence: Synthetic peptide
GESEIRTTNPCATEQYGSVSTALQRGDR

SEQ ID NO: 24664 - protein, 28 aa, Artificial Sequence
  Description of Artificial Sequence: Synthetic peptide
DEEEIRTTNPVATEWYGSVDENEMRGNR

SEQ ID NO: 24665 - protein, 28 aa, Artificial Sequence
  Description of Artificial Sequence: Synthetic peptide
NEEIIRTTNPDATEQYGSVSTNLNPGNR

SEQ ID NO: 24666 - protein, 28 aa, Artificial Sequence
  Description of Artificial Sequence: Synthetic peptide
KENEIRTVNPVATEQYGSVSTNLQAGNA

SEQ ID NO: 24667 - protein, 28 aa, Artificial Sequence
  Description of Artificial Sequence: Synthetic peptide
DEEEIRTTNIVATEMYGSVTTNVQRGND

SEQ ID NO: 24668 - protein, 28 aa, Artificial Sequence
  Description of Artificial Sequence: Synthetic peptide
DEQEIRTTNPVSTELYGEASTNLQRGNR

SEQ ID NO: 24669 - protein, 28 aa, Artificial Sequence
  Description of Artificial Sequence: Synthetic peptide
DEDEVRATNPVATEIYGSVSSNLQRGNR

SEQ ID NO: 24670 - protein, 28 aa, Artificial Sequence
  Description of Artificial Sequence: Synthetic peptide
DEEEITTTNPVATEQYGGVSTNLMRGTI

SEQ ID NO: 24671 - protein, 28 aa, Artificial Sequence
  Description of Artificial Sequence: Synthetic peptide
DEHEICGTNPVSTEQYGSVSTNLQRGTR

SEQ ID NO: 24672 - protein, 28 aa, Artificial Sequence
  Description of Artificial Sequence: Synthetic peptide
DEEEIRTTNIVATEQYGSVSTIDFRGER

SEQ ID NO: 24673 - protein, 28 aa, Artificial Sequence
  Description of Artificial Sequence: Synthetic peptide
DEEELRPTNPVATEAYGSVSENLQRGTR

SEQ ID NO: 24674 - protein, 28 aa, Artificial Sequence
  Description of Artificial Sequence: Synthetic peptide
DEECIRTTNPDATEQYGSVETNDQRGNP

SEQ ID NO: 24675 - protein, 28 aa, Artificial Sequence
  Description of Artificial Sequence: Synthetic peptide
DENEIRTTNPVATEQYGSVDDALQRGNH

SEQ ID NO: 24676 - protein, 32 aa, Artificial Sequence
  Description of Artificial Sequence: Synthetic polypeptide
DEEEIRTTNPVATEQYGSVSITCNDVQRGDNR

SEQ ID NO: 24677 - protein, 30 aa, Artificial Sequence
  Description of Artificial Sequence: Synthetic polypeptide
DEEEIRTTNPEATEQYGSVSATGPLQRGNH

SEQ ID NO: 24678 - protein, 30 aa, Artificial Sequence
  Description of Artificial Sequence: Synthetic polypeptide
DEEEIRTTNPVATEPYWGVSVSTGLQQGNR

SEQ ID NO: 24679 - protein, 31 aa, Artificial Sequence
  Description of Artificial Sequence: Synthetic polypeptide
DEEEIRTTNPVATEQYGESVSETNLEREGNF

SEQ ID NO: 24680 - protein, 28 aa, Artificial Sequence
  Description of Artificial Sequence: Synthetic peptide
DDEEIRTTNPVSTEQYGNYSTNLQRGNM

SEQ ID NO: 24681 - protein, 28 aa, Artificial Sequence
  Description of Artificial Sequence: Synthetic peptide
DEEEIRTTNPEATEQYGSVSTDLQDGDE

SEQ ID NO: 24682 - protein, 28 aa, Artificial Sequence
  Description of Artificial Sequence: Synthetic peptide
DEEEIRTTNPVATEQYGSVDTDLCAGNC

SEQ ID NO: 24683 - protein, 28 aa, Artificial Sequence
  Description of Artificial Sequence: Synthetic peptide
DEEEIRTTNPVATEQYGSWSTELEMGNN

SEQ ID NO: 24684 - protein, 28 aa, Artificial Sequence
  Description of Artificial Sequence: Synthetic peptide
DEEEIRTTNPEATEQYGSVSTNEDTGER

SEQ ID NO: 24685 - protein, 28 aa, Artificial Sequence
  Description of Artificial Sequence: Synthetic peptide
DEEEIRATNPVATEQYGEVITLLQRGNY

SEQ ID NO: 24686 - protein, 28 aa, Artificial Sequence
  Description of Artificial Sequence: Synthetic peptide
DEEEVGTTNPVATENYGSVSTNGERGNR

SEQ ID NO: 24687 - protein, 32 aa, Artificial Sequence
  Description of Artificial Sequence: Synthetic polypeptide
DEEEIRTTNPVATEQYGSVDSTNGLQRGEEDR

SEQ ID NO: 24688 - protein, 30 aa, Artificial Sequence
  Description of Artificial Sequence: Synthetic polypeptide
DEEEIRTTNPVATEQYGSVSTNLEDDGNDL

SEQ ID NO: 24689 - protein, 28 aa, Artificial Sequence
  Description of Artificial Sequence: Synthetic peptide
EEEEISTTNPVATEAYGSMSTNLQRGMR

SEQ ID NO: 24690 - protein, 28 aa, Artificial Sequence
  Description of Artificial Sequence: Synthetic peptide
DEYEIQTTNIVATEQYGSVSTCLQRGNL

SEQ ID NO: 24691 - protein, 28 aa, Artificial Sequence
  Description of Artificial Sequence: Synthetic peptide
DEEEIRTTNPVATEQYGSVSENLQHEEA

SEQ ID NO: 24692 - protein, 28 aa, Artificial Sequence
  Description of Artificial Sequence: Synthetic peptide
DEEEIRTTNPEATEMYGSVSTNPQQGNE

SEQ ID NO: 24693 - protein, 29 aa, Artificial Sequence
  Description of Artificial Sequence: Synthetic peptide
DEEEIRTTNPVATELYGTVSEMNLQRLNR

SEQ ID NO: 24694 - protein, 28 aa, Artificial Sequence
  Description of Artificial Sequence: Synthetic peptide
DEFEIVTTNPVSTEQYGEVSTVLQRGNR

SEQ ID NO: 24695 - protein, 28 aa, Artificial Sequence
  Description of Artificial Sequence: Synthetic peptide
ADEEIRTTNPVATEVYGSVSTNLQKSNR

SEQ ID NO: 24696 - protein, 30 aa, Artificial Sequence
  Description of Artificial Sequence: Synthetic polypeptide
DEQEIRTTNPIASEQYGSVSATNLQRNGNR

SEQ ID NO: 24697 - protein, 28 aa, Artificial Sequence
  Description of Artificial Sequence: Synthetic peptide
MEEEIDTTNPVATEQYGSVSTDLQNGNA

SEQ ID NO: 24698 - protein, 31 aa, Artificial Sequence
  Description of Artificial Sequence: Synthetic polypeptide
DEEEIRTTNPVATEQYGSVSETNLEDNGENR

SEQ ID NO: 24699 - protein, 28 aa, Artificial Sequence
  Description of Artificial Sequence: Synthetic peptide
DEEEIRPTNPVATFQYGSVSTNQERGNF

SEQ ID NO: 24700 - protein, 31 aa, Artificial Sequence
  Description of Artificial Sequence: Synthetic polypeptide
DEEEIRTTNPVATEQYGSVDSETNLQQGEDR

SEQ ID NO: 24701 - protein, 28 aa, Artificial Sequence
  Description of Artificial Sequence: Synthetic peptide
DEEEIRTTNPVATEQYGSVSTELENGES

SEQ ID NO: 24702 - protein, 30 aa, Artificial Sequence
  Description of Artificial Sequence: Synthetic polypeptide
DEEEIRTVNPVATEIYGSVSLTDLQRGNDR

SEQ ID NO: 24703 - protein, 30 aa, Artificial Sequence
  Description of Artificial Sequence: Synthetic polypeptide
DEEEIRTTNPVATEQYGSVSTDLQDLEGNQ

SEQ ID NO: 24704 - protein, 28 aa, Artificial Sequence
  Description of Artificial Sequence: Synthetic peptide
DEQEIRSTNPVATEVYGWVSTNLQRGTR

SEQ ID NO: 24705 - protein, 32 aa, Artificial Sequence
  Description of Artificial Sequence: Synthetic polypeptide
DEEEIRTTNPVATEQYGSVDSDTNLEREGENR

SEQ ID NO: 24706 - protein, 30 aa, Artificial Sequence
  Description of Artificial Sequence: Synthetic polypeptide
DEEEIRTTNPVATEQYGSVSCTMELCRGNC

SEQ ID NO: 24707 - protein, 30 aa, Artificial Sequence
  Description of Artificial Sequence: Synthetic polypeptide
DEEEIRTTNPVATEQYGSVDSTNQIERGDR

SEQ ID NO: 24708 - protein, 28 aa, Artificial Sequence
  Description of Artificial Sequence: Synthetic peptide
DEEEIRTTNPVATEQYGSVETDDQPGND

SEQ ID NO: 24709 - protein, 28 aa, Artificial Sequence
  Description of Artificial Sequence: Synthetic peptide
DEEEIGTTNPVSTEQYGSVSEVLQRGGR

SEQ ID NO: 24710 - protein, 29 aa, Artificial Sequence
  Description of Artificial Sequence: Synthetic peptide
DEEEIRTTNPVATEWYGSVSENLMMRGNW

SEQ ID NO: 24711 - protein, 29 aa, Artificial Sequence
  Description of Artificial Sequence: Synthetic peptide
REETIRTTNPVATEQYGSVSPDNLQHGNR

SEQ ID NO: 24712 - protein, 29 aa, Artificial Sequence
  Description of Artificial Sequence: Synthetic peptide
DEEEIRQTNPVATEQYGSVSTNECREDNR

SEQ ID NO: 24713 - protein, 28 aa, Artificial Sequence
  Description of Artificial Sequence: Synthetic peptide
VEEEIRTTNPYATEQYGSVSTELQIGND

SEQ ID NO: 24714 - protein, 30 aa, Artificial Sequence
  Description of Artificial Sequence: Synthetic polypeptide
DEEEIRTTNPVATEQYGSVSTDLDREGNDD

SEQ ID NO: 24715 - protein, 29 aa, Artificial Sequence
  Description of Artificial Sequence: Synthetic peptide
DEEEIRTTNPCATEQYGSVSTINLDRLMR

SEQ ID NO: 24716 - protein, 31 aa, Artificial Sequence
  Description of Artificial Sequence: Synthetic polypeptide
DEEEIRTTNPVATEQYGISVSTLPLQRGDNK

SEQ ID NO: 24717 - protein, 29 aa, Artificial Sequence
  Description of Artificial Sequence: Synthetic peptide
DEQEITTTNPCATEQYGSVSCTNLQQGNR

SEQ ID NO: 24718 - protein, 28 aa, Artificial Sequence
  Description of Artificial Sequence: Synthetic peptide
DEFEINTTNPVATEQYGDVSDFLQRGNR

SEQ ID NO: 24719 - protein, 30 aa, Artificial Sequence
  Description of Artificial Sequence: Synthetic polypeptide
DEEEIRTVNPVATEQYGCVSATNLQSRGMR

SEQ ID NO: 24720 - protein, 30 aa, Artificial Sequence
  Description of Artificial Sequence: Synthetic polypeptide
DEEEIRTTNPDATEQYGSVSITDLQFRGNA

SEQ ID NO: 24721 - protein, 28 aa, Artificial Sequence
  Description of Artificial Sequence: Synthetic peptide
DEEEIRTTNPDATQQYGSVWTGLQRGNP

SEQ ID NO: 24722 - protein, 30 aa, Artificial Sequence
  Description of Artificial Sequence: Synthetic polypeptide
DEEEIRTTNPVCTEQYGGVSTNGLQRGDLR

SEQ ID NO: 24723 - protein, 28 aa, Artificial Sequence
  Description of Artificial Sequence: Synthetic peptide
DDEEIRSTNPVASEIYGSVSTNLQRGDR

SEQ ID NO: 24724 - protein, 28 aa, Artificial Sequence
  Description of Artificial Sequence: Synthetic peptide
DEEEIRCTNPTATEQYGSVSTDLQRGDA

SEQ ID NO: 24725 - protein, 28 aa, Artificial Sequence
  Description of Artificial Sequence: Synthetic peptide
DEERIRTTNPVATEQYGSVSAEEQPGNR

SEQ ID NO: 24726 - protein, 29 aa, Artificial Sequence
  Description of Artificial Sequence: Synthetic peptide
HEEEIRTTNPVATEQYGFVDSTNVQRGTR

SEQ ID NO: 24727 - protein, 28 aa, Artificial Sequence
  Description of Artificial Sequence: Synthetic peptide
DEEEIRTTNPFATEQYGSVSTQLEVGNF

SEQ ID NO: 24728 - protein, 30 aa, Artificial Sequence
  Description of Artificial Sequence: Synthetic polypeptide
DEEEIRTTNPVATEQYGSVSTEELQVLGNH

SEQ ID NO: 24729 - protein, 28 aa, Artificial Sequence
  Description of Artificial Sequence: Synthetic peptide
NECEIRTTNPVSTEQYGSVSMNLQRLNR

SEQ ID NO: 24730 - protein, 29 aa, Artificial Sequence
  Description of Artificial Sequence: Synthetic peptide
DEEEIRTTNPFATEQYGSLSTNGLQDGNH

SEQ ID NO: 24731 - protein, 28 aa, Artificial Sequence
  Description of Artificial Sequence: Synthetic peptide
DEEEIRTTNPCATEQYGSVSTELCLGNE

SEQ ID NO: 24732 - protein, 31 aa, Artificial Sequence
  Description of Artificial Sequence: Synthetic polypeptide
DEEEIRTTNPVATEQYGSVDSTPDLQWGNDR

SEQ ID NO: 24733 - protein, 31 aa, Artificial Sequence
  Description of Artificial Sequence: Synthetic polypeptide
DEEEIRTTNPVATEQYGSVSATNGLQRGIDY

SEQ ID NO: 24734 - protein, 30 aa, Artificial Sequence
  Description of Artificial Sequence: Synthetic polypeptide
DEEEIRTTNPVATEQYGSVSTNLEVGENDD

SEQ ID NO: 24735 - protein, 28 aa, Artificial Sequence
  Description of Artificial Sequence: Synthetic peptide
DEEEIATTNPEATEQYGSVSENQQRGND

SEQ ID NO: 24736 - protein, 28 aa, Artificial Sequence
  Description of Artificial Sequence: Synthetic peptide
DEEEIRTTNPTATETYGSVSTNLQLLNL

SEQ ID NO: 24737 - protein, 28 aa, Artificial Sequence
  Description of Artificial Sequence: Synthetic peptide
DEEEIRTTNPDATEQYGSWSTNLDTGNQ

SEQ ID NO: 24738 - protein, 28 aa, Artificial Sequence
  Description of Artificial Sequence: Synthetic peptide
DEEEIRTTNPAATEIYGSVSTNEQIGTR

SEQ ID NO: 24739 - protein, 31 aa, Artificial Sequence
  Description of Artificial Sequence: Synthetic polypeptide
DEEEIRTTNPVATEQYGSVSTMNLQCVGNDC

SEQ ID NO: 24740 - protein, 30 aa, Artificial Sequence
  Description of Artificial Sequence: Synthetic polypeptide
DEEEIRTTNPVATEQYGDVSCENLQCTGNR

SEQ ID NO: 24741 - protein, 29 aa, Artificial Sequence
  Description of Artificial Sequence: Synthetic peptide
DEEEIRTTNPVATEQYGSHVSEILQRENA

SEQ ID NO: 24742 - protein, 32 aa, Artificial Sequence
  Description of Artificial Sequence: Synthetic polypeptide
DEEEIRTTNPVATEQYGSVESTELPQVRKGNR

SEQ ID NO: 24743 - protein, 30 aa, Artificial Sequence
  Description of Artificial Sequence: Synthetic polypeptide
DEEETRTTNPVATEQYGSVSTNLDQQGIMR

SEQ ID NO: 24744 - protein, 29 aa, Artificial Sequence
  Description of Artificial Sequence: Synthetic peptide
DEVEIRQTNPVATEQYGFVSTNLQSRGNF

SEQ ID NO: 24745 - protein, 28 aa, Artificial Sequence
  Description of Artificial Sequence: Synthetic peptide
MENEIRAVNPVATEQYGSVSTNLQAGNR

SEQ ID NO: 24746 - protein, 29 aa, Artificial Sequence
  Description of Artificial Sequence: Synthetic peptide
DEEEIRTTNPVATEQYGSASEILQRGNDN

SEQ ID NO: 24747 - protein, 28 aa, Artificial Sequence
  Description of Artificial Sequence: Synthetic peptide
DEEEIRTTNPCASEFYGWVSTNLQRGNM

SEQ ID NO: 24748 - protein, 30 aa, Artificial Sequence
  Description of Artificial Sequence: Synthetic polypeptide
DEEEIRTTNPVATEQYGSVSETNLEDRGEI

SEQ ID NO: 24749 - protein, 29 aa, Artificial Sequence
  Description of Artificial Sequence: Synthetic peptide
GEAEIRTTNPVATEQYGSVSETDLQRLNR

SEQ ID NO: 24750 - protein, 28 aa, Artificial Sequence
  Description of Artificial Sequence: Synthetic peptide
DNEEIRTTNPVATEQYGSVVTNLCRGEQ

SEQ ID NO: 24751 - protein, 28 aa, Artificial Sequence
  Description of Artificial Sequence: Synthetic peptide
SEEEIRTTNPEATEQYGSVSTNWQQGLR

SEQ ID NO: 24752 - protein, 30 aa, Artificial Sequence
  Description of Artificial Sequence: Synthetic polypeptide
DEEEIRTTNPVATEQYGSVSCTELCCRGNY

SEQ ID NO: 24753 - protein, 28 aa, Artificial Sequence
  Description of Artificial Sequence: Synthetic peptide
DEEEIRTTNPDATEQYGSVSTNLFLGDW

SEQ ID NO: 24754 - protein, 32 aa, Artificial Sequence
  Description of Artificial Sequence: Synthetic polypeptide
DEEEIRTTNPVATEQYGSVESTNLQEREGENG

SEQ ID NO: 24755 - protein, 29 aa, Artificial Sequence
  Description of Artificial Sequence: Synthetic peptide
DEEEIRTTNPVCTECWGSVSATPLQRGNR

SEQ ID NO: 24756 - protein, 28 aa, Artificial Sequence
  Description of Artificial Sequence: Synthetic peptide
DENEIRTTNPVATECYGIVSTNEQRGNA

SEQ ID NO: 24757 - protein, 28 aa, Artificial Sequence
  Description of Artificial Sequence: Synthetic peptide
YEEEIGTTNPVATEEYGEVSTVLQRGNR

SEQ ID NO: 24758 - protein, 30 aa, Artificial Sequence
  Description of Artificial Sequence: Synthetic polypeptide
DEEEIRCTNPIASEQYGSVSATNLQREGNR

SEQ ID NO: 24759 - protein, 28 aa, Artificial Sequence
  Description of Artificial Sequence: Synthetic peptide
DEEEIRTTNPDATEQYGSVSTDDQRGEY

SEQ ID NO: 24760 - protein, 28 aa, Artificial Sequence
  Description of Artificial Sequence: Synthetic peptide
VEEEIRTVNPVATEQYGCVSNNLQRGTR

SEQ ID NO: 24761 - protein, 28 aa, Artificial Sequence
  Description of Artificial Sequence: Synthetic peptide
DEEEIRAVNPVATEQYGVVSTNLQYGNN

SEQ ID NO: 24762 - protein, 28 aa, Artificial Sequence
  Description of Artificial Sequence: Synthetic peptide
DEEEISTTNPYCTEQYGSVSTNDQHGNR

SEQ ID NO: 24763 - protein, 30 aa, Artificial Sequence
  Description of Artificial Sequence: Synthetic polypeptide
DEEEIRTTNPVATEQYGSVSTDLQDHEGNL

SEQ ID NO: 24764 - protein, 28 aa, Artificial Sequence
  Description of Artificial Sequence: Synthetic peptide
SEREIRTTNPVATELYGSVSENLQRGNF

SEQ ID NO: 24765 - protein, 30 aa, Artificial Sequence
  Description of Artificial Sequence: Synthetic polypeptide
DEEEIRTTNPVATEMYGSVISAVNLQRGNF

SEQ ID NO: 24766 - protein, 29 aa, Artificial Sequence
  Description of Artificial Sequence: Synthetic peptide
DEEEIRTTNPSATECYGSVSENLQRQGNG

SEQ ID NO: 24767 - protein, 29 aa, Artificial Sequence
  Description of Artificial Sequence: Synthetic peptide
DENEIRTTNPFATEQYGDVSTNLQRGEDR

SEQ ID NO: 24768 - protein, 30 aa, Artificial Sequence
  Description of Artificial Sequence: Synthetic polypeptide
DEEEIRTTNPVATEQYGSVSTMDLQHGNDA

SEQ ID NO: 24769 - protein, 28 aa, Artificial Sequence
  Description of Artificial Sequence: Synthetic peptide
DEHEIAGTNPVATEQYGSASTNLQRGNC

SEQ ID NO: 24770 - protein, 28 aa, Artificial Sequence
  Description of Artificial Sequence: Synthetic peptide
DEGEIETTNPVATEQYGTVSTNLQRGMM

SEQ ID NO: 24771 - protein, 28 aa, Artificial Sequence
  Description of Artificial Sequence: Synthetic peptide
DEEEIRTTNPIATEIYGAVGTNLERGNR

SEQ ID NO: 24772 - protein, 28 aa, Artificial Sequence
  Description of Artificial Sequence: Synthetic peptide
DEEEIRTTNPVATEQYGSVDTNDQNGDN

SEQ ID NO: 24773 - protein, 28 aa, Artificial Sequence
  Description of Artificial Sequence: Synthetic peptide
SEECIRTTNPTAYEQYGSVSTGLQRGNR

SEQ ID NO: 24774 - protein, 28 aa, Artificial Sequence
  Description of Artificial Sequence: Synthetic peptide
DEEEIRATNPEATEQYGSASTNLQLGNS

SEQ ID NO: 24775 - protein, 30 aa, Artificial Sequence
  Description of Artificial Sequence: Synthetic polypeptide
DEEEIRTTNPVATDQYGCVQTMNLQRGGNR

SEQ ID NO: 24776 - protein, 30 aa, Artificial Sequence
  Description of Artificial Sequence: Synthetic polypeptide
DEEEIRCTNPVCTEQYGSVSTNEPQMRGNR

SEQ ID NO: 24777 - protein, 29 aa, Artificial Sequence
  Description of Artificial Sequence: Synthetic peptide
DEMEIRQTNPVATEQYGSVSSENVQRGNR

SEQ ID NO: 24778 - protein, 29 aa, Artificial Sequence
  Description of Artificial Sequence: Synthetic peptide
DEEEITTTNPVATEQYGSVSSTGLYRGNA

SEQ ID NO: 24779 - protein, 28 aa, Artificial Sequence
  Description of Artificial Sequence: Synthetic peptide
DEQEIVTTNPVSSEHYGSVSTNLQRGNR

SEQ ID NO: 24780 - protein, 30 aa, Artificial Sequence
  Description of Artificial Sequence: Synthetic polypeptide
DEEEIRTTNPVATEQYGSVDTNLMMIGENR

SEQ ID NO: 24781 - protein, 32 aa, Artificial Sequence
  Description of Artificial Sequence: Synthetic polypeptide
DEEEIRTTNPVATEQYGYSVSTVNLQREHNPR

SEQ ID NO: 24782 - protein, 29 aa, Artificial Sequence
  Description of Artificial Sequence: Synthetic peptide
DEETIRTCNPVATEQYGSVSTNLQVHGAR

SEQ ID NO: 24783 - protein, 31 aa, Artificial Sequence
  Description of Artificial Sequence: Synthetic polypeptide
DEEEIRTTNPDAYEQYGSVSTPNPLQLRGNR

SEQ ID NO: 24784 - protein, 30 aa, Artificial Sequence
  Description of Artificial Sequence: Synthetic polypeptide
DEVEIRATNPVATEQYGSVSTNLQQGDNTR

SEQ ID NO: 24785 - protein, 30 aa, Artificial Sequence
  Description of Artificial Sequence: Synthetic polypeptide
DEEEIRTTNPCCTEQYGSVSTNLQQRFGNV

SEQ ID NO: 24786 - protein, 28 aa, Artificial Sequence
  Description of Artificial Sequence: Synthetic peptide
DEEQIRTTNPVATEQYGSWSHNDQRGER

SEQ ID NO: 24787 - protein, 30 aa, Artificial Sequence
  Description of Artificial Sequence: Synthetic polypeptide
DEEEIRTTNPVATEQYGSVSCENLQCMGNI

SEQ ID NO: 24788 - protein, 30 aa, Artificial Sequence
  Description of Artificial Sequence: Synthetic polypeptide
DEEEVRTTNPVATEQYGFVSATNGLQRGAR

SEQ ID NO: 24789 - protein, 28 aa, Artificial Sequence
  Description of Artificial Sequence: Synthetic peptide
DEQEIRTTNPVATEQYGSVETNDERGNA

SEQ ID NO: 24790 - protein, 30 aa, Artificial Sequence
  Description of Artificial Sequence: Synthetic polypeptide
DEEEIRQTNPVATEQYGWVASTNLQRGIER

SEQ ID NO: 24791 - protein, 28 aa, Artificial Sequence
  Description of Artificial Sequence: Synthetic peptide
MENEIRTTNPVATEQYGSVSTDLQNGNA

SEQ ID NO: 24792 - protein, 28 aa, Artificial Sequence
  Description of Artificial Sequence: Synthetic peptide
DEEEIRTTNPVAYEVYGCVAMNLQRGNR

SEQ ID NO: 24793 - protein, 28 aa, Artificial Sequence
  Description of Artificial Sequence: Synthetic peptide
DEDEIRCVNPVSTEQYGSVSTNLQHGNR

SEQ ID NO: 24794 - protein, 30 aa, Artificial Sequence
  Description of Artificial Sequence: Synthetic polypeptide
MEEEIRTTNPVATEQYGSVSTNLQNEGNDS

SEQ ID NO: 24795 - protein, 28 aa, Artificial Sequence
  Description of Artificial Sequence: Synthetic peptide
QENEIRTTNPVATECYGSVSTNLQPGER

SEQ ID NO: 24796 - protein, 30 aa, Artificial Sequence
  Description of Artificial Sequence: Synthetic polypeptide
DEEEIRGTNPVATDQYGSVATGNPLQRGNR

SEQ ID NO: 24797 - protein, 30 aa, Artificial Sequence
  Description of Artificial Sequence: Synthetic polypeptide
DEEEIRTVNPVSTEMYGSVSTNLQRNGENR

SEQ ID NO: 24798 - protein, 31 aa, Artificial Sequence
  Description of Artificial Sequence: Synthetic polypeptide
DEEEIRTTNPFATEQYGSVSTCNLQRGDELR

SEQ ID NO: 24799 - protein, 28 aa, Artificial Sequence
  Description of Artificial Sequence: Synthetic peptide
DEEEIRCTNPVATEQYGSADTNLQTGNG

SEQ ID NO: 24800 - protein, 31 aa, Artificial Sequence
  Description of Artificial Sequence: Synthetic polypeptide
DEEEIVTTNPVATECYGSVSFTNLQDRGINR

SEQ ID NO: 24801 - protein, 31 aa, Artificial Sequence
  Description of Artificial Sequence: Synthetic polypeptide
DEEEIRTTNPVATEQYGSVDSTNLVQVGEND

SEQ ID NO: 24802 - protein, 30 aa, Artificial Sequence
  Description of Artificial Sequence: Synthetic polypeptide
DEEEIRTTNPVATEQYGSVSCEDLQCYGNR

SEQ ID NO: 24803 - protein, 28 aa, Artificial Sequence
  Description of Artificial Sequence: Synthetic peptide
DEEEIRTTNPVATEQYGEVSENLQEGEC

SEQ ID NO: 24804 - protein, 28 aa, Artificial Sequence
  Description of Artificial Sequence: Synthetic peptide
DEEEIRCTNPVASEIYGSVSTNLMRGPR

SEQ ID NO: 24805 - protein, 28 aa, Artificial Sequence
  Description of Artificial Sequence: Synthetic peptide
DEGEIRTTNPVATECYGSVSENLQVGNP

SEQ ID NO: 24806 - protein, 31 aa, Artificial Sequence
  Description of Artificial Sequence: Synthetic polypeptide
DEEEIRTTNPVATEQYGSVSETDLVQERGNL

SEQ ID NO: 24807 - protein, 31 aa, Artificial Sequence
  Description of Artificial Sequence: Synthetic polypeptide
DEEEIRTTNPVATEQYGSVYSTNCIQKCGNR

SEQ ID NO: 24808 - protein, 28 aa, Artificial Sequence
  Description of Artificial Sequence: Synthetic peptide
DEEEIRTTNPFATEQYWSWSTNLQAGDR

SEQ ID NO: 24809 - protein, 28 aa, Artificial Sequence
  Description of Artificial Sequence: Synthetic peptide
KENEIRTTNPVATEQYGSVSTDLQSGNS

SEQ ID NO: 24810 - protein, 28 aa, Artificial Sequence
  Description of Artificial Sequence: Synthetic peptide
DEEEIATTNPCATEQYGSASTNLCRGNQ

SEQ ID NO: 24811 - protein, 32 aa, Artificial Sequence
  Description of Artificial Sequence: Synthetic polypeptide
DEEEIRTTNPVATEQYGSVSDTENLQQEGENR

SEQ ID NO: 24812 - protein, 28 aa, Artificial Sequence
  Description of Artificial Sequence: Synthetic peptide
DEEEIAQTNIVATEQYGSVSENLQRGNA

SEQ ID NO: 24813 - protein, 31 aa, Artificial Sequence
  Description of Artificial Sequence: Synthetic polypeptide
DEEEIRTTNPVATEQYGSVSCTNLCHGENDR

SEQ ID NO: 24814 - protein, 32 aa, Artificial Sequence
  Description of Artificial Sequence: Synthetic polypeptide
DEEEIRTTNPVATQQYWGSMVSTNPLQREGNR

SEQ ID NO: 24815 - protein, 30 aa, Artificial Sequence
  Description of Artificial Sequence: Synthetic polypeptide
SEEEIRTTNPVATEMYGSVSTNLQCQSGNR

SEQ ID NO: 24816 - protein, 29 aa, Artificial Sequence
  Description of Artificial Sequence: Synthetic peptide
DEEEIRTTNPVATEQYGSVSCDNLCNGNC

SEQ ID NO: 24817 - protein, 28 aa, Artificial Sequence
  Description of Artificial Sequence: Synthetic peptide
HEEEIRTTNPIATEQYGSVSVNLQLGLR

SEQ ID NO: 24818 - protein, 30 aa, Artificial Sequence
  Description of Artificial Sequence: Synthetic polypeptide
DEEEIRTTNPVAYEQYGSWHTPNPLQRGNR

SEQ ID NO: 24819 - protein, 30 aa, Artificial Sequence
  Description of Artificial Sequence: Synthetic polypeptide
DEEEIRTTNPFATEQYGSVSTPGLEVRGNR

SEQ ID NO: 24820 - protein, 29 aa, Artificial Sequence
  Description of Artificial Sequence: Synthetic peptide
QEEEIVTTNPVATEQYGWVSADNLQRGNR

SEQ ID NO: 24821 - protein, 28 aa, Artificial Sequence
  Description of Artificial Sequence: Synthetic peptide
DEEMIRTTNPYAFEQYGSVSTNEQEGNR

SEQ ID NO: 24822 - protein, 28 aa, Artificial Sequence
  Description of Artificial Sequence: Synthetic peptide
DEQEIVCTNPVATEMYGNVSTNLQRGNR

SEQ ID NO: 24823 - protein, 29 aa, Artificial Sequence
  Description of Artificial Sequence: Synthetic peptide
QEDEIRTTNPVATEQYGEVSAENLQRGNR

SEQ ID NO: 24824 - protein, 29 aa, Artificial Sequence
  Description of Artificial Sequence: Synthetic peptide
DEEEIATTNPVATEQYGSVSTDLEHGNDR

SEQ ID NO: 24825 - protein, 28 aa, Artificial Sequence
  Description of Artificial Sequence: Synthetic peptide
DEQEIRTTNPVATEQYGSVETNLDWGNV

SEQ ID NO: 24826 - protein, 28 aa, Artificial Sequence
  Description of Artificial Sequence: Synthetic peptide
DEQEVRTTNPVATEQYGSVDTDLQRGER

SEQ ID NO: 24827 - protein, 30 aa, Artificial Sequence
  Description of Artificial Sequence: Synthetic polypeptide
DEQHIRTVNPVATEQYGSVSTNLQREGNLR

SEQ ID NO: 24828 - protein, 32 aa, Artificial Sequence
  Description of Artificial Sequence: Synthetic polypeptide
DEEEIRTTNPVATEQYGSVSCTMNLQDTGNDR

SEQ ID NO: 24829 - protein, 30 aa, Artificial Sequence
  Description of Artificial Sequence: Synthetic polypeptide
DEEEIRTTNPDATEQWYGSMVSTNDQRGNP

SEQ ID NO: 24830 - protein, 29 aa, Artificial Sequence
  Description of Artificial Sequence: Synthetic peptide
KEEEIRTTNPVATEQYGSVSTDLQAGNDD

SEQ ID NO: 24831 - protein, 28 aa, Artificial Sequence
  Description of Artificial Sequence: Synthetic peptide
DEENIRTTNIVATEKYGSVSTNLQAGQR

SEQ ID NO: 24832 - protein, 28 aa, Artificial Sequence
  Description of Artificial Sequence: Synthetic peptide
DEEEIRQTNPVATEGYGSVSTCLQREER

SEQ ID NO: 24833 - protein, 30 aa, Artificial Sequence
  Description of Artificial Sequence: Synthetic polypeptide
NEEEIRTTNPDATEQYGSVSSTNLVQPGNR

SEQ ID NO: 24834 - protein, 31 aa, Artificial Sequence
  Description of Artificial Sequence: Synthetic polypeptide
DEFEIRTTNPVATEQYGSVSTTGLNQRGNTR

SEQ ID NO: 24835 - protein, 28 aa, Artificial Sequence
  Description of Artificial Sequence: Synthetic peptide
SEECIRTTNPVATEQFGSVSANLQRGNG

SEQ ID NO: 24836 - protein, 28 aa, Artificial Sequence
  Description of Artificial Sequence: Synthetic peptide
DEQEIRTTNPVASEQYGSVANNLERGNR

SEQ ID NO: 24837 - protein, 28 aa, Artificial Sequence
  Description of Artificial Sequence: Synthetic peptide
DEEEIRTTNPVATEKYGSWHTNLQEGDR

SEQ ID NO: 24838 - protein, 28 aa, Artificial Sequence
  Description of Artificial Sequence: Synthetic peptide
DDSEIRTTNPISTEQYGSTSTNLQRGNR

SEQ ID NO: 24839 - protein, 28 aa, Artificial Sequence
  Description of Artificial Sequence: Synthetic peptide
DTEEIRTTNPVATECWGSVSTPLIRGNR

SEQ ID NO: 24840 - protein, 28 aa, Artificial Sequence
  Description of Artificial Sequence: Synthetic peptide
DETEITTTNPVATEQYGDVSSNLQRGNA

SEQ ID NO: 24841 - protein, 28 aa, Artificial Sequence
  Description of Artificial Sequence: Synthetic peptide
DEEEIRTTNPFATEQYGSVSTGLCRGED

SEQ ID NO: 24842 - protein, 28 aa, Artificial Sequence
  Description of Artificial Sequence: Synthetic peptide
DEQEIRSVNPVATEIYGVVSTNLQRGNR

SEQ ID NO: 24843 - protein, 31 aa, Artificial Sequence
  Description of Artificial Sequence: Synthetic polypeptide
DENEIRTTNPVATEQYGVVDSATNLQRGENR

SEQ ID NO: 24844 - protein, 31 aa, Artificial Sequence
  Description of Artificial Sequence: Synthetic polypeptide
DEEEIRTTNPVATEQYGSVSCTMNLQQGNDN

SEQ ID NO: 24845 - protein, 28 aa, Artificial Sequence
  Description of Artificial Sequence: Synthetic peptide
NAEEIRPTNPVATLQYGSVSTPLQRGNR

SEQ ID NO: 24846 - protein, 30 aa, Artificial Sequence
  Description of Artificial Sequence: Synthetic polypeptide
DEEEIRTTNPEATEQFGSVSTVNLQRGNTV

SEQ ID NO: 24847 - protein, 28 aa, Artificial Sequence
  Description of Artificial Sequence: Synthetic peptide
YEEEIRTTNPVSTESYGSVSTNWQRENR

SEQ ID NO: 24848 - protein, 31 aa, Artificial Sequence
  Description of Artificial Sequence: Synthetic polypeptide
DEEEIRTTNPVATEQYGSVSTFNDQVKGNPR

SEQ ID NO: 24849 - protein, 28 aa, Artificial Sequence
  Description of Artificial Sequence: Synthetic peptide
DENEICQTNPVATEQYGSVSENLQRGNQ

SEQ ID NO: 24850 - protein, 31 aa, Artificial Sequence
  Description of Artificial Sequence: Synthetic polypeptide
DEEEIRTTNPIATEQYGSVESATNLQDRGER

SEQ ID NO: 24851 - protein, 30 aa, Artificial Sequence
  Description of Artificial Sequence: Synthetic polypeptide
DEEEIRTTNPVATEQYGSVSTAGWLIRGTR

SEQ ID NO: 24852 - protein, 28 aa, Artificial Sequence
  Description of Artificial Sequence: Synthetic peptide
DELEIRTTNPIATEVYGSVSTNVQRGDR

SEQ ID NO: 24853 - protein, 28 aa, Artificial Sequence
  Description of Artificial Sequence: Synthetic peptide
KDEEIRTTNPVATEQYGSVSTNLEQGNW

SEQ ID NO: 24854 - protein, 30 aa, Artificial Sequence
  Description of Artificial Sequence: Synthetic polypeptide
DEEEIRTTNPFATEQYGSVSTNNDVLRGNR

SEQ ID NO: 24855 - protein, 28 aa, Artificial Sequence
  Description of Artificial Sequence: Synthetic peptide
DEEEIRTTNPEATEQYGSVSTDEQFGNA

SEQ ID NO: 24856 - protein, 28 aa, Artificial Sequence
  Description of Artificial Sequence: Synthetic peptide
SEEEIRPTNPFATEQYGSVSTNLQRGDA

SEQ ID NO: 24857 - protein, 28 aa, Artificial Sequence
  Description of Artificial Sequence: Synthetic peptide
DEEECRTTNPVNTMQYGSVSTNLQAGQR

SEQ ID NO: 24858 - protein, 30 aa, Artificial Sequence
  Description of Artificial Sequence: Synthetic polypeptide
DEEEIRTTNPDATEQYGSVSTNLTDERGER

SEQ ID NO: 24859 - protein, 28 aa, Artificial Sequence
  Description of Artificial Sequence: Synthetic peptide
QEEELCTTNPVATEQYGSVSENVQRGNR

SEQ ID NO: 24860 - protein, 30 aa, Artificial Sequence
  Description of Artificial Sequence: Synthetic polypeptide
DEEEIRTTNPVATEQYGSVEETNLPQRGEN

SEQ ID NO: 24861 - protein, 28 aa, Artificial Sequence
  Description of Artificial Sequence: Synthetic peptide
DETEIRATNPVATEQWGSTSTNIQRGNR

SEQ ID NO: 24862 - protein, 28 aa, Artificial Sequence
  Description of Artificial Sequence: Synthetic peptide
DEEEIRGVNPVATEPYGSVSTNLQRGTQ

SEQ ID NO: 24863 - protein, 28 aa, Artificial Sequence
  Description of Artificial Sequence: Synthetic peptide
DEEEIRTTNPVATEQYGSVDTPGQDGNL

SEQ ID NO: 24864 - protein, 30 aa, Artificial Sequence
  Description of Artificial Sequence: Synthetic polypeptide
DEEEIRTTNPVSTEQYGSVCGTGALQRGNR

SEQ ID NO: 24865 - protein, 28 aa, Artificial Sequence
  Description of Artificial Sequence: Synthetic peptide
DEEEIRTTNPVATEQYGSAETNEQRGDF

SEQ ID NO: 24866 - protein, 28 aa, Artificial Sequence
  Description of Artificial Sequence: Synthetic peptide
DEEEIRTTNPVATEIYGSVSTELQTGEA

SEQ ID NO: 24867 - protein, 28 aa, Artificial Sequence
  Description of Artificial Sequence: Synthetic peptide
NEEEIRTTNPVATEQYGVVDTNWQRGNG

SEQ ID NO: 24868 - protein, 29 aa, Artificial Sequence
  Description of Artificial Sequence: Synthetic peptide
DEEEIRTTNPVATEQYGSVDCTELCMGNR

SEQ ID NO: 24869 - protein, 29 aa, Artificial Sequence
  Description of Artificial Sequence: Synthetic peptide
DEEEIRTTNPVATEQYGSVSTDLQIGEDD

SEQ ID NO: 24870 - protein, 29 aa, Artificial Sequence
  Description of Artificial Sequence: Synthetic peptide
DEEEIRTTNPFATEQYGSVSENQELRGNR

SEQ ID NO: 24871 - protein, 29 aa, Artificial Sequence
  Description of Artificial Sequence: Synthetic peptide
DEEEITATNPVATEQHGEVSTNLQTRGNR

SEQ ID NO: 24872 - protein, 30 aa, Artificial Sequence
  Description of Artificial Sequence: Synthetic polypeptide
DEEEIRTTNPVATEQYGSVTEDNLQRDDNR

SEQ ID NO: 24873 - protein, 28 aa, Artificial Sequence
  Description of Artificial Sequence: Synthetic peptide
GEEEIRCTNPVASEQYGCVSNNLQRGNR

SEQ ID NO: 24874 - protein, 28 aa, Artificial Sequence
  Description of Artificial Sequence: Synthetic peptide
DEHEIRTTNPVATELYGSVSTPLQYGDR

SEQ ID NO: 24875 - protein, 28 aa, Artificial Sequence
  Description of Artificial Sequence: Synthetic peptide
DDEEIRTTNPVATEIYGSVGMNLERGNR

SEQ ID NO: 24876 - protein, 28 aa, Artificial Sequence
  Description of Artificial Sequence: Synthetic peptide
DEEEIRTTNPVAMERYGSVSINLSRGNF

SEQ ID NO: 24877 - protein, 28 aa, Artificial Sequence
  Description of Artificial Sequence: Synthetic peptide
DEQEIRTTNPEATEQYGSVSTDLERGER

SEQ ID NO: 24878 - protein, 29 aa, Artificial Sequence
  Description of Artificial Sequence: Synthetic peptide
DEEEVRTTNPCATEVYGSVATNLQRNGNR

SEQ ID NO: 24879 - protein, 30 aa, Artificial Sequence
  Description of Artificial Sequence: Synthetic polypeptide
TEEEIRTTNPVATEQAGSVSTNLQETNGNR

SEQ ID NO: 24880 - protein, 28 aa, Artificial Sequence
  Description of Artificial Sequence: Synthetic peptide
DEEEIRTTNPFATEQYGSVSTDEQRENS

SEQ ID NO: 24881 - protein, 28 aa, Artificial Sequence
  Description of Artificial Sequence: Synthetic peptide
DEEEIRTTNPESTEQYGEVSTTGQRGNR

SEQ ID NO: 24882 - protein, 31 aa, Artificial Sequence
  Description of Artificial Sequence: Synthetic polypeptide
DEEEIRTTNPVATEQYGSVSTDLQENEGNDR

SEQ ID NO: 24883 - protein, 28 aa, Artificial Sequence
  Description of Artificial Sequence: Synthetic peptide
DEEEIRTTNPVATEQYGSVFTNWCNGND

SEQ ID NO: 24884 - protein, 28 aa, Artificial Sequence
  Description of Artificial Sequence: Synthetic peptide
DEEEIRTTNPEATEQYGSVSTGPQHGNV

SEQ ID NO: 24885 - protein, 29 aa, Artificial Sequence
  Description of Artificial Sequence: Synthetic peptide
YEEEIRTTNPVCTEQYGSVSTAWQRGNDR

SEQ ID NO: 24886 - protein, 28 aa, Artificial Sequence
  Description of Artificial Sequence: Synthetic peptide
DEEEIRSTNPVAYEIYGTVATNLQRGNR

SEQ ID NO: 24887 - protein, 28 aa, Artificial Sequence
  Description of Artificial Sequence: Synthetic peptide
QEEEIRTTNPVSTEQYGSASTVLQRGGR

SEQ ID NO: 24888 - protein, 28 aa, Artificial Sequence
  Description of Artificial Sequence: Synthetic peptide
DEDEITTTNPVATEQYGSVGMNLQRGTR

SEQ ID NO: 24889 - protein, 28 aa, Artificial Sequence
  Description of Artificial Sequence: Synthetic peptide
KENEIRTTNPVATEQYGSVSEELQRGNV

SEQ ID NO: 24890 - protein, 32 aa, Artificial Sequence
  Description of Artificial Sequence: Synthetic polypeptide
DEEEIRTTNPVATEQYGSVSDTPNLQREGDNP

SEQ ID NO: 24891 - protein, 31 aa, Artificial Sequence
  Description of Artificial Sequence: Synthetic polypeptide
DEEEIRTTNPVATEQYGMSVHQTNLQRGDNP

SEQ ID NO: 24892 - protein, 29 aa, Artificial Sequence
  Description of Artificial Sequence: Synthetic peptide
DEVEIRTTNPVATEQYGSVSTSWQRQGQR

SEQ ID NO: 24893 - protein, 28 aa, Artificial Sequence
  Description of Artificial Sequence: Synthetic peptide
DEEEIRTTNIVATEQYGSVSNFLQQGNT

SEQ ID NO: 24894 - protein, 31 aa, Artificial Sequence
  Description of Artificial Sequence: Synthetic polypeptide
DEEEIRTTNPVATEQYGSVSTDLELRGENDR

SEQ ID NO: 24895 - protein, 32 aa, Artificial Sequence
  Description of Artificial Sequence: Synthetic polypeptide
DEEEIRTTNPVATEQYGSVSTCNLQEREGNDG

SEQ ID NO: 24896 - protein, 28 aa, Artificial Sequence
  Description of Artificial Sequence: Synthetic peptide
SEEEIGTTNIVATEQYGTVSTNLQRGNK

SEQ ID NO: 24897 - protein, 30 aa, Artificial Sequence
  Description of Artificial Sequence: Synthetic polypeptide
DEEEIRTTNPVATEQYGSVSCENLQCNGNN

SEQ ID NO: 24898 - protein, 29 aa, Artificial Sequence
  Description of Artificial Sequence: Synthetic peptide
DEEEIRTTNPVSSEQYGSVSTNLQIRGEM

SEQ ID NO: 24899 - protein, 28 aa, Artificial Sequence
  Description of Artificial Sequence: Synthetic peptide
DEEEIRTTNIVGTEQYGSVITNLQNGNT

SEQ ID NO: 24900 - protein, 28 aa, Artificial Sequence
  Description of Artificial Sequence: Synthetic peptide
DEEEVRGTNPVATEQYGFVATNLQRGGR

SEQ ID NO: 24901 - protein, 29 aa, Artificial Sequence
  Description of Artificial Sequence: Synthetic peptide
DEEEIRTTNPCATEQYGSASDNLQVRFNR

SEQ ID NO: 24902 - protein, 30 aa, Artificial Sequence
  Description of Artificial Sequence: Synthetic polypeptide
SEVEIRTTNPTATEQYGSVSTMNLQDRGNR

SEQ ID NO: 24903 - protein, 28 aa, Artificial Sequence
  Description of Artificial Sequence: Synthetic peptide
DEEEIATTNPVATEQFGALSTNLQRENR

SEQ ID NO: 24904 - protein, 28 aa, Artificial Sequence
  Description of Artificial Sequence: Synthetic peptide
SEEEIRTTNPAATEQYGSVSTNLQVGDA

SEQ ID NO: 24905 - protein, 30 aa, Artificial Sequence
  Description of Artificial Sequence: Synthetic polypeptide
DEEEIRTTNPVATEQYGSVSTNLQEIGEDC

SEQ ID NO: 24906 - protein, 30 aa, Artificial Sequence
  Description of Artificial Sequence: Synthetic polypeptide
DEEEIRTTNPVATEQYGDVSCENLQCYGNR

SEQ ID NO: 24907 - protein, 29 aa, Artificial Sequence
  Description of Artificial Sequence: Synthetic peptide
DEEEIRTTNPVATEQYGSVETNEQTGDER

SEQ ID NO: 24908 - protein, 29 aa, Artificial Sequence
  Description of Artificial Sequence: Synthetic peptide
DEEEIRTTNPVATEQYGSWSETELNSGNR

SEQ ID NO: 24909 - protein, 28 aa, Artificial Sequence
  Description of Artificial Sequence: Synthetic peptide
DEEEIRTTNPEATEQYGSVSTELQHGEI

SEQ ID NO: 24910 - protein, 28 aa, Artificial Sequence
  Description of Artificial Sequence: Synthetic peptide
DEEEIVTTNPVGTEQYGSVSTNIMRQNR

SEQ ID NO: 24911 - protein, 28 aa, Artificial Sequence
  Description of Artificial Sequence: Synthetic peptide
DEEEIRTTNPVATEQYGSVETDEQQGNS

SEQ ID NO: 24912 - protein, 28 aa, Artificial Sequence
  Description of Artificial Sequence: Synthetic peptide
DEEEIRQTNPVSTEQYGEVSTVIQRGNR

SEQ ID NO: 24913 - protein, 28 aa, Artificial Sequence
  Description of Artificial Sequence: Synthetic peptide
DECEIRVTNPVATEQYGSVSTNGTPGNR

SEQ ID NO: 24914 - protein, 31 aa, Artificial Sequence
  Description of Artificial Sequence: Synthetic polypeptide
YEEEIRTTNPVATEQYGSVSCTDLQRFGNDR

SEQ ID NO: 24915 - protein, 28 aa, Artificial Sequence
  Description of Artificial Sequence: Synthetic peptide
DENEIRTTNPAATETYGSVSTNLQRGPF

SEQ ID NO: 24916 - protein, 29 aa, Artificial Sequence
  Description of Artificial Sequence: Synthetic peptide
DEEEIRATNPFATEQYGSVSTNLQGGEDR

SEQ ID NO: 24917 - protein, 28 aa, Artificial Sequence
  Description of Artificial Sequence: Synthetic peptide
NDEELVTTNPVATECYGSVSTNLQRGNR

SEQ ID NO: 24918 - protein, 30 aa, Artificial Sequence
  Description of Artificial Sequence: Synthetic polypeptide
DEEEIRTTNPVATEQYGSVSTDDERGDNDR

SEQ ID NO: 24919 - protein, 28 aa, Artificial Sequence
  Description of Artificial Sequence: Synthetic peptide
DEEEIRTTNPVATEQYGDVSEDLQVGNI

SEQ ID NO: 24920 - protein, 28 aa, Artificial Sequence
  Description of Artificial Sequence: Synthetic peptide
DEEEIRTCNPVATEMYGTVSENLQLGNR

SEQ ID NO: 24921 - protein, 30 aa, Artificial Sequence
  Description of Artificial Sequence: Synthetic polypeptide
DEEEIRTTNPVATEQYGSVATELQDFGNDR

SEQ ID NO: 24922 - protein, 30 aa, Artificial Sequence
  Description of Artificial Sequence: Synthetic polypeptide
DEDEIRTTNPVATEQYGWVSTNLQEEGNDR

SEQ ID NO: 24923 - protein, 31 aa, Artificial Sequence
  Description of Artificial Sequence: Synthetic polypeptide
DEEEIRTTNPVATEQYGSVSETNLQEDGNED

SEQ ID NO: 24924 - protein, 31 aa, Artificial Sequence
  Description of Artificial Sequence: Synthetic polypeptide
DEEEIRTTNPTATEQFGSVISTNLPQRGDNR

SEQ ID NO: 24925 - protein, 28 aa, Artificial Sequence
  Description of Artificial Sequence: Synthetic peptide
QENEIATTNPVATEQYGSVSTCLQRGNN

SEQ ID NO: 24926 - protein, 28 aa, Artificial Sequence
  Description of Artificial Sequence: Synthetic peptide
DEGEIRSTNPVATEQYGSVSTGLQHGNM

SEQ ID NO: 24927 - protein, 28 aa, Artificial Sequence
  Description of Artificial Sequence: Synthetic peptide
DEQEIRTTNIVATECWGSVSENLQRGNR

SEQ ID NO: 24928 - protein, 30 aa, Artificial Sequence
  Description of Artificial Sequence: Synthetic polypeptide
DEEMIRTTNPVATEQYGMSVSTNPDQPGNR

SEQ ID NO: 24929 - protein, 30 aa, Artificial Sequence
  Description of Artificial Sequence: Synthetic polypeptide
DEEEIATTNPVATECYGSVSTNLQIRGFNL

SEQ ID NO: 24930 - protein, 29 aa, Artificial Sequence
  Description of Artificial Sequence: Synthetic peptide
DENEITTTNPVATEQYGEVPTNLQRGNYR

SEQ ID NO: 24931 - protein, 30 aa, Artificial Sequence
  Description of Artificial Sequence: Synthetic polypeptide
DEEEIRTTNPCASEQYGSVSATNLQQRQNR

SEQ ID NO: 24932 - protein, 30 aa, Artificial Sequence
  Description of Artificial Sequence: Synthetic polypeptide
DEEEIRTTNPVATEQYGVVSTNLQRGDEDH

SEQ ID NO: 24933 - protein, 29 aa, Artificial Sequence
  Description of Artificial Sequence: Synthetic peptide
DEQEIRTTNPVASEVYGAVSATNLQRGNR

SEQ ID NO: 24934 - protein, 28 aa, Artificial Sequence
  Description of Artificial Sequence: Synthetic peptide
GEEEIVTTNPVATETYGEVSTNLQRGNA

SEQ ID NO: 24935 - protein, 28 aa, Artificial Sequence
  Description of Artificial Sequence: Synthetic peptide
DEEEIATTNPVATEQYGYVSTNEARGNE

SEQ ID NO: 24936 - protein, 28 aa, Artificial Sequence
  Description of Artificial Sequence: Synthetic peptide
QENEIATTNPVATEQYGSVSECLQRGNR

SEQ ID NO: 24937 - protein, 28 aa, Artificial Sequence
  Description of Artificial Sequence: Synthetic peptide
DEEEIATTNPAATEQYGEVPTNLQHGNR

SEQ ID NO: 24938 - protein, 30 aa, Artificial Sequence
  Description of Artificial Sequence: Synthetic polypeptide
DEEEIRTTNPVATEQYGSVSCTDLQYGNDC

SEQ ID NO: 24939 - protein, 28 aa, Artificial Sequence
  Description of Artificial Sequence: Synthetic peptide
SEEEIRTTNPEATEQYGSVSTNLQGGDL

SEQ ID NO: 24940 - protein, 28 aa, Artificial Sequence
  Description of Artificial Sequence: Synthetic peptide
REEEIRTTNPCCSEQYGSVSTNLQRGPR

SEQ ID NO: 24941 - protein, 30 aa, Artificial Sequence
  Description of Artificial Sequence: Synthetic polypeptide
DEEEIRTTNPVATEQYGSVETNLVQEGDER

SEQ ID NO: 24942 - protein, 30 aa, Artificial Sequence
  Description of Artificial Sequence: Synthetic polypeptide
DEEEIITTNPVATEQYGVVSTNGLQERGNW

SEQ ID NO: 24943 - protein, 30 aa, Artificial Sequence
  Description of Artificial Sequence: Synthetic polypeptide
DEEEIRTTNPVATEQYGSVSCENLQCAGNA

SEQ ID NO: 24944 - protein, 29 aa, Artificial Sequence
  Description of Artificial Sequence: Synthetic peptide
DECEIRTVNPVATESYGSVSTNDQQRGNR

SEQ ID NO: 24945 - protein, 29 aa, Artificial Sequence
  Description of Artificial Sequence: Synthetic peptide
DEEEIVTTNPVGTEQYGCVSDNLQTRGNR

SEQ ID NO: 24946 - protein, 31 aa, Artificial Sequence
  Description of Artificial Sequence: Synthetic polypeptide
DEEEIVTTNPVATEQYGSVSTCNPQRKGDNR

SEQ ID NO: 24947 - protein, 31 aa, Artificial Sequence
  Description of Artificial Sequence: Synthetic polypeptide
DEEEIRTTNPDATEQYGSVSVTNLVIRGENR

SEQ ID NO: 24948 - protein, 28 aa, Artificial Sequence
  Description of Artificial Sequence: Synthetic peptide
DEEEIVTTNIVATEQYGSVSTNLQIGED

SEQ ID NO: 24949 - protein, 28 aa, Artificial Sequence
  Description of Artificial Sequence: Synthetic peptide
DEVEITTTNPVATEQYGSVSENLQTGNG

SEQ ID NO: 24950 - protein, 29 aa, Artificial Sequence
  Description of Artificial Sequence: Synthetic peptide
DEQEIRTTNPVATEQYGVASENLQRIGNR

SEQ ID NO: 24951 - protein, 28 aa, Artificial Sequence
  Description of Artificial Sequence: Synthetic peptide
KENEIRTTNPVATECYGSVSTELQRGNY

SEQ ID NO: 24952 - protein, 28 aa, Artificial Sequence
  Description of Artificial Sequence: Synthetic peptide
DEVEIRTTNPTATEQYGGVSENLQQGNR

SEQ ID NO: 24953 - protein, 28 aa, Artificial Sequence
  Description of Artificial Sequence: Synthetic peptide
DEIEIRQTNPVSTEQYGWVSTNLQHGNR

SEQ ID NO: 24954 - protein, 28 aa, Artificial Sequence
  Description of Artificial Sequence: Synthetic peptide
EEQEIRTTNPVATEQYGWTSDNLQRGNR

SEQ ID NO: 24955 - protein, 30 aa, Artificial Sequence
  Description of Artificial Sequence: Synthetic polypeptide
HEEEIRTTNPVATEQYGSVSTNLQRNANFY

SEQ ID NO: 24956 - protein, 28 aa, Artificial Sequence
  Description of Artificial Sequence: Synthetic peptide
DEEEIRCTNPVACEQYGSCSTLIQRGNR

SEQ ID NO: 24957 - protein, 31 aa, Artificial Sequence
  Description of Artificial Sequence: Synthetic polypeptide
DEEEIRTTNPEATEQYGSVSITNELQMGNWR

SEQ ID NO: 24958 - protein, 31 aa, Artificial Sequence
  Description of Artificial Sequence: Synthetic polypeptide
DEEEIRTTNPVATEQYGSVETINLPQRGDER

SEQ ID NO: 24959 - protein, 29 aa, Artificial Sequence
  Description of Artificial Sequence: Synthetic peptide
DENEIGTTNPVATEQYGSASATNLQRGGR

SEQ ID NO: 24960 - protein, 28 aa, Artificial Sequence
  Description of Artificial Sequence: Synthetic peptide
SEEEIRTTNPVSTEVYGSVSTNLQRGDT

SEQ ID NO: 24961 - protein, 31 aa, Artificial Sequence
  Description of Artificial Sequence: Synthetic polypeptide
DEEEIRTTNPVATEQYGSVSTNLEEPEGDNR

SEQ ID NO: 24962 - protein, 28 aa, Artificial Sequence
  Description of Artificial Sequence: Synthetic peptide
DEEEIRTTNPEATEQYGSVSTNDERGEF

SEQ ID NO: 24963 - protein, 29 aa, Artificial Sequence
  Description of Artificial Sequence: Synthetic peptide
DEEEIATTNPVATEQYGAVSCMNLQWGNR

SEQ ID NO: 24964 - protein, 28 aa, Artificial Sequence
  Description of Artificial Sequence: Synthetic peptide
QEQEIRTVNPVATEQYGSASTNLQRGGR

SEQ ID NO: 24965 - protein, 28 aa, Artificial Sequence
  Description of Artificial Sequence: Synthetic peptide
DEEEIVTTNPVATEQYGSVPTCLQHGNM

SEQ ID NO: 24966 - protein, 28 aa, Artificial Sequence
  Description of Artificial Sequence: Synthetic peptide
DEQEIRCTNPVASEVYGAVSTNLQRGNR

SEQ ID NO: 24967 - protein, 31 aa, Artificial Sequence
  Description of Artificial Sequence: Synthetic polypeptide
DEEEIRTTNPVATEQYGSVDTNLMLRNGNDR

SEQ ID NO: 24968 - protein, 29 aa, Artificial Sequence
  Description of Artificial Sequence: Synthetic peptide
SEEEICTCNPVATEQYGSVSTDLQRGNDR

SEQ ID NO: 24969 - protein, 30 aa, Artificial Sequence
  Description of Artificial Sequence: Synthetic polypeptide
DEEEIRTTNPVATCQYGSHVSTNLQEGDNP

SEQ ID NO: 24970 - protein, 28 aa, Artificial Sequence
  Description of Artificial Sequence: Synthetic peptide
DEQEIRTTNPVGTEQYGSVSTALQRMNV

SEQ ID NO: 24971 - protein, 30 aa, Artificial Sequence
  Description of Artificial Sequence: Synthetic polypeptide
DTEEIRTTNPVAAFQYGSVSTMNLQREGNR

SEQ ID NO: 24972 - protein, 29 aa, Artificial Sequence
  Description of Artificial Sequence: Synthetic peptide
DPEEIRTTNPVATECYGSVSDTPDQRGNR

SEQ ID NO: 24973 - protein, 29 aa, Artificial Sequence
  Description of Artificial Sequence: Synthetic peptide
QEEEIVTTNPTATEQYGSVSTNLQEGGNR

SEQ ID NO: 24974 - protein, 28 aa, Artificial Sequence
  Description of Artificial Sequence: Synthetic peptide
DEEEIACTNPVATEIYGSVSTNLDRGND

SEQ ID NO: 24975 - protein, 30 aa, Artificial Sequence
  Description of Artificial Sequence: Synthetic polypeptide
DEEEIRTTNPVATEQYGSVSTDLQSEGENI

SEQ ID NO: 24976 - protein, 31 aa, Artificial Sequence
  Description of Artificial Sequence: Synthetic polypeptide
DEECIRTTNPVATEQYGESVSETNLQREGNP

SEQ ID NO: 24977 - protein, 28 aa, Artificial Sequence
  Description of Artificial Sequence: Synthetic peptide
DEEEIRTTNPEATEQYGSVSTNLEREEN

SEQ ID NO: 24978 - protein, 28 aa, Artificial Sequence
  Description of Artificial Sequence: Synthetic peptide
DEEEIRTTNPDATEQYGSVSTCPNRGER

SEQ ID NO: 24979 - protein, 29 aa, Artificial Sequence
  Description of Artificial Sequence: Synthetic peptide
DEEEIRTTNPVATEQYGEVSEVLQRAGER

SEQ ID NO: 24980 - protein, 31 aa, Artificial Sequence
  Description of Artificial Sequence: Synthetic polypeptide
DEEEIRTTNPVATEQYGSVDSETNLEDDGNR

SEQ ID NO: 24981 - protein, 28 aa, Artificial Sequence
  Description of Artificial Sequence: Synthetic peptide
DEEEIRTTNPVATEQYGDVSENEMRGNW

SEQ ID NO: 24982 - protein, 30 aa, Artificial Sequence
  Description of Artificial Sequence: Synthetic polypeptide
DEEEIRTTNPVATQQWGSVSNNPLQRNGNR

SEQ ID NO: 24983 - protein, 28 aa, Artificial Sequence
  Description of Artificial Sequence: Synthetic peptide
DEDEIRTTNPEATECFGSVSTNLQRGLR

SEQ ID NO: 24984 - protein, 28 aa, Artificial Sequence
  Description of Artificial Sequence: Synthetic peptide
DEEEIRTTNPFATEQYGSVSTDLEVGND

SEQ ID NO: 24985 - protein, 28 aa, Artificial Sequence
  Description of Artificial Sequence: Synthetic peptide
DEQEIRTVNPVATEVYGVVSMNLQRGNR

SEQ ID NO: 24986 - protein, 28 aa, Artificial Sequence
  Description of Artificial Sequence: Synthetic peptide
DEEEIRTTNPDATEQYGYVSTMLQGGVR

SEQ ID NO: 24987 - protein, 28 aa, Artificial Sequence
  Description of Artificial Sequence: Synthetic peptide
DEEEIRTTNPFATEQYGSVSDALQMGNE

SEQ ID NO: 24988 - protein, 30 aa, Artificial Sequence
  Description of Artificial Sequence: Synthetic polypeptide
QESEIATTNPVATEQYGSVSCTNLQRAGNR

SEQ ID NO: 24989 - protein, 28 aa, Artificial Sequence
  Description of Artificial Sequence: Synthetic peptide
DEQEVRCTNPVATEQYGSVAMNLQRGNR

SEQ ID NO: 24990 - protein, 29 aa, Artificial Sequence
  Description of Artificial Sequence: Synthetic peptide
DEEEIAATNPTATEQYGSVSTNPQREGNR

SEQ ID NO: 24991 - protein, 28 aa, Artificial Sequence
  Description of Artificial Sequence: Synthetic peptide
SEEEIRTTNPAATEQYGSVSTNPQIGNF

SEQ ID NO: 24992 - protein, 28 aa, Artificial Sequence
  Description of Artificial Sequence: Synthetic peptide
DEEEITTTNPTATEQYGEVSENLQRGTR

SEQ ID NO: 24993 - protein, 28 aa, Artificial Sequence
  Description of Artificial Sequence: Synthetic peptide
SEEEIRTTNPAATEQFGSVSTNPQFGNR

SEQ ID NO: 24994 - protein, 31 aa, Artificial Sequence
  Description of Artificial Sequence: Synthetic polypeptide
DEEEIRTTNPVATEQYGSVEETNLVQRGNEP

SEQ ID NO: 24995 - protein, 29 aa, Artificial Sequence
  Description of Artificial Sequence: Synthetic peptide
DEEEIRTTNPVATEQFGEVSYMLQRGANR

SEQ ID NO: 24996 - protein, 29 aa, Artificial Sequence
  Description of Artificial Sequence: Synthetic peptide
DEVEIRTTNPVATEQYGYVSTNLQFGINF

SEQ ID NO: 24997 - protein, 29 aa, Artificial Sequence
  Description of Artificial Sequence: Synthetic peptide
DEGEIKTTNPVATETYGSVSENLQQRGNR

SEQ ID NO: 24998 - protein, 28 aa, Artificial Sequence
  Description of Artificial Sequence: Synthetic peptide
SEVEIRATNPVATEQYGSVSTNEQRGNF

SEQ ID NO: 24999 - protein, 28 aa, Artificial Sequence
  Description of Artificial Sequence: Synthetic peptide
DEQEIRCTNPIASEIYGSVSTNLQRGNR

SEQ ID NO: 25000 - protein, 31 aa, Artificial Sequence
  Description of Artificial Sequence: Synthetic polypeptide
DEEEIRTTNPVATEQYGSVDSTNDQEPGNDR

SEQ ID NO: 25001 - protein, 30 aa, Artificial Sequence
  Description of Artificial Sequence: Synthetic polypeptide
DEEEIRTTNPDATEQYGSVSTLNEQRGNPI

SEQ ID NO: 25002 - protein, 28 aa, Artificial Sequence
  Description of Artificial Sequence: Synthetic peptide
DEEEIRTTNPVATQQYGSVSTPLQREEP

SEQ ID NO: 25003 - protein, 28 aa, Artificial Sequence
  Description of Artificial Sequence: Synthetic peptide
DEEEIRTTNPVASEQYGSCATNLQMGDR

SEQ ID NO: 25004 - protein, 28 aa, Artificial Sequence
  Description of Artificial Sequence: Synthetic peptide
AEEEIRTVNPVSTEHYGNVSTNLQRGNR

SEQ ID NO: 25005 - protein, 28 aa, Artificial Sequence
  Description of Artificial Sequence: Synthetic peptide
QEQEIRTVNPVATEQYGIVSTNLQYGNR

SEQ ID NO: 25006 - protein, 29 aa, Artificial Sequence
  Description of Artificial Sequence: Synthetic peptide
DEEEIRSTNPDATEIYGSVSTDLQRGDNR

SEQ ID NO: 25007 - protein, 28 aa, Artificial Sequence
  Description of Artificial Sequence: Synthetic peptide
DPEEIRTTNPVATEQYGMASTELQRGND

SEQ ID NO: 25008 - protein, 28 aa, Artificial Sequence
  Description of Artificial Sequence: Synthetic peptide
MENEIRATNPVATEQYGSVSTNLQAGNM

SEQ ID NO: 25009 - protein, 31 aa, Artificial Sequence
  Description of Artificial Sequence: Synthetic polypeptide
DEEEIRTTNPVATEQYGSVDSETDLQNGDNR

SEQ ID NO: 25010 - protein, 30 aa, Artificial Sequence
  Description of Artificial Sequence: Synthetic polypeptide
DEEEIRGTNPVATEQYGSVSGTSGLQRGNP

SEQ ID NO: 25011 - protein, 32 aa, Artificial Sequence
  Description of Artificial Sequence: Synthetic polypeptide
DEEEIHTTNPVATEQYGSCVASTNLQERGNDR

SEQ ID NO: 25012 - protein, 30 aa, Artificial Sequence
  Description of Artificial Sequence: Synthetic polypeptide
DEQEIRCTNPVASEQYGSVSATNLQRNGNR

SEQ ID NO: 25013 - protein, 28 aa, Artificial Sequence
  Description of Artificial Sequence: Synthetic peptide
DENEIRTTNIVATECYGSVSDNLQRGER

SEQ ID NO: 25014 - protein, 28 aa, Artificial Sequence
  Description of Artificial Sequence: Synthetic peptide
DEEEIRTTNPYATEQYGSVSTDLGPGNL

SEQ ID NO: 25015 - protein, 28 aa, Artificial Sequence
  Description of Artificial Sequence: Synthetic peptide
NEEEIRATNPIATEMYGSVATNLQRGNR

SEQ ID NO: 25016 - protein, 31 aa, Artificial Sequence
  Description of Artificial Sequence: Synthetic polypeptide
DEEEIRTTNPVATEQYGSVESTNPLQPGDNP

SEQ ID NO: 25017 - protein, 28 aa, Artificial Sequence
  Description of Artificial Sequence: Synthetic peptide
DEDELRTTNPTATEQYGIVSENLQRGNR

SEQ ID NO: 25018 - protein, 28 aa, Artificial Sequence
  Description of Artificial Sequence: Synthetic peptide
DEVEIRTTNPTSTEQYGSLSTNLQRGNI

SEQ ID NO: 25019 - protein, 29 aa, Artificial Sequence
  Description of Artificial Sequence: Synthetic peptide
DEEEIRTTNPVASEQYGAVSCTLQRAGNR

SEQ ID NO: 25020 - protein, 32 aa, Artificial Sequence
  Description of Artificial Sequence: Synthetic polypeptide
DEEEIRTTNPVATEQYGSVCSTVNLVLRGTNR

SEQ ID NO: 25021 - protein, 30 aa, Artificial Sequence
  Description of Artificial Sequence: Synthetic polypeptide
DEEEIRTTNPVATEQYGSVSTNHQQDPGNV

SEQ ID NO: 25022 - protein, 30 aa, Artificial Sequence
  Description of Artificial Sequence: Synthetic polypeptide
DEEEIRTTNPVATEQYGSVSITCDLDRGNV

SEQ ID NO: 25023 - protein, 29 aa, Artificial Sequence
  Description of Artificial Sequence: Synthetic peptide
DEEELRTTNPVATEQFGVVSTNLERKGNR

SEQ ID NO: 25024 - protein, 28 aa, Artificial Sequence
  Description of Artificial Sequence: Synthetic peptide
DEEEIRTTNPVAWEQCGSVSTNDCRGND

SEQ ID NO: 25025 - protein, 30 aa, Artificial Sequence
  Description of Artificial Sequence: Synthetic polypeptide
DEEEVRTTNPVATEQYGSVSDLNLQSKGNR

SEQ ID NO: 25026 - protein, 30 aa, Artificial Sequence
  Description of Artificial Sequence: Synthetic polypeptide
DEQEIRTTNPVSTEQYGSVGATNLQRNGNR

SEQ ID NO: 25027 - protein, 28 aa, Artificial Sequence
  Description of Artificial Sequence: Synthetic peptide
DEMEIRTTNPVATEQYGSVSDILQRNQR

SEQ ID NO: 25028 - protein, 28 aa, Artificial Sequence
  Description of Artificial Sequence: Synthetic peptide
DEEEIYTTNIVATEQYGSVQTNLQRGDC

SEQ ID NO: 25029 - protein, 28 aa, Artificial Sequence
  Description of Artificial Sequence: Synthetic peptide
KEEEIRTTNPCATEQYGGVSANIQRGNR

SEQ ID NO: 25030 - protein, 28 aa, Artificial Sequence
  Description of Artificial Sequence: Synthetic peptide
DENEIRTTNPVATEWYGWVSTNLQHGNM

SEQ ID NO: 25031 - protein, 28 aa, Artificial Sequence
  Description of Artificial Sequence: Synthetic peptide
DEQEIRCTNPVASELYGAVSTNLQRGNR

SEQ ID NO: 25032 - protein, 28 aa, Artificial Sequence
  Description of Artificial Sequence: Synthetic peptide
KENEIRTTNPVATECYGSVSTNLQTGNL

SEQ ID NO: 25033 - protein, 32 aa, Artificial Sequence
  Description of Artificial Sequence: Synthetic polypeptide
DEEEIRTTNPVATEQYGSVSITNPVQDRKGNR

SEQ ID NO: 25034 - protein, 28 aa, Artificial Sequence
  Description of Artificial Sequence: Synthetic peptide
DEEEIATTNIVATEQYGSVSNVLQRGGR

SEQ ID NO: 25035 - protein, 30 aa, Artificial Sequence
  Description of Artificial Sequence: Synthetic polypeptide
DEEEIRTTNPVATEMYGSVSTNLQETEGNF

SEQ ID NO: 25036 - protein, 31 aa, Artificial Sequence
  Description of Artificial Sequence: Synthetic polypeptide
DEQEIRTTNPVATEQYGSVDSTNLEEREGNR

SEQ ID NO: 25037 - protein, 28 aa, Artificial Sequence
  Description of Artificial Sequence: Synthetic peptide
DEESIRATNPTATHQYGSVSTNLDRGNR

SEQ ID NO: 25038 - protein, 28 aa, Artificial Sequence
  Description of Artificial Sequence: Synthetic peptide
SEEEIKTTNPVATEQYGSVSNNLERLNR

SEQ ID NO: 25039 - protein, 30 aa, Artificial Sequence
  Description of Artificial Sequence: Synthetic polypeptide
DEEEVRTTNPVATEQYGSVSDTDLQRGNDF

SEQ ID NO: 25040 - protein, 28 aa, Artificial Sequence
  Description of Artificial Sequence: Synthetic peptide
DDMEIRTTNPVSTEQYGVVSTNLQRLNR

SEQ ID NO: 25041 - protein, 28 aa, Artificial Sequence
  Description of Artificial Sequence: Synthetic peptide
DEGEIRTTNPVATEQYGSVQTALIRMNR

SEQ ID NO: 25042 - protein, 28 aa, Artificial Sequence
  Description of Artificial Sequence: Synthetic peptide
QEEEIMTTNPVATEQFGCVSTNWQRGNR

SEQ ID NO: 25043 - protein, 28 aa, Artificial Sequence
  Description of Artificial Sequence: Synthetic peptide
KENEIRTTNPVATEQYGSVSTDLQGGNM

SEQ ID NO: 25044 - protein, 29 aa, Artificial Sequence
  Description of Artificial Sequence: Synthetic peptide
SENEIRTTNPVATEIYGSVISTNLQRGDR

SEQ ID NO: 25045 - protein, 28 aa, Artificial Sequence
  Description of Artificial Sequence: Synthetic peptide
DEQEIRTTNPVSTEHYGGVSENLQRGNR

SEQ ID NO: 25046 - protein, 29 aa, Artificial Sequence
  Description of Artificial Sequence: Synthetic peptide
DEEEIRTVNPVATEVYGSASAENLQRGNR

SEQ ID NO: 25047 - protein, 30 aa, Artificial Sequence
  Description of Artificial Sequence: Synthetic polypeptide
QEEEIRTTNPVATEQYGSVSTCNLQERPMR

SEQ ID NO: 25048 - protein, 28 aa, Artificial Sequence
  Description of Artificial Sequence: Synthetic peptide
DEEEIRCTNPVATELYGSVANNLQRGTR

SEQ ID NO: 25049 - protein, 31 aa, Artificial Sequence
  Description of Artificial Sequence: Synthetic polypeptide
DEEEIATTNPVATEQYGSVDTNPLVQRGDNR

SEQ ID NO: 25050 - protein, 29 aa, Artificial Sequence
  Description of Artificial Sequence: Synthetic peptide
DEEEIRCTNPVASEMYGCVSATNLQRGNR

SEQ ID NO: 25051 - protein, 30 aa, Artificial Sequence
  Description of Artificial Sequence: Synthetic polypeptide
DEECIRTTNPVATEQYWSVSETPLQRGDNR

SEQ ID NO: 25052 - protein, 28 aa, Artificial Sequence
  Description of Artificial Sequence: Synthetic peptide
DDEEIRTVNPVATEIWGQVSTNLQRGNR

SEQ ID NO: 25053 - protein, 30 aa, Artificial Sequence
  Description of Artificial Sequence: Synthetic polypeptide
DEEEIRTTNPVCTEQYGSVSTNLQQHAGNC

SEQ ID NO: 25054 - protein, 28 aa, Artificial Sequence
  Description of Artificial Sequence: Synthetic peptide
DEEEIRTTNPDAYQQYGSVSTNDQRGNP

SEQ ID NO: 25055 - protein, 30 aa, Artificial Sequence
  Description of Artificial Sequence: Synthetic polypeptide
DEEPIRTTNPFATEQYGSVSITNGLIRGNR

SEQ ID NO: 25056 - protein, 28 aa, Artificial Sequence
  Description of Artificial Sequence: Synthetic peptide
DEEEIRTTNPVATEQYGDVSEDLQYGNF

SEQ ID NO: 25057 - protein, 28 aa, Artificial Sequence
  Description of Artificial Sequence: Synthetic peptide
DEEEIRTTNPDSTEQYGSVSTNPQFGNG

SEQ ID NO: 25058 - protein, 28 aa, Artificial Sequence
  Description of Artificial Sequence: Synthetic peptide
DEEEIRTTNPCATEQYGSVDTDLQYGNA

SEQ ID NO: 25059 - protein, 30 aa, Artificial Sequence
  Description of Artificial Sequence: Synthetic polypeptide
DEQEIRTTNPVATEQYGSWSENPLQREGNR

SEQ ID NO: 25060 - protein, 28 aa, Artificial Sequence
  Description of Artificial Sequence: Synthetic peptide
DEEEIRQTNPVATEQYGSASENLQYGNT

SEQ ID NO: 25061 - protein, 30 aa, Artificial Sequence
  Description of Artificial Sequence: Synthetic polypeptide
DEEEIRTTNPVAYWQYGSVDCTNLQMRGNR

SEQ ID NO: 25062 - protein, 29 aa, Artificial Sequence
  Description of Artificial Sequence: Synthetic peptide
DEEEINSTNPVATEQYGSCVSFELQRGNR

SEQ ID NO: 25063 - protein, 30 aa, Artificial Sequence
  Description of Artificial Sequence: Synthetic polypeptide
DEEEIRTTNPVATEQYGSVFENCLQTKGNR

SEQ ID NO: 25064 - protein, 32 aa, Artificial Sequence
  Description of Artificial Sequence: Synthetic polypeptide
DEEEIRTTNPVATEQYGSVESTNPLTQREGND

SEQ ID NO: 25065 - protein, 30 aa, Artificial Sequence
  Description of Artificial Sequence: Synthetic polypeptide
DEEEIRTTNPTATEQYGSVSTMNEQQGDNR

SEQ ID NO: 25066 - protein, 31 aa, Artificial Sequence
  Description of Artificial Sequence: Synthetic polypeptide
DEEEIRTTNPTATEQYGSVSTMNLQQEGNTR

SEQ ID NO: 25067 - protein, 29 aa, Artificial Sequence
  Description of Artificial Sequence: Synthetic peptide
DEEEIVTTNPVATEQYGSVSGDNLQREER

SEQ ID NO: 25068 - protein, 29 aa, Artificial Sequence
  Description of Artificial Sequence: Synthetic peptide
DEEAIRTTNPQATEQYGSHSETNLQRPNR

SEQ ID NO: 25069 - protein, 28 aa, Artificial Sequence
  Description of Artificial Sequence: Synthetic peptide
DEQEIRTTNPEATEQYGSVSTNLQHEER

SEQ ID NO: 25070 - protein, 30 aa, Artificial Sequence
  Description of Artificial Sequence: Synthetic polypeptide
DEEEIRTTNPVATEQYGSVSCENLQCMGNA

SEQ ID NO: 25071 - protein, 30 aa, Artificial Sequence
  Description of Artificial Sequence: Synthetic polypeptide
DEEEIRQTNPVSTEQYGSVSTVNNLQRGER

SEQ ID NO: 25072 - protein, 28 aa, Artificial Sequence
  Description of Artificial Sequence: Synthetic peptide
DHEEIRTTNPVATEQYGSVSTNDDPGNP

SEQ ID NO: 25073 - protein, 30 aa, Artificial Sequence
  Description of Artificial Sequence: Synthetic polypeptide
DEEEIMPTNPVATEQYGSVSTNPQRGDNPR

SEQ ID NO: 25074 - protein, 29 aa, Artificial Sequence
  Description of Artificial Sequence: Synthetic peptide
DEEEIRTTNPVATEQYGSWSTNLNEGNEN

SEQ ID NO: 25075 - protein, 28 aa, Artificial Sequence
  Description of Artificial Sequence: Synthetic peptide
DEQEIRTTNPEATEQYGSVSTNDQRGEF

SEQ ID NO: 25076 - protein, 28 aa, Artificial Sequence
  Description of Artificial Sequence: Synthetic peptide
DEEEIRTTNPTATEQFGSVSENPQRGTR

SEQ ID NO: 25077 - protein, 31 aa, Artificial Sequence
  Description of Artificial Sequence: Synthetic polypeptide
DEEEIRTTNPVATEQYGSVSTTNNDQVRGNF

SEQ ID NO: 25078 - protein, 29 aa, Artificial Sequence
  Description of Artificial Sequence: Synthetic peptide
QEEEIRTTNPVATEFFGSVSTNEQRGDNR

SEQ ID NO: 25079 - protein, 28 aa, Artificial Sequence
  Description of Artificial Sequence: Synthetic peptide
DDEEIRTTNPVASEQYGEVSEELQRGNR

SEQ ID NO: 25080 - protein, 30 aa, Artificial Sequence
  Description of Artificial Sequence: Synthetic polypeptide
DEEEIRTTNPVATEQYGSVSTCPLVQHENR

SEQ ID NO: 25081 - protein, 28 aa, Artificial Sequence
  Description of Artificial Sequence: Synthetic peptide
DEEEIRCTNPVSTETYGNVATNLQRGNR

SEQ ID NO: 25082 - protein, 29 aa, Artificial Sequence
  Description of Artificial Sequence: Synthetic peptide
DEEEIRCTNPVASEQYGCVSMNLQRNGNR

SEQ ID NO: 25083 - protein, 28 aa, Artificial Sequence
  Description of Artificial Sequence: Synthetic peptide
DDTEIRTTNPVATEQYGSVSENLDRGTR

SEQ ID NO: 25084 - protein, 28 aa, Artificial Sequence
  Description of Artificial Sequence: Synthetic peptide
SEEEIRTTNPDATEQYGSVSTGPQRGER

SEQ ID NO: 25085 - protein, 28 aa, Artificial Sequence
  Description of Artificial Sequence: Synthetic peptide
DEEEIRTTNPEATEQYGSVSENLIAGNH

SEQ ID NO: 25086 - protein, 28 aa, Artificial Sequence
  Description of Artificial Sequence: Synthetic peptide
DENEIRCTNPVGTEQYGSVSTNLERGND

SEQ ID NO: 25087 - protein, 30 aa, Artificial Sequence
  Description of Artificial Sequence: Synthetic polypeptide
DEEEIRTTNPCATEQYGSVDDNNLQRGENR

SEQ ID NO: 25088 - protein, 28 aa, Artificial Sequence
  Description of Artificial Sequence: Synthetic peptide
DEEEIRTTNPVATTQYGHVSTNLETGMR

SEQ ID NO: 25089 - protein, 31 aa, Artificial Sequence
  Description of Artificial Sequence: Synthetic polypeptide
DEEEIRTTNPVATEQYGSVPCTNLQHKGNDR

SEQ ID NO: 25090 - protein, 28 aa, Artificial Sequence
  Description of Artificial Sequence: Synthetic peptide
DEEIIRTTNPVATNIYGSVWTNDQRGNR

SEQ ID NO: 25091 - protein, 30 aa, Artificial Sequence
  Description of Artificial Sequence: Synthetic polypeptide
DEEEIRTTNPVSTEQYGSVSCTNNEQMGNR

SEQ ID NO: 25092 - protein, 30 aa, Artificial Sequence
  Description of Artificial Sequence: Synthetic polypeptide
DEEEIRTTNPVATEQYGSVESDTNLDPGNP

SEQ ID NO: 25093 - protein, 28 aa, Artificial Sequence
  Description of Artificial Sequence: Synthetic peptide
DEEEIRTTNPCATEQYGSVSTEDCRGNH

SEQ ID NO: 25094 - protein, 30 aa, Artificial Sequence
  Description of Artificial Sequence: Synthetic polypeptide
DENEIRTTNPVATEQYGSVSDFFLLQRGNR

SEQ ID NO: 25095 - protein, 28 aa, Artificial Sequence
  Description of Artificial Sequence: Synthetic peptide
DEGEIRTTNPVATEWYGWVSCNLQRPNR

SEQ ID NO: 25096 - protein, 28 aa, Artificial Sequence
  Description of Artificial Sequence: Synthetic peptide
DEEEIRTTNIVATEIYGSVSTGLQQGQR

SEQ ID NO: 25097 - protein, 30 aa, Artificial Sequence
  Description of Artificial Sequence: Synthetic polypeptide
DEEEIRTTNPVATEQYGSVSTHDLQPMGNG

SEQ ID NO: 25098 - protein, 28 aa, Artificial Sequence
  Description of Artificial Sequence: Synthetic peptide
DEEEIRTTNPHATEQYGSVHTGEMRGNR

SEQ ID NO: 25099 - protein, 29 aa, Artificial Sequence
  Description of Artificial Sequence: Synthetic peptide
DEGEIRTTNPVATECFGGVSTNLQRGDNR

SEQ ID NO: 25100 - protein, 29 aa, Artificial Sequence
  Description of Artificial Sequence: Synthetic peptide
DEEEIRTTNPIATEWYGCVSTNLQFRGND

SEQ ID NO: 25101 - protein, 28 aa, Artificial Sequence
  Description of Artificial Sequence: Synthetic peptide
DENEIRTTNIVATEQYGSVSDNLQVGER

SEQ ID NO: 25102 - protein, 30 aa, Artificial Sequence
  Description of Artificial Sequence: Synthetic polypeptide
DEEEITTTNPVATEQYGSVSTNGIQLRGNV

SEQ ID NO: 25103 - protein, 28 aa, Artificial Sequence
  Description of Artificial Sequence: Synthetic peptide
DEQEIRCTNPVASEVYGCVSTNLQRGNR

SEQ ID NO: 25104 - protein, 29 aa, Artificial Sequence
  Description of Artificial Sequence: Synthetic peptide
DEEEIAQTNPVATEQYGSVSTNLMRAGQR

SEQ ID NO: 25105 - protein, 30 aa, Artificial Sequence
  Description of Artificial Sequence: Synthetic polypeptide
DEQEIRATNPVASEQYGSVSATNLQRNGNR

SEQ ID NO: 25106 - protein, 29 aa, Artificial Sequence
  Description of Artificial Sequence: Synthetic peptide
DEEEIRTTNPVGTEGWGSVDTNLQTRGNR

SEQ ID NO: 25107 - protein, 31 aa, Artificial Sequence
  Description of Artificial Sequence: Synthetic polypeptide
DEEEIRTTNPVATEQYGSVTSLTPGLLRGNR

SEQ ID NO: 25108 - protein, 28 aa, Artificial Sequence
  Description of Artificial Sequence: Synthetic peptide
KEEEIRTTNPCATEQYGDVSTNEQRENR

SEQ ID NO: 25109 - protein, 28 aa, Artificial Sequence
  Description of Artificial Sequence: Synthetic peptide
DEEEIRTTNPVASEVYGSVGTNLQREPR

SEQ ID NO: 25110 - protein, 28 aa, Artificial Sequence
  Description of Artificial Sequence: Synthetic peptide
DEEEIRTTNPVATEQYWSWSTNLQNGEW

SEQ ID NO: 25111 - protein, 30 aa, Artificial Sequence
  Description of Artificial Sequence: Synthetic polypeptide
DEQEIATTNPVATEQYGSVSTNLCCRGNDR

SEQ ID NO: 25112 - protein, 32 aa, Artificial Sequence
  Description of Artificial Sequence: Synthetic polypeptide
DEEEIRTTNPVATEQYGSVESETLNLVQRGNQ

SEQ ID NO: 25113 - protein, 30 aa, Artificial Sequence
  Description of Artificial Sequence: Synthetic polypeptide
DEEEIRTTNPLATEQFGSVSTGNLQEQGNR

SEQ ID NO: 25114 - protein, 31 aa, Artificial Sequence
  Description of Artificial Sequence: Synthetic polypeptide
DEIEIRTTNPVATEQYGSVTSTNLQLHGANR

SEQ ID NO: 25115 - protein, 29 aa, Artificial Sequence
  Description of Artificial Sequence: Synthetic peptide
DENEIRQTNPVATEQYGEVSAENLQRGNR

SEQ ID NO: 25116 - protein, 28 aa, Artificial Sequence
  Description of Artificial Sequence: Synthetic peptide
DEEEIRTTNPEATEQYGSVSTAEQWGNQ

SEQ ID NO: 25117 - protein, 29 aa, Artificial Sequence
  Description of Artificial Sequence: Synthetic peptide
MEEEIRTTNPVATEQYGSVSENLQTEGNM

SEQ ID NO: 25118 - protein, 30 aa, Artificial Sequence
  Description of Artificial Sequence: Synthetic polypeptide
DEGEIRTTNPVATEQYGSVEESNLQRTGNR

SEQ ID NO: 25119 - protein, 30 aa, Artificial Sequence
  Description of Artificial Sequence: Synthetic polypeptide
DEEEIRTTNPVASECYGSVSTNLQREGNDD

SEQ ID NO: 25120 - protein, 31 aa, Artificial Sequence
  Description of Artificial Sequence: Synthetic polypeptide
DEEEIRTTNPVATEQYGSVSTCNEQDQGNDR

SEQ ID NO: 25121 - protein, 29 aa, Artificial Sequence
  Description of Artificial Sequence: Synthetic peptide
DEEEIAQTNPVATEQYGWVSVTNDQRGNR

SEQ ID NO: 25122 - protein, 30 aa, Artificial Sequence
  Description of Artificial Sequence: Synthetic polypeptide
QEEEIRTTNPVATEQYGSASTNLCCRGNDR

SEQ ID NO: 25123 - protein, 28 aa, Artificial Sequence
  Description of Artificial Sequence: Synthetic peptide
DEEEIRQTNPVATEQYGSWSTGLERGND

SEQ ID NO: 25124 - protein, 29 aa, Artificial Sequence
  Description of Artificial Sequence: Synthetic peptide
DEEEIRTTNPVATELWGSVSTNEQIRGNS

SEQ ID NO: 25125 - protein, 28 aa, Artificial Sequence
  Description of Artificial Sequence: Synthetic peptide
DEEEIRTTNPEATEHYGSVSTNLQLGDF

SEQ ID NO: 25126 - protein, 28 aa, Artificial Sequence
  Description of Artificial Sequence: Synthetic peptide
DEEEITTTNPVCTEQYGWVSDNLQSGNR

SEQ ID NO: 25127 - protein, 30 aa, Artificial Sequence
  Description of Artificial Sequence: Synthetic polypeptide
DEEEIRPTNPVATEQYGSYWHTNLQRGDNR

SEQ ID NO: 25128 - protein, 28 aa, Artificial Sequence
  Description of Artificial Sequence: Synthetic peptide
DEEEIRAVNPVATEQYGSVSTNLQFGEV

SEQ ID NO: 25129 - protein, 28 aa, Artificial Sequence
  Description of Artificial Sequence: Synthetic peptide
DEVEIATTNPTATEQYGSVSTNEQNGNR

SEQ ID NO: 25130 - protein, 28 aa, Artificial Sequence
  Description of Artificial Sequence: Synthetic peptide
DEVEIRTTNPVATELYGWVSTNLQTGNF

SEQ ID NO: 25131 - protein, 30 aa, Artificial Sequence
  Description of Artificial Sequence: Synthetic polypeptide
DEEEIRSTNPVATEIYGSVGTNLQLRGENR

SEQ ID NO: 25132 - protein, 32 aa, Artificial Sequence
  Description of Artificial Sequence: Synthetic polypeptide
DEEEIRTTNPVATEQYGSVMSYLNLPQHRGNR

SEQ ID NO: 25133 - protein, 33 aa, Artificial Sequence
  Description of Artificial Sequence: Synthetic polypeptide
DEEEIRTTNPVATEQYGESVDSETNLQERGENR

SEQ ID NO: 25134 - protein, 28 aa, Artificial Sequence
  Description of Artificial Sequence: Synthetic peptide
KEIEIRTTNPVATEQYGSVSTELQAGNM

SEQ ID NO: 25135 - protein, 28 aa, Artificial Sequence
  Description of Artificial Sequence: Synthetic peptide
DEEEIRTTNPVSSEHYGATSTNLQRGNR

SEQ ID NO: 25136 - protein, 30 aa, Artificial Sequence
  Description of Artificial Sequence: Synthetic polypeptide
DEEEIRTTNPVATEQYGSVSTDLQQNGNDL

SEQ ID NO: 25137 - protein, 30 aa, Artificial Sequence
  Description of Artificial Sequence: Synthetic polypeptide
DAEEIRSTNPVATEQYGSVSTNLQARNGQR

SEQ ID NO: 25138 - protein, 28 aa, Artificial Sequence
  Description of Artificial Sequence: Synthetic peptide
DEQEIAQTNPVATEIYGWVSTNLQRGNR

SEQ ID NO: 25139 - protein, 28 aa, Artificial Sequence
  Description of Artificial Sequence: Synthetic peptide
AEEEIRTTNPEATEQYGSVSTPLERGND

SEQ ID NO: 25140 - protein, 32 aa, Artificial Sequence
  Description of Artificial Sequence: Synthetic polypeptide
DEEEIRTTNPVATEQYGSSVSTNLPQWNGNIR

SEQ ID NO: 25141 - protein, 30 aa, Artificial Sequence
  Description of Artificial Sequence: Synthetic polypeptide
DEECIRTTNPVATQQYGSVTSTGLQRNGNR

SEQ ID NO: 25142 - protein, 30 aa, Artificial Sequence
  Description of Artificial Sequence: Synthetic polypeptide
DEEEIRTTNPVATEIYGSVSTNLQDVGNDM

SEQ ID NO: 25143 - protein, 28 aa, Artificial Sequence
  Description of Artificial Sequence: Synthetic peptide
DEEEINTTNIVATCQYGSVSTVLGRGNR

SEQ ID NO: 25144 - protein, 28 aa, Artificial Sequence
  Description of Artificial Sequence: Synthetic peptide
DEQEVCTTNPDATEQYGSVSTNLQRGER

SEQ ID NO: 25145 - protein, 31 aa, Artificial Sequence
  Description of Artificial Sequence: Synthetic polypeptide
DENEIRTTNPCATEQYGSVSCTMNLQRNGNR

SEQ ID NO: 25146 - protein, 28 aa, Artificial Sequence
  Description of Artificial Sequence: Synthetic peptide
DEEEIRTTNPCATEQYGDVSTDLERGNT

SEQ ID NO: 25147 - protein, 28 aa, Artificial Sequence
  Description of Artificial Sequence: Synthetic peptide
DEEGIRTTNPVSTEQYGSVDTNDQRGNA

SEQ ID NO: 25148 - protein, 30 aa, Artificial Sequence
  Description of Artificial Sequence: Synthetic polypeptide
DEEEIRTTNPVATEIYGFSVASTNLDHGNR

SEQ ID NO: 25149 - protein, 29 aa, Artificial Sequence
  Description of Artificial Sequence: Synthetic peptide
DEEEIRTTNPVATELWGSVSTNLQIQGNQ

SEQ ID NO: 25150 - protein, 28 aa, Artificial Sequence
  Description of Artificial Sequence: Synthetic peptide
DEGAIRTTNPVATEQYGSFSTNLIIGNR

SEQ ID NO: 25151 - protein, 30 aa, Artificial Sequence
  Description of Artificial Sequence: Synthetic polypeptide
DEEEIRTTNPVATEQYGSVSCTEDLERGNE

SEQ ID NO: 25152 - protein, 30 aa, Artificial Sequence
  Description of Artificial Sequence: Synthetic polypeptide
DEEEIRTTNPDATEQYGSISDTNLDLRGNR

SEQ ID NO: 25153 - protein, 28 aa, Artificial Sequence
  Description of Artificial Sequence: Synthetic peptide
DEEEIRQTNPVATEQYGEASDNLQRGGR

SEQ ID NO: 25154 - protein, 28 aa, Artificial Sequence
  Description of Artificial Sequence: Synthetic peptide
DEEEIRTTNPVATEQYGSVFENLCHGNC

SEQ ID NO: 25155 - protein, 31 aa, Artificial Sequence
  Description of Artificial Sequence: Synthetic polypeptide
DEMEIRTTNPVATEQYGSVTSTVNLQLRGNF

SEQ ID NO: 25156 - protein, 31 aa, Artificial Sequence
  Description of Artificial Sequence: Synthetic polypeptide
SEEEIRTTNPVATEQYGSVSTNGLQDRGDNN

SEQ ID NO: 25157 - protein, 29 aa, Artificial Sequence
  Description of Artificial Sequence: Synthetic peptide
DEEEIRTTNPEATEQYGSVSTDPDQIGNR

SEQ ID NO: 25158 - protein, 28 aa, Artificial Sequence
  Description of Artificial Sequence: Synthetic peptide
DEEEIRTTNPVATEQYGVVSTELQLGEV

SEQ ID NO: 25159 - protein, 30 aa, Artificial Sequence
  Description of Artificial Sequence: Synthetic polypeptide
DEEEIRTTNPVATEQYGSVSTNEQIEGDNQ

SEQ ID NO: 25160 - protein, 28 aa, Artificial Sequence
  Description of Artificial Sequence: Synthetic peptide
DEEEIAQTNPVATEQYGSVSENLEVGNR

SEQ ID NO: 25161 - protein, 28 aa, Artificial Sequence
  Description of Artificial Sequence: Synthetic peptide
DEEEIRTTNPVATEQYGVVSTDQQVGND

SEQ ID NO: 25162 - protein, 32 aa, Artificial Sequence
  Description of Artificial Sequence: Synthetic polypeptide
DEEEIRTTNPVATEQYGSVFITMNLQPRGNDR

SEQ ID NO: 25163 - protein, 28 aa, Artificial Sequence
  Description of Artificial Sequence: Synthetic peptide
DEENIDTTNNVATAQYGSVSTNLSRGNR

SEQ ID NO: 25164 - protein, 28 aa, Artificial Sequence
  Description of Artificial Sequence: Synthetic peptide
DEEEIRATNPVCTEQYGDVSTELQRGND

SEQ ID NO: 25165 - protein, 28 aa, Artificial Sequence
  Description of Artificial Sequence: Synthetic peptide
QEQEITTTNPVATEQYGDVSDNLQRGNR

SEQ ID NO: 25166 - protein, 29 aa, Artificial Sequence
  Description of Artificial Sequence: Synthetic peptide
DEEEIRTTNPAATEQFGSVSTNWQRGDTR

SEQ ID NO: 25167 - protein, 29 aa, Artificial Sequence
  Description of Artificial Sequence: Synthetic peptide
DEEEIRCTNPVATEQYGSVDTNDQRGNDL

SEQ ID NO: 25168 - protein, 28 aa, Artificial Sequence
  Description of Artificial Sequence: Synthetic peptide
DEEEIRTTNPVATEQYGIVNENLQRGPS

SEQ ID NO: 25169 - protein, 30 aa, Artificial Sequence
  Description of Artificial Sequence: Synthetic polypeptide
DEEEIRTVNPVSTEQYGSVSAENLQRAGNR

SEQ ID NO: 25170 - protein, 29 aa, Artificial Sequence
  Description of Artificial Sequence: Synthetic peptide
DEEEIITTNPVATEAYGTVPATNLQRGNR

SEQ ID NO: 25171 - protein, 28 aa, Artificial Sequence
  Description of Artificial Sequence: Synthetic peptide
DEMEIRQTNPVATEQYGSCSTPLQRGNG

SEQ ID NO: 25172 - protein, 30 aa, Artificial Sequence
  Description of Artificial Sequence: Synthetic polypeptide
DEEEIRTTNPVATEQYGGVISTNEQRGDTR

SEQ ID NO: 25173 - protein, 28 aa, Artificial Sequence
  Description of Artificial Sequence: Synthetic peptide
DEESISTTNIVATEQYGSVSTNLQHGAR

SEQ ID NO: 25174 - protein, 29 aa, Artificial Sequence
  Description of Artificial Sequence: Synthetic peptide
DEEEVRTTNPVATEQYGGVSTNLQSALNR

SEQ ID NO: 25175 - protein, 30 aa, Artificial Sequence
  Description of Artificial Sequence: Synthetic polypeptide
DEEEIRTTNPCSTLQYGSVSTNLQRNGNDR

SEQ ID NO: 25176 - protein, 28 aa, Artificial Sequence
  Description of Artificial Sequence: Synthetic peptide
DPEEIRTTNPVATQQYGSVSTNDQDGER

SEQ ID NO: 25177 - protein, 28 aa, Artificial Sequence
  Description of Artificial Sequence: Synthetic peptide
QEEEIRTTNPECTEQYGSVSTNLEMGNR

SEQ ID NO: 25178 - protein, 28 aa, Artificial Sequence
  Description of Artificial Sequence: Synthetic peptide
DEEEIRTTNCVASEQYGAVSSNLQGGNR

SEQ ID NO: 25179 - protein, 29 aa, Artificial Sequence
  Description of Artificial Sequence: Synthetic peptide
DEEEIRTTNPEATEQYGSVSTNPDQRGEL

SEQ ID NO: 25180 - protein, 28 aa, Artificial Sequence
  Description of Artificial Sequence: Synthetic peptide
DEEEIRTTNPVATEQYGSVDTNEEQGNQ

SEQ ID NO: 25181 - protein, 28 aa, Artificial Sequence
  Description of Artificial Sequence: Synthetic peptide
DEREIRTTNPVATEQYGSCSTLLMRGNY

SEQ ID NO: 25182 - protein, 28 aa, Artificial Sequence
  Description of Artificial Sequence: Synthetic peptide
GDGEIRTTNPVATEQYGSVSYNLQRGNI

SEQ ID NO: 25183 - protein, 28 aa, Artificial Sequence
  Description of Artificial Sequence: Synthetic peptide
CEEEIRTTNPECTEQYGSVSTEEQRGNR

SEQ ID NO: 25184 - protein, 28 aa, Artificial Sequence
  Description of Artificial Sequence: Synthetic peptide
DEEEIRTTNPDATEQYGSVSTDLQEGEN

SEQ ID NO: 25185 - protein, 28 aa, Artificial Sequence
  Description of Artificial Sequence: Synthetic peptide
DEEEIRGTNIVNTHQYGSVSTNLQTGNR

SEQ ID NO: 25186 - protein, 28 aa, Artificial Sequence
  Description of Artificial Sequence: Synthetic peptide
DEEEIRTTNTVAMEQYGSVSHNMQRGNH

SEQ ID NO: 25187 - protein, 28 aa, Artificial Sequence
  Description of Artificial Sequence: Synthetic peptide
DEEEIRTTNPFATEQYGSVSTCDIRGER

SEQ ID NO: 25188 - protein, 30 aa, Artificial Sequence
  Description of Artificial Sequence: Synthetic polypeptide
DEEEIRTTNPVATEQYGSHVSTIEQRELNR

SEQ ID NO: 25189 - protein, 32 aa, Artificial Sequence
  Description of Artificial Sequence: Synthetic polypeptide
DEEEIRTTNPVATEQYGSVSITTNLEREGDNR

SEQ ID NO: 25190 - protein, 28 aa, Artificial Sequence
  Description of Artificial Sequence: Synthetic peptide
DEEEIRQTNPVATEQYGSASENPQRGNL

SEQ ID NO: 25191 - protein, 28 aa, Artificial Sequence
  Description of Artificial Sequence: Synthetic peptide
VEEEIRTVNPVATEQYGAVSMNLQRGTR

SEQ ID NO: 25192 - protein, 29 aa, Artificial Sequence
  Description of Artificial Sequence: Synthetic peptide
DEEEIRTTNPVATEQYGSVDTEDQRGNET

SEQ ID NO: 25193 - protein, 28 aa, Artificial Sequence
  Description of Artificial Sequence: Synthetic peptide
DEEMCRTTNIVATEQYGSVSTNLQRGLG

SEQ ID NO: 25194 - protein, 29 aa, Artificial Sequence
  Description of Artificial Sequence: Synthetic peptide
QEEEIAQTNPVATEQYGSVSATNLQRGGR

SEQ ID NO: 25195 - protein, 28 aa, Artificial Sequence
  Description of Artificial Sequence: Synthetic peptide
DESEIRTTNPVATEQYGSGSTDLQNGNA

SEQ ID NO: 25196 - protein, 30 aa, Artificial Sequence
  Description of Artificial Sequence: Synthetic polypeptide
DEEEIRTTNPVATEQYGSVVSTELQMEGNG

SEQ ID NO: 25197 - protein, 28 aa, Artificial Sequence
  Description of Artificial Sequence: Synthetic peptide
DEEEIATTNPVATECYGSVSTNLQVGEL

SEQ ID NO: 25198 - protein, 31 aa, Artificial Sequence
  Description of Artificial Sequence: Synthetic polypeptide
DEEEIRTTNPVATEQYGSVSTDLQEREGNDM

SEQ ID NO: 25199 - protein, 28 aa, Artificial Sequence
  Description of Artificial Sequence: Synthetic peptide
RDQEIRTTNPVATEQYGTVSTNLQRGNA

SEQ ID NO: 25200 - protein, 28 aa, Artificial Sequence
  Description of Artificial Sequence: Synthetic peptide
DEEEINTTNPVACEQYGSVSANLYPGNR

SEQ ID NO: 25201 - protein, 32 aa, Artificial Sequence
  Description of Artificial Sequence: Synthetic polypeptide
DEEEIRTTNPVATEQYGSVSTDLQEREGENDR

SEQ ID NO: 25202 - protein, 32 aa, Artificial Sequence
  Description of Artificial Sequence: Synthetic polypeptide
DEEEIRTTNPVATEQYGSVSDTNGLQLKGDNR

SEQ ID NO: 25203 - protein, 29 aa, Artificial Sequence
  Description of Artificial Sequence: Synthetic peptide
DEEEIRSTNPVATEQWGSYSTNLMMRGNR

SEQ ID NO: 25204 - protein, 30 aa, Artificial Sequence
  Description of Artificial Sequence: Synthetic polypeptide
DEEEIRTTNPDATEQYGSVSDTDLQRKGNY

SEQ ID NO: 25205 - protein, 32 aa, Artificial Sequence
  Description of Artificial Sequence: Synthetic polypeptide
DEEEIRTTNPVATEQYGSVSETDNLQEFGDNR

SEQ ID NO: 25206 - protein, 30 aa, Artificial Sequence
  Description of Artificial Sequence: Synthetic polypeptide
DEEEIKTTNPVATEQYGSVSVNLQRAGDNN

SEQ ID NO: 25207 - protein, 28 aa, Artificial Sequence
  Description of Artificial Sequence: Synthetic peptide
DEEEIATTNPVATEQYGSVSTDLQVGEL

SEQ ID NO: 25208 - protein, 28 aa, Artificial Sequence
  Description of Artificial Sequence: Synthetic peptide
DEMEIYTTNPVGTEQYGSVSENLQRGNL

SEQ ID NO: 25209 - protein, 31 aa, Artificial Sequence
  Description of Artificial Sequence: Synthetic polypeptide
QEEEIVTTNPVATEQYGSVSSTNNLQREGNR

SEQ ID NO: 25210 - protein, 28 aa, Artificial Sequence
  Description of Artificial Sequence: Synthetic peptide
DEECSRTTNPIAYEQYGEVSTNLQRGNR

SEQ ID NO: 25211 - protein, 28 aa, Artificial Sequence
  Description of Artificial Sequence: Synthetic peptide
DEEEIRTTNIVATEQYGSVSTILEQGNI

SEQ ID NO: 25212 - protein, 28 aa, Artificial Sequence
  Description of Artificial Sequence: Synthetic peptide
DEEEIRTTNPFATEQYGSVSTPGIRGER

SEQ ID NO: 25213 - protein, 28 aa, Artificial Sequence
  Description of Artificial Sequence: Synthetic peptide
DEQEIRTTNPDATEQYGSVSTNDQQGNF

SEQ ID NO: 25214 - protein, 31 aa, Artificial Sequence
  Description of Artificial Sequence: Synthetic polypeptide
DEEEIVTTNPVATEVYGSVASDTNLQRGINR

SEQ ID NO: 25215 - protein, 28 aa, Artificial Sequence
  Description of Artificial Sequence: Synthetic peptide
NTEEMRTTNPVATEQYGSVSTALDRGNR

SEQ ID NO: 25216 - protein, 28 aa, Artificial Sequence
  Description of Artificial Sequence: Synthetic peptide
DEEELRTTNPVATEQYGDVSTDLLRGNN

SEQ ID NO: 25217 - protein, 29 aa, Artificial Sequence
  Description of Artificial Sequence: Synthetic peptide
KEEEIRTTNPVATEQYGSVSTNLQEYGEA

SEQ ID NO: 25218 - protein, 28 aa, Artificial Sequence
  Description of Artificial Sequence: Synthetic peptide
DEEEIRTTNPDATEQYGSVSTCLQREEI

SEQ ID NO: 25219 - protein, 31 aa, Artificial Sequence
  Description of Artificial Sequence: Synthetic polypeptide
DEEEIRTTNPTATEQYGSVSTMNLQEVEGNR

SEQ ID NO: 25220 - protein, 30 aa, Artificial Sequence
  Description of Artificial Sequence: Synthetic polypeptide
DEEEIRTTNPTATEIYGSVSTVNLQDRGNH

SEQ ID NO: 25221 - protein, 28 aa, Artificial Sequence
  Description of Artificial Sequence: Synthetic peptide
YEEEITTTNPVATEQYGSVSTNLLEGNS

SEQ ID NO: 25222 - protein, 28 aa, Artificial Sequence
  Description of Artificial Sequence: Synthetic peptide
DEQEIRTVNPVATEQYGFVSENLQWGNR

SEQ ID NO: 25223 - protein, 28 aa, Artificial Sequence
  Description of Artificial Sequence: Synthetic peptide
AETEIRTTNPVGTEQYGCVSNNLQRGNR

SEQ ID NO: 25224 - protein, 31 aa, Artificial Sequence
  Description of Artificial Sequence: Synthetic polypeptide
DEEEIRTTNPVATEQYGSVSCTMNLCRGNDV

SEQ ID NO: 25225 - protein, 28 aa, Artificial Sequence
  Description of Artificial Sequence: Synthetic peptide
DEEEIRTTNPVATEQYGVVDDDDQRGNR

SEQ ID NO: 25226 - protein, 31 aa, Artificial Sequence
  Description of Artificial Sequence: Synthetic polypeptide
DENEIRQTNPVATEQYGSVSTTNLVQIRGNR

SEQ ID NO: 25227 - protein, 28 aa, Artificial Sequence
  Description of Artificial Sequence: Synthetic peptide
DEEEIRTTNPVATQQYGSVSHPLDRGER

SEQ ID NO: 25228 - protein, 30 aa, Artificial Sequence
  Description of Artificial Sequence: Synthetic polypeptide
DEEEIRCTNPVATEQYGVVSTGNLQRGENI

SEQ ID NO: 25229 - protein, 28 aa, Artificial Sequence
  Description of Artificial Sequence: Synthetic peptide
DEEEIRTTNPVATEQYGIVDTNPQRGEV

SEQ ID NO: 25230 - protein, 28 aa, Artificial Sequence
  Description of Artificial Sequence: Synthetic peptide
DEEEIRTTNPCAYEWYGSVGSNLQRGNR

SEQ ID NO: 25231 - protein, 28 aa, Artificial Sequence
  Description of Artificial Sequence: Synthetic peptide
DAEEIATVNPVATEQYGSVSYNLQIGNR

SEQ ID NO: 25232 - protein, 28 aa, Artificial Sequence
  Description of Artificial Sequence: Synthetic peptide
YEGEIRTTNPVATEQYGSVNTFLQRGAR

SEQ ID NO: 25233 - protein, 30 aa, Artificial Sequence
  Description of Artificial Sequence: Synthetic polypeptide
SEEEIRTTNPEATEQYGSVSTANLPQHGNR

SEQ ID NO: 25234 - protein, 28 aa, Artificial Sequence
  Description of Artificial Sequence: Synthetic peptide
DEEEVKTTNPVATELYGSVSDNIQRGNR

SEQ ID NO: 25235 - protein, 31 aa, Artificial Sequence
  Description of Artificial Sequence: Synthetic polypeptide
DEEEIRTTNPVATEQYGSVDSTQNPDQRGNA

SEQ ID NO: 25236 - protein, 28 aa, Artificial Sequence
  Description of Artificial Sequence: Synthetic peptide
DEEEIRTTNPVATEVYGVVSSNLQFGNC

SEQ ID NO: 25237 - protein, 28 aa, Artificial Sequence
  Description of Artificial Sequence: Synthetic peptide
DEEEIRATNPVSTEMYGSVAMNLQRGNR

SEQ ID NO: 25238 - protein, 28 aa, Artificial Sequence
  Description of Artificial Sequence: Synthetic peptide
DDQEIRTTNPVATEQYGSVSTLLQRPNA

SEQ ID NO: 25239 - protein, 29 aa, Artificial Sequence
  Description of Artificial Sequence: Synthetic peptide
DEEEIRTTNPVATEQYGSYVSTGLERENE

SEQ ID NO: 25240 - protein, 28 aa, Artificial Sequence
  Description of Artificial Sequence: Synthetic peptide
DEQEIRTTNPEATEQYGSVSTNLQIGEF

SEQ ID NO: 25241 - protein, 28 aa, Artificial Sequence
  Description of Artificial Sequence: Synthetic peptide
DEEEIATTNPTATEQYGSVSTNEQQGNF

SEQ ID NO: 25242 - protein, 28 aa, Artificial Sequence
  Description of Artificial Sequence: Synthetic peptide
DEEEIATTNIVATEQYGSVSCNIQHGNR

SEQ ID NO: 25243 - protein, 28 aa, Artificial Sequence
  Description of Artificial Sequence: Synthetic peptide
SEEEIRTTNPVATEQFGSVSENEQRGDR

SEQ ID NO: 25244 - protein, 28 aa, Artificial Sequence
  Description of Artificial Sequence: Synthetic peptide
QEEEIATTNPVATEVYGSASENLQRGNR

SEQ ID NO: 25245 - protein, 28 aa, Artificial Sequence
  Description of Artificial Sequence: Synthetic peptide
SEQEIRSTNPVASEQYGCVSTNLQRGNR

SEQ ID NO: 25246 - protein, 28 aa, Artificial Sequence
  Description of Artificial Sequence: Synthetic peptide
DEGEIRTTNPVATECYGSVSTNLERGEN

SEQ ID NO: 25247 - protein, 28 aa, Artificial Sequence
  Description of Artificial Sequence: Synthetic peptide
DEEEIRTTNPEATEQYGSVSTGLDQGND

SEQ ID NO: 25248 - protein, 30 aa, Artificial Sequence
  Description of Artificial Sequence: Synthetic polypeptide
DEEEIRTTNPVAWEQYGDVEFTNLPQRGNR

SEQ ID NO: 25249 - protein, 28 aa, Artificial Sequence
  Description of Artificial Sequence: Synthetic peptide
DEQEIRTTNPVATECYGSVSTNLQLGEY

SEQ ID NO: 25250 - protein, 28 aa, Artificial Sequence
  Description of Artificial Sequence: Synthetic peptide
DEEEIRTTNPHATEQWGNVSDNLQRGNM

SEQ ID NO: 25251 - protein, 28 aa, Artificial Sequence
  Description of Artificial Sequence: Synthetic peptide
DEEEIRTTNIVATEQYGSVSEDLEMGNR

SEQ ID NO: 25252 - protein, 29 aa, Artificial Sequence
  Description of Artificial Sequence: Synthetic peptide
DEEEIRTTNPEATEQYGSVSTEPLQNGER

SEQ ID NO: 25253 - protein, 29 aa, Artificial Sequence
  Description of Artificial Sequence: Synthetic peptide
DEEEIRTTNPVATEGYGEVSAENLQRGNK

SEQ ID NO: 25254 - protein, 30 aa, Artificial Sequence
  Description of Artificial Sequence: Synthetic polypeptide
DEEEIRQTNPVATEQYGSVSTNLQCHGEDR

SEQ ID NO: 25255 - protein, 28 aa, Artificial Sequence
  Description of Artificial Sequence: Synthetic peptide
DENEIRQTNPVATENYGSASTNLERGNR

SEQ ID NO: 25256 - protein, 28 aa, Artificial Sequence
  Description of Artificial Sequence: Synthetic peptide
DEEEIRTTNIVATEQYGVVSENLEIGNR

SEQ ID NO: 25257 - protein, 29 aa, Artificial Sequence
  Description of Artificial Sequence: Synthetic peptide
SEEEVRTTNPVACEQYGSVSSNLQRGMNR

SEQ ID NO: 25258 - protein, 28 aa, Artificial Sequence
  Description of Artificial Sequence: Synthetic peptide
DEEEIRTTNPFATEQYGSVSTNDNMGNQ

SEQ ID NO: 25259 - protein, 30 aa, Artificial Sequence
  Description of Artificial Sequence: Synthetic polypeptide
DEEEIVTTNPVATETYGSVSCTNLQEHGNR

SEQ ID NO: 25260 - protein, 28 aa, Artificial Sequence
  Description of Artificial Sequence: Synthetic peptide
AEEEIRTVNPIATEQYGAVSTNLQRGNP

SEQ ID NO: 25261 - protein, 29 aa, Artificial Sequence
  Description of Artificial Sequence: Synthetic peptide
DEEEIRTTNPVATEQYGSVSTNEPVENDR

SEQ ID NO: 25262 - protein, 28 aa, Artificial Sequence
  Description of Artificial Sequence: Synthetic peptide
DEEEIRTTNPFATEQYGSVDTGLLRGNE

SEQ ID NO: 25263 - protein, 31 aa, Artificial Sequence
  Description of Artificial Sequence: Synthetic polypeptide
DEEEIRTTNPTATEQYGSVSTNLQLNGDNTR

SEQ ID NO: 25264 - protein, 31 aa, Artificial Sequence
  Description of Artificial Sequence: Synthetic polypeptide
DEEEIRTTNPVATQQYGSVHSTNDPQRGDNR

SEQ ID NO: 25265 - protein, 31 aa, Artificial Sequence
  Description of Artificial Sequence: Synthetic polypeptide
DEEEIRTTNPVATEQYGSVDSDTNLEQIGLR

SEQ ID NO: 25266 - protein, 30 aa, Artificial Sequence
  Description of Artificial Sequence: Synthetic polypeptide
DEGEIRTVNPVATEQYGSVSTNDNQRGNLR

SEQ ID NO: 25267 - protein, 28 aa, Artificial Sequence
  Description of Artificial Sequence: Synthetic peptide
VEEEIKGTNPCATEQYGSVSTNLERGNR

SEQ ID NO: 25268 - protein, 28 aa, Artificial Sequence
  Description of Artificial Sequence: Synthetic peptide
QENEITTTNPVATEQYGGVSDNLQRGNR

SEQ ID NO: 25269 - protein, 31 aa, Artificial Sequence
  Description of Artificial Sequence: Synthetic polypeptide
DEEEIRTTNPVATEQYGESVDTEELQRGDNR

SEQ ID NO: 25270 - protein, 31 aa, Artificial Sequence
  Description of Artificial Sequence: Synthetic polypeptide
DEEEIRTTNPVATECYGSVSTELQDRKGNDR

SEQ ID NO: 25271 - protein, 28 aa, Artificial Sequence
  Description of Artificial Sequence: Synthetic peptide
KENEIRTTNPVATEQYGSVSTNLQNGEI

SEQ ID NO: 25272 - protein, 28 aa, Artificial Sequence
  Description of Artificial Sequence: Synthetic peptide
DEECIRPTNPVATQQYGFVSENLQRGNR

SEQ ID NO: 25273 - protein, 30 aa, Artificial Sequence
  Description of Artificial Sequence: Synthetic polypeptide
DEEEISTTNPVATETYGSVSTNLQRGENDQ

SEQ ID NO: 25274 - protein, 28 aa, Artificial Sequence
  Description of Artificial Sequence: Synthetic peptide
DEEEIAATNIVATEQYGSVSENLQNGNR

SEQ ID NO: 25275 - protein, 31 aa, Artificial Sequence
  Description of Artificial Sequence: Synthetic polypeptide
DEEEIVTTNPVATEQYGSVSTCDLQERGNDR

SEQ ID NO: 25276 - protein, 30 aa, Artificial Sequence
  Description of Artificial Sequence: Synthetic polypeptide
DEEEIRTTNPVATEQFGSVISTNPQRGNDA

SEQ ID NO: 25277 - protein, 28 aa, Artificial Sequence
  Description of Artificial Sequence: Synthetic peptide
DEEEIRTTNPDATEQYGSVSTPLDRGEV

SEQ ID NO: 25278 - protein, 32 aa, Artificial Sequence
  Description of Artificial Sequence: Synthetic polypeptide
DEEEIRTTNPVATEQYGSVISTCNEPQRGDNR

SEQ ID NO: 25279 - protein, 30 aa, Artificial Sequence
  Description of Artificial Sequence: Synthetic polypeptide
DEEEIRTTNPVATEQYGSVSCENLQCNGNV

SEQ ID NO: 25280 - protein, 28 aa, Artificial Sequence
  Description of Artificial Sequence: Synthetic peptide
QEEEIRTTNPVATEQYGDVCTNLQRGTM

SEQ ID NO: 25281 - protein, 30 aa, Artificial Sequence
  Description of Artificial Sequence: Synthetic polypeptide
DEEEITTTNPVATEQYGSVSTANLQLFGNI

SEQ ID NO: 25282 - protein, 28 aa, Artificial Sequence
  Description of Artificial Sequence: Synthetic peptide
DEFEIVTTNPVATEQYGGVSDNLQRGNH

SEQ ID NO: 25283 - protein, 31 aa, Artificial Sequence
  Description of Artificial Sequence: Synthetic polypeptide
DEEEIRTTNPVSTEQYGSVISTNLQRGIDTR

SEQ ID NO: 25284 - protein, 28 aa, Artificial Sequence
  Description of Artificial Sequence: Synthetic peptide
DEQEIVATNPVATEMYGWVSTNLQRGNR

SEQ ID NO: 25285 - protein, 31 aa, Artificial Sequence
  Description of Artificial Sequence: Synthetic polypeptide
DEEEIRTTNPVATEQYGVVSNINGLVQRGNR

SEQ ID NO: 25286 - protein, 30 aa, Artificial Sequence
  Description of Artificial Sequence: Synthetic polypeptide
DEEEIRTTNPDATEQYGSVSTENNLQIDNR

SEQ ID NO: 25287 - protein, 28 aa, Artificial Sequence
  Description of Artificial Sequence: Synthetic peptide
DEEEIRTTNPFATEQYGSVSTPGQLGDR

SEQ ID NO: 25288 - protein, 29 aa, Artificial Sequence
  Description of Artificial Sequence: Synthetic peptide
DEEEIRTTNPVATELYGSVSTNLMNQGNL

SEQ ID NO: 25289 - protein, 31 aa, Artificial Sequence
  Description of Artificial Sequence: Synthetic polypeptide
DEEEIRTTNPVATEQYGDVGSTDNLQERGNQ

SEQ ID NO: 25290 - protein, 28 aa, Artificial Sequence
  Description of Artificial Sequence: Synthetic peptide
DENEIRTTNIVATELYGSVSTNLMRGNG

SEQ ID NO: 25291 - protein, 29 aa, Artificial Sequence
  Description of Artificial Sequence: Synthetic peptide
DEEEIRTTNPVATEQFGTSVSTYLLRGNS

SEQ ID NO: 25292 - protein, 31 aa, Artificial Sequence
  Description of Artificial Sequence: Synthetic polypeptide
YEEAIRTTNPVATEQYGSCVSTNLQLRNGNR

SEQ ID NO: 25293 - protein, 28 aa, Artificial Sequence
  Description of Artificial Sequence: Synthetic peptide
DDEEIRTTNPVASECYGEVSTNLQRLNR

SEQ ID NO: 25294 - protein, 28 aa, Artificial Sequence
  Description of Artificial Sequence: Synthetic peptide
DEEEIATVNPVSTEQYGSVSTVLQRENR

SEQ ID NO: 25295 - protein, 30 aa, Artificial Sequence
  Description of Artificial Sequence: Synthetic polypeptide
DEEEIRTTNPVATEVFGSVSTCDLQNRGNR

SEQ ID NO: 25296 - protein, 28 aa, Artificial Sequence
  Description of Artificial Sequence: Synthetic peptide
YEEEIACVNPVATEQYGSVSTNLQLGNR

SEQ ID NO: 25297 - protein, 31 aa, Artificial Sequence
  Description of Artificial Sequence: Synthetic polypeptide
DEEEIRTTNPDATEQYGSVSETLNLQRNGNI

SEQ ID NO: 25298 - protein, 28 aa, Artificial Sequence
  Description of Artificial Sequence: Synthetic peptide
DEEEIATTNPVATEQYGDVSTPLPRGNW

SEQ ID NO: 25299 - protein, 28 aa, Artificial Sequence
  Description of Artificial Sequence: Synthetic peptide
DTEMIRTTNPVATEKYGSVSTNLQEGDR

SEQ ID NO: 25300 - protein, 28 aa, Artificial Sequence
  Description of Artificial Sequence: Synthetic peptide
DEEEIRTTNIVATEQYGSVSASLQRINH

SEQ ID NO: 25301 - protein, 29 aa, Artificial Sequence
  Description of Artificial Sequence: Synthetic peptide
DEEEIRTTNPVATEQYGDVSTANEQLENR

SEQ ID NO: 25302 - protein, 28 aa, Artificial Sequence
  Description of Artificial Sequence: Synthetic peptide
DEEEIRTTNPVATEQYGSVSTDDLQGEE

SEQ ID NO: 25303 - protein, 31 aa, Artificial Sequence
  Description of Artificial Sequence: Synthetic polypeptide
DEEEIRTTNPVATEQYGASVHSYNDQRGNHR

SEQ ID NO: 25304 - protein, 28 aa, Artificial Sequence
  Description of Artificial Sequence: Synthetic peptide
DENEIRTTNIVATEQYGSVSENDQRGNT

SEQ ID NO: 25305 - protein, 31 aa, Artificial Sequence
  Description of Artificial Sequence: Synthetic polypeptide
DEEEIRTTNPVATEQYGESVSTNGLEDRGNF

SEQ ID NO: 25306 - protein, 28 aa, Artificial Sequence
  Description of Artificial Sequence: Synthetic peptide
DEGEIRATNPEATECYGSVSTNLQQGNR

SEQ ID NO: 25307 - protein, 30 aa, Artificial Sequence
  Description of Artificial Sequence: Synthetic polypeptide
DEEEIRTTNPVATEQYGSVSCENLQCMGNQ

SEQ ID NO: 25308 - protein, 31 aa, Artificial Sequence
  Description of Artificial Sequence: Synthetic polypeptide
DEEEIRTTNPVATEQYGSVEETNLDREGDNR

SEQ ID NO: 25309 - protein, 28 aa, Artificial Sequence
  Description of Artificial Sequence: Synthetic peptide
FEEEIATTNPVATEQYGSVYTNMQRVNR

SEQ ID NO: 25310 - protein, 30 aa, Artificial Sequence
  Description of Artificial Sequence: Synthetic polypeptide
DEGEIRTTNPVATEHYGSVSTNLQRDGNDE

SEQ ID NO: 25311 - protein, 30 aa, Artificial Sequence
  Description of Artificial Sequence: Synthetic polypeptide
DEEEIRTTNPVATEQYGSVSMNLQLSGEER

SEQ ID NO: 25312 - protein, 32 aa, Artificial Sequence
  Description of Artificial Sequence: Synthetic polypeptide
DEEEIRTTNPVATEQYGSVDCTMNLQCRGNDR

SEQ ID NO: 25313 - protein, 28 aa, Artificial Sequence
  Description of Artificial Sequence: Synthetic peptide
DEEEITTVNPVATEQYGSVSTGDQRENR

SEQ ID NO: 25314 - protein, 33 aa, Artificial Sequence
  Description of Artificial Sequence: Synthetic polypeptide
DEEEIRTTNPVATEQYGSVSTCNLQDREGDNTR

SEQ ID NO: 25315 - protein, 31 aa, Artificial Sequence
  Description of Artificial Sequence: Synthetic polypeptide
DEEEIRPTNPVATEQYGSVSVTNLQRGFNVT

SEQ ID NO: 25316 - protein, 29 aa, Artificial Sequence
  Description of Artificial Sequence: Synthetic peptide
DEEEIRTTNPTATEQYGSVSENEQQEGNR

SEQ ID NO: 25317 - protein, 28 aa, Artificial Sequence
  Description of Artificial Sequence: Synthetic peptide
DEEEVRTTNPVATFMYGSVSTNWQRGND

SEQ ID NO: 25318 - protein, 28 aa, Artificial Sequence
  Description of Artificial Sequence: Synthetic peptide
DEEEITTTNPVATEQYGSVSTYLIQGNH

SEQ ID NO: 25319 - protein, 28 aa, Artificial Sequence
  Description of Artificial Sequence: Synthetic peptide
REGEICTTNPVATEQYGIISTNLQRGNR

SEQ ID NO: 25320 - protein, 31 aa, Artificial Sequence
  Description of Artificial Sequence: Synthetic polypeptide
DEEEIRTTNPVATEQYGSVEETNLEREGENR

SEQ ID NO: 25321 - protein, 28 aa, Artificial Sequence
  Description of Artificial Sequence: Synthetic peptide
DEVEIRTTNPTATEMYGSVSENLQRGNF

SEQ ID NO: 25322 - protein, 28 aa, Artificial Sequence
  Description of Artificial Sequence: Synthetic peptide
DEEEIRTTNPVATEQYWSVSTGQQWGNA

SEQ ID NO: 25323 - protein, 28 aa, Artificial Sequence
  Description of Artificial Sequence: Synthetic peptide
DEEEIRTTNPVAYECYGSVSTNDQDGER

SEQ ID NO: 25324 - protein, 31 aa, Artificial Sequence
  Description of Artificial Sequence: Synthetic polypeptide
DEQEIRTTNPVATEQYGESVSTNLVQREGNM

SEQ ID NO: 25325 - protein, 28 aa, Artificial Sequence
  Description of Artificial Sequence: Synthetic peptide
DEEEIRCTNIVATEQYGSVSEDLQRGNL

SEQ ID NO: 25326 - protein, 28 aa, Artificial Sequence
  Description of Artificial Sequence: Synthetic peptide
DETEIRSTNPVATEIYGCVATNLQRGNR

SEQ ID NO: 25327 - protein, 30 aa, Artificial Sequence
  Description of Artificial Sequence: Synthetic polypeptide
DEEEIRSTNPVATEQYGSVDTPNGLQNGNR

SEQ ID NO: 25328 - protein, 28 aa, Artificial Sequence
  Description of Artificial Sequence: Synthetic peptide
DEQEIRTTNPEATEQYGSVSTNDEIGNR

SEQ ID NO: 25329 - protein, 28 aa, Artificial Sequence
  Description of Artificial Sequence: Synthetic peptide
DEEDIRTTNIVATEQYGSVSTNLQRQIV

SEQ ID NO: 25330 - protein, 32 aa, Artificial Sequence
  Description of Artificial Sequence: Synthetic polypeptide
DEEEIRTTNPVATEQYGESVDDTNLQRDGENR

SEQ ID NO: 25331 - protein, 28 aa, Artificial Sequence
  Description of Artificial Sequence: Synthetic peptide
DEEEIRTTNPVATEQYGSVETDDERENR

SEQ ID NO: 25332 - protein, 28 aa, Artificial Sequence
  Description of Artificial Sequence: Synthetic peptide
DEQEIRTVNPVATEQYGDVSTNLQEGNF

SEQ ID NO: 25333 - protein, 28 aa, Artificial Sequence
  Description of Artificial Sequence: Synthetic peptide
DEECIRTTNPVATFQYGCVSTNLQRGIP

SEQ ID NO: 25334 - protein, 29 aa, Artificial Sequence
  Description of Artificial Sequence: Synthetic peptide
DEEEIAQTNPVATEQYGSVDSTNQQRGER

SEQ ID NO: 25335 - protein, 29 aa, Artificial Sequence
  Description of Artificial Sequence: Synthetic peptide
DENEIRTTNPVATEQWGSVSTNEQMRGNF

SEQ ID NO: 25336 - protein, 29 aa, Artificial Sequence
  Description of Artificial Sequence: Synthetic peptide
KEEEIRTTNPVATEQYGSVSTNLQSEGEF

SEQ ID NO: 25337 - protein, 30 aa, Artificial Sequence
  Description of Artificial Sequence: Synthetic polypeptide
DEEEIRTTNPVAYEQWYGSVSTNPLDPGNR

SEQ ID NO: 25338 - protein, 28 aa, Artificial Sequence
  Description of Artificial Sequence: Synthetic peptide
DEEEIRTTNPVATEQYGSVSTDDQGGEI

SEQ ID NO: 25339 - protein, 28 aa, Artificial Sequence
  Description of Artificial Sequence: Synthetic peptide
TEQEIRTTNPVATEQYGMTSTNLLRGNR

SEQ ID NO: 25340 - protein, 28 aa, Artificial Sequence
  Description of Artificial Sequence: Synthetic peptide
DEEIIRTTNPVAHEQYGSVSHNDQDGNR

SEQ ID NO: 25341 - protein, 28 aa, Artificial Sequence
  Description of Artificial Sequence: Synthetic peptide
DEEEIRTTNPVATEQYGSVETNDQMGEV

SEQ ID NO: 25342 - protein, 28 aa, Artificial Sequence
  Description of Artificial Sequence: Synthetic peptide
DEEEIRTTNIVANEYYGSVSTNLQRSNT

SEQ ID NO: 25343 - protein, 30 aa, Artificial Sequence
  Description of Artificial Sequence: Synthetic polypeptide
DEEEIATTNPVATEQYGSVSCTMDLCRGNR

SEQ ID NO: 25344 - protein, 29 aa, Artificial Sequence
  Description of Artificial Sequence: Synthetic peptide
DEQEVRCTNPVATEQYGCVSTNLQRNGNR

SEQ ID NO: 25345 - protein, 28 aa, Artificial Sequence
  Description of Artificial Sequence: Synthetic peptide
DEEEIRTTNPVATEQYGSVETPDDLGNR

SEQ ID NO: 25346 - protein, 28 aa, Artificial Sequence
  Description of Artificial Sequence: Synthetic peptide
AEEEIVTTNPVATEQYGWVSTNLIRGER

SEQ ID NO: 25347 - protein, 28 aa, Artificial Sequence
  Description of Artificial Sequence: Synthetic peptide
DETEIVSTNPVATEIYGVVSTNLQRGNR

SEQ ID NO: 25348 - protein, 28 aa, Artificial Sequence
  Description of Artificial Sequence: Synthetic peptide
DEEEIRTTNPVATEQYGSVETPLDLGER

SEQ ID NO: 25349 - protein, 30 aa, Artificial Sequence
  Description of Artificial Sequence: Synthetic polypeptide
DEEEIRTTNPVATEQYGSWSDNLQPRKGNN

SEQ ID NO: 25350 - protein, 30 aa, Artificial Sequence
  Description of Artificial Sequence: Synthetic polypeptide
DEEEIRTTNPVATEQYGSVSTNLEDRGEEL

SEQ ID NO: 25351 - protein, 28 aa, Artificial Sequence
  Description of Artificial Sequence: Synthetic peptide
DEQEIRTTNPVATEQYGSVETNLEVGER

SEQ ID NO: 25352 - protein, 30 aa, Artificial Sequence
  Description of Artificial Sequence: Synthetic polypeptide
DEEEIRTTNPVATEQYGSVPCENLVQRENR

SEQ ID NO: 25353 - protein, 28 aa, Artificial Sequence
  Description of Artificial Sequence: Synthetic peptide
DEEEIRTTNIVATEQYGSVSEGEQRGNF

SEQ ID NO: 25354 - protein, 28 aa, Artificial Sequence
  Description of Artificial Sequence: Synthetic peptide
DAEEIHTTNPVATEQYGTVYTNLDRGNR

SEQ ID NO: 25355 - protein, 29 aa, Artificial Sequence
  Description of Artificial Sequence: Synthetic peptide
DEEEIRTTNPVATEQYWGSVSENDQDGNP

SEQ ID NO: 25356 - protein, 30 aa, Artificial Sequence
  Description of Artificial Sequence: Synthetic polypeptide
DEEEIRTTNPVATEQYGSVSTNLQVLDGEV

SEQ ID NO: 25357 - protein, 28 aa, Artificial Sequence
  Description of Artificial Sequence: Synthetic peptide
DEEEIRTTNPFATEQYGSVSTGLDPGND

SEQ ID NO: 25358 - protein, 30 aa, Artificial Sequence
  Description of Artificial Sequence: Synthetic polypeptide
DEEEIRTTNPVATEQYGSVDETEDLQHGNR

SEQ ID NO: 25359 - protein, 29 aa, Artificial Sequence
  Description of Artificial Sequence: Synthetic peptide
DEEEIRTVNPTATECYGSVSDTNLQRGTR

SEQ ID NO: 25360 - protein, 28 aa, Artificial Sequence
  Description of Artificial Sequence: Synthetic peptide
DENEIATTNPFATEQYGWVSTNQQRGNR

SEQ ID NO: 25361 - protein, 28 aa, Artificial Sequence
  Description of Artificial Sequence: Synthetic peptide
YEEEIRTTNPVSTECYGSYSTNLQRGNT

SEQ ID NO: 25362 - protein, 30 aa, Artificial Sequence
  Description of Artificial Sequence: Synthetic polypeptide
DEEEIRTTNPVATEQYGGVISTNLQSGVTR

SEQ ID NO: 25363 - protein, 31 aa, Artificial Sequence
  Description of Artificial Sequence: Synthetic polypeptide
DEEEIRTTNPVATEQYGSVSTENLQPQGENG

SEQ ID NO: 25364 - protein, 28 aa, Artificial Sequence
  Description of Artificial Sequence: Synthetic peptide
DEEEIRTTNPVATELYGIVSTNLQIGPF

SEQ ID NO: 25365 - protein, 32 aa, Artificial Sequence
  Description of Artificial Sequence: Synthetic polypeptide
DEEEIRTTNPVATEQYGYSVTSTLNLQEPGNR

SEQ ID NO: 25366 - protein, 28 aa, Artificial Sequence
  Description of Artificial Sequence: Synthetic peptide
DEEEIRTTNPVGTEQWGVVSSNYQRGNR

SEQ ID NO: 25367 - protein, 31 aa, Artificial Sequence
  Description of Artificial Sequence: Synthetic polypeptide
DEEEIRTTNPVATEQYGSVESTDLEERGNER

SEQ ID NO: 25368 - protein, 30 aa, Artificial Sequence
  Description of Artificial Sequence: Synthetic polypeptide
DEEEIYTTNPVATEMYGSVSTNLQSKGNTR

SEQ ID NO: 25369 - protein, 31 aa, Artificial Sequence
  Description of Artificial Sequence: Synthetic polypeptide
DEEEIRTTNPVATEQYGDVSCTNLQCRGNDV

SEQ ID NO: 25370 - protein, 29 aa, Artificial Sequence
  Description of Artificial Sequence: Synthetic peptide
DEQEIVTTNPVATEQYGEVSADNLQRGNR

SEQ ID NO: 25371 - protein, 30 aa, Artificial Sequence
  Description of Artificial Sequence: Synthetic polypeptide
QEHEIRSTNPVATEQYGSVSDTNLQRNGNR

SEQ ID NO: 25372 - protein, 28 aa, Artificial Sequence
  Description of Artificial Sequence: Synthetic peptide
SEEEIRTTNPEATEQFGSVSTNLQLGNI

SEQ ID NO: 25373 - protein, 29 aa, Artificial Sequence
  Description of Artificial Sequence: Synthetic peptide
DENEIRTTNPVATECYGSVSTNLQFGNDQ

SEQ ID NO: 25374 - protein, 30 aa, Artificial Sequence
  Description of Artificial Sequence: Synthetic polypeptide
DEEEIRTTNPEATEQYGSVSTPLQERKGNS

SEQ ID NO: 25375 - protein, 28 aa, Artificial Sequence
  Description of Artificial Sequence: Synthetic peptide
DDEEIRTTNPVATEQFGSTSTNLDLGNR

SEQ ID NO: 25376 - protein, 32 aa, Artificial Sequence
  Description of Artificial Sequence: Synthetic polypeptide
DEEEIRTTNPVATEQYGSVDSTENDQERGNER

SEQ ID NO: 25377 - protein, 28 aa, Artificial Sequence
  Description of Artificial Sequence: Synthetic peptide
REEEIRTTNPVATAQYGSVSIALERGNR

SEQ ID NO: 25378 - protein, 28 aa, Artificial Sequence
  Description of Artificial Sequence: Synthetic peptide
DENEIRTTNPVATEQWGSVDTNEQRGNA

SEQ ID NO: 25379 - protein, 28 aa, Artificial Sequence
  Description of Artificial Sequence: Synthetic peptide
DSNEIRTTNPCATEQYGNVSENLQRGNR

SEQ ID NO: 25380 - protein, 28 aa, Artificial Sequence
  Description of Artificial Sequence: Synthetic peptide
DEGEIRSTNPVSTEQYGSVSTNLLRGNF

SEQ ID NO: 25381 - protein, 28 aa, Artificial Sequence
  Description of Artificial Sequence: Synthetic peptide
SEEEIRTTNIVATEQYGSVSTNEQQGNQ

SEQ ID NO: 25382 - protein, 28 aa, Artificial Sequence
  Description of Artificial Sequence: Synthetic peptide
HEQEIRTTNPCCTEQYGSVSTNDQRGNR

SEQ ID NO: 25383 - protein, 28 aa, Artificial Sequence
  Description of Artificial Sequence: Synthetic peptide
DEEEIRTTNPEATEQYGSVSTDLQPGWL

SEQ ID NO: 25384 - protein, 28 aa, Artificial Sequence
  Description of Artificial Sequence: Synthetic peptide
DDEEIRSTNPVASEQYGSVSTELQEGNR

SEQ ID NO: 25385 - protein, 29 aa, Artificial Sequence
  Description of Artificial Sequence: Synthetic peptide
DEEEIRTTNPVATEQYGSVSENPQVEGNA

SEQ ID NO: 25386 - protein, 28 aa, Artificial Sequence
  Description of Artificial Sequence: Synthetic peptide
GEEEIRTTNPVATEGYGTVSTNLQAGDR

SEQ ID NO: 25387 - protein, 28 aa, Artificial Sequence
  Description of Artificial Sequence: Synthetic peptide
DEEEIRTTNPVATEQYGSVDDNLQTENP

SEQ ID NO: 25388 - protein, 29 aa, Artificial Sequence
  Description of Artificial Sequence: Synthetic peptide
DEQEIRCTNPVASEVYGSVSATNLQRGNR

SEQ ID NO: 25389 - protein, 28 aa, Artificial Sequence
  Description of Artificial Sequence: Synthetic peptide
DEEEIRCTNPVSTEQWGSTSTNLQRLNR

SEQ ID NO: 25390 - protein, 28 aa, Artificial Sequence
  Description of Artificial Sequence: Synthetic peptide
MEQEIRTVNPVATEQYGSVSTNLQSGNY

SEQ ID NO: 25391 - protein, 30 aa, Artificial Sequence
  Description of Artificial Sequence: Synthetic polypeptide
DEEEIRATNPVATEQYGSVSTNLQDSGNDN

SEQ ID NO: 25392 - protein, 28 aa, Artificial Sequence
  Description of Artificial Sequence: Synthetic peptide
REEEIRTTNPVCSEQWGSVSTNLERGNR

SEQ ID NO: 25393 - protein, 31 aa, Artificial Sequence
  Description of Artificial Sequence: Synthetic polypeptide
CEEEIRTTNPVCTEQYGSVSTNLPQPRGINR

SEQ ID NO: 25394 - protein, 28 aa, Artificial Sequence
  Description of Artificial Sequence: Synthetic peptide
DEEEIRTTNPVATEQYWSVSENLFRGEP

SEQ ID NO: 25395 - protein, 30 aa, Artificial Sequence
  Description of Artificial Sequence: Synthetic polypeptide
DEEEIRTTNPVATEQYWSWSTNLQLRNGND

SEQ ID NO: 25396 - protein, 28 aa, Artificial Sequence
  Description of Artificial Sequence: Synthetic peptide
DEEEIRTTNPEATEQYGSVSTEEQQGNV

SEQ ID NO: 25397 - protein, 29 aa, Artificial Sequence
  Description of Artificial Sequence: Synthetic peptide
QEEEIRTTNPVSTEVYGSVSATVLQRGNR

SEQ ID NO: 25398 - protein, 28 aa, Artificial Sequence
  Description of Artificial Sequence: Synthetic peptide
DDEEIRATNPVASEQWGSVATNLQRGNR

SEQ ID NO: 25399 - protein, 28 aa, Artificial Sequence
  Description of Artificial Sequence: Synthetic peptide
DEQEIRTTNPVATEQYGSVDEDLQNGNR

SEQ ID NO: 25400 - protein, 29 aa, Artificial Sequence
  Description of Artificial Sequence: Synthetic peptide
DEEEIRTTNPVATEQYGSVSTNEMMQGNF

SEQ ID NO: 25401 - protein, 29 aa, Artificial Sequence
  Description of Artificial Sequence: Synthetic peptide
DDEEIRTTNPVATELYGVVSTNLEREGNR

SEQ ID NO: 25402 - protein, 30 aa, Artificial Sequence
  Description of Artificial Sequence: Synthetic polypeptide
DEEEIRTTNPDATEQYGSVSTNLQERDGDS

SEQ ID NO: 25403 - protein, 28 aa, Artificial Sequence
  Description of Artificial Sequence: Synthetic peptide
DEEEIRATNPVASEIYGSVAMNLQRGNR

SEQ ID NO: 25404 - protein, 28 aa, Artificial Sequence
  Description of Artificial Sequence: Synthetic peptide
DEQEIRATNPVATEIYGCVATNLQRGNR

SEQ ID NO: 25405 - protein, 28 aa, Artificial Sequence
  Description of Artificial Sequence: Synthetic peptide
DEEEIRTVNPVATEQYGIVSYDLQRGNV

SEQ ID NO: 25406 - protein, 29 aa, Artificial Sequence
  Description of Artificial Sequence: Synthetic peptide
DEQEIRTTNPVASEQYGCVSANNLQRGNR

SEQ ID NO: 25407 - protein, 28 aa, Artificial Sequence
  Description of Artificial Sequence: Synthetic peptide
DEEEIRTTNPVCFEQYGSVSSNLQPGND

SEQ ID NO: 25408 - protein, 28 aa, Artificial Sequence
  Description of Artificial Sequence: Synthetic peptide
DENEIRTTNIVATEFMGSVSTNGQRGNR

SEQ ID NO: 25409 - protein, 28 aa, Artificial Sequence
  Description of Artificial Sequence: Synthetic peptide
DVEEIRATNPVATEQYGSVSTNLQQGTF

SEQ ID NO: 25410 - protein, 29 aa, Artificial Sequence
  Description of Artificial Sequence: Synthetic peptide
AEEEIRTTNPVATEQYWGSVSDNLQALNR

SEQ ID NO: 25411 - protein, 29 aa, Artificial Sequence
  Description of Artificial Sequence: Synthetic peptide
DENEIRTTNPVATEQYGSVDTNLQVGEDR

SEQ ID NO: 25412 - protein, 28 aa, Artificial Sequence
  Description of Artificial Sequence: Synthetic peptide
DEEEIYTTNPVATEQYGVVSVNEQRENR

SEQ ID NO: 25413 - protein, 28 aa, Artificial Sequence
  Description of Artificial Sequence: Synthetic peptide
KENEIRTTNPVATEQYGSVSENLQHGNF

SEQ ID NO: 25414 - protein, 28 aa, Artificial Sequence
  Description of Artificial Sequence: Synthetic peptide
DEEEIRTTNPVATEQYGSVETDDQEGER

SEQ ID NO: 25415 - protein, 30 aa, Artificial Sequence
  Description of Artificial Sequence: Synthetic polypeptide
DEEEISTTNPCATEQYGSVSTTNLQLQGNR

SEQ ID NO: 25416 - protein, 28 aa, Artificial Sequence
  Description of Artificial Sequence: Synthetic peptide
SEGEIRTTNPTATEQYGSVSENLQRGNV

SEQ ID NO: 25417 - protein, 30 aa, Artificial Sequence
  Description of Artificial Sequence: Synthetic polypeptide
DEEEIRQTNPVATEQYGSASTNLTQPEGNR

SEQ ID NO: 25418 - protein, 29 aa, Artificial Sequence
  Description of Artificial Sequence: Synthetic peptide
DPEEIATTNPVATECYGSVSTNLQRGINF

SEQ ID NO: 25419 - protein, 28 aa, Artificial Sequence
  Description of Artificial Sequence: Synthetic peptide
DEEEIRCTNPVSTEIYGSVSENLERGNR

SEQ ID NO: 25420 - protein, 31 aa, Artificial Sequence
  Description of Artificial Sequence: Synthetic polypeptide
DEEEIRTTNPVATEQYGSVSTDNDPQDWGNR

SEQ ID NO: 25421 - protein, 28 aa, Artificial Sequence
  Description of Artificial Sequence: Synthetic peptide
DEEEIRTTNPFATEQYWSVSTNLEREND

SEQ ID NO: 25422 - protein, 28 aa, Artificial Sequence
  Description of Artificial Sequence: Synthetic peptide
DEEEIRTTNPVATEQYGTMSTELQAGDR

SEQ ID NO: 25423 - protein, 30 aa, Artificial Sequence
  Description of Artificial Sequence: Synthetic polypeptide
DEEEIRTTNPEATEQYGSVSETEDDQRGNR

SEQ ID NO: 25424 - protein, 28 aa, Artificial Sequence
  Description of Artificial Sequence: Synthetic peptide
DEEEIRTTNPVATELWGSVDTNLQVGNM

SEQ ID NO: 25425 - protein, 29 aa, Artificial Sequence
  Description of Artificial Sequence: Synthetic peptide
DEQEIVTTNPVATEQYGEVSAENLQRGNR

SEQ ID NO: 25426 - protein, 32 aa, Artificial Sequence
  Description of Artificial Sequence: Synthetic polypeptide
DEEEIRTTNPVATEQYGSVEETNGLQREGNDR

SEQ ID NO: 25427 - protein, 31 aa, Artificial Sequence
  Description of Artificial Sequence: Synthetic polypeptide
DEEEIRTTNPVATEQYGSVSTNLQEIEGNDQ

SEQ ID NO: 25428 - protein, 28 aa, Artificial Sequence
  Description of Artificial Sequence: Synthetic peptide
DEEEIRTTNPVATEQWGIVDTNLERGNF

SEQ ID NO: 25429 - protein, 28 aa, Artificial Sequence
  Description of Artificial Sequence: Synthetic peptide
DEQEIRATNPVATEIYGWVATNLQRGNR

SEQ ID NO: 25430 - protein, 29 aa, Artificial Sequence
  Description of Artificial Sequence: Synthetic peptide
VEEEIRTTNPVATETFGSVSTNLEREGNR

SEQ ID NO: 25431 - protein, 28 aa, Artificial Sequence
  Description of Artificial Sequence: Synthetic peptide
DEEEIRTTNIVATEQYGAVSANLQLGIR

SEQ ID NO: 25432 - protein, 28 aa, Artificial Sequence
  Description of Artificial Sequence: Synthetic peptide
SEEEIRTTNPVATLQYGSVSTNLWEDNR

SEQ ID NO: 25433 - protein, 29 aa, Artificial Sequence
  Description of Artificial Sequence: Synthetic peptide
KEGEIRTTNPVCTEQYGSVSTNLQDSGNR

SEQ ID NO: 25434 - protein, 31 aa, Artificial Sequence
  Description of Artificial Sequence: Synthetic polypeptide
DEEEIRTTNPVATEQYGSVSTCNLQEAGNDT

SEQ ID NO: 25435 - protein, 29 aa, Artificial Sequence
  Description of Artificial Sequence: Synthetic peptide
DEEEIYTTNPVATEQYGSVSEDNLQTGNL

SEQ ID NO: 25436 - protein, 28 aa, Artificial Sequence
  Description of Artificial Sequence: Synthetic peptide
DEQEITTTNPVCTEQYGSVSENLQHGNR

SEQ ID NO: 25437 - protein, 29 aa, Artificial Sequence
  Description of Artificial Sequence: Synthetic peptide
DEEEIRTTNPFATEQYGTVSENLQQVGNR

SEQ ID NO: 25438 - protein, 30 aa, Artificial Sequence
  Description of Artificial Sequence: Synthetic polypeptide
DEEEIRTTNPEATEQYGSVSTIELQAGDNR

SEQ ID NO: 25439 - protein, 31 aa, Artificial Sequence
  Description of Artificial Sequence: Synthetic polypeptide
DEEEIRTTNPVATEQYGSVSVTDLQEHGNDR

SEQ ID NO: 25440 - protein, 29 aa, Artificial Sequence
  Description of Artificial Sequence: Synthetic peptide
DEEEIRATNPFATAQYGSVSTGGLQRGNR

SEQ ID NO: 25441 - protein, 29 aa, Artificial Sequence
  Description of Artificial Sequence: Synthetic peptide
DENEIRTTNPVATEQYGSVSTNLMNIGNW

SEQ ID NO: 25442 - protein, 28 aa, Artificial Sequence
  Description of Artificial Sequence: Synthetic peptide
DEECIRTTNPVATEQYGMWETNDQRGNR

SEQ ID NO: 25443 - protein, 32 aa, Artificial Sequence
  Description of Artificial Sequence: Synthetic polypeptide
DEEEIRTTNPVATEQYGSVSETNLERDGENER

SEQ ID NO: 25444 - protein, 29 aa, Artificial Sequence
  Description of Artificial Sequence: Synthetic peptide
DEEEVRTTNPVASEVYGCVSTNLQRNGNR

SEQ ID NO: 25445 - protein, 28 aa, Artificial Sequence
  Description of Artificial Sequence: Synthetic peptide
DEQEIRTTNPCATEIYGCVSNNLQRGNR

SEQ ID NO: 25446 - protein, 28 aa, Artificial Sequence
  Description of Artificial Sequence: Synthetic peptide
DEEEIATTNPVATEQYGSVSTDLQQGEA

SEQ ID NO: 25447 - protein, 29 aa, Artificial Sequence
  Description of Artificial Sequence: Synthetic peptide
DEEEIRTTNPVATECYGSVSTNLMMQGNM

SEQ ID NO: 25448 - protein, 29 aa, Artificial Sequence
  Description of Artificial Sequence: Synthetic peptide
DEEEIRTTNPDATEQYGSVSCTNPQRENS

SEQ ID NO: 25449 - protein, 29 aa, Artificial Sequence
  Description of Artificial Sequence: Synthetic peptide
SEEEIRTTNPVATETYGVVSTNGLQLGNR

SEQ ID NO: 25450 - protein, 30 aa, Artificial Sequence
  Description of Artificial Sequence: Synthetic polypeptide
DEEELRTTNPVATEQYGSVQTNPLERGNDR

SEQ ID NO: 25451 - protein, 29 aa, Artificial Sequence
  Description of Artificial Sequence: Synthetic peptide
DEEEIRTTNPVATAQYGSVFCENDQRGNR

SEQ ID NO: 25452 - protein, 30 aa, Artificial Sequence
  Description of Artificial Sequence: Synthetic polypeptide
DEEPIRTTNPVATIQYGSVSTMNLTRGLNR

SEQ ID NO: 25453 - protein, 31 aa, Artificial Sequence
  Description of Artificial Sequence: Synthetic polypeptide
DEEEIRTTNPVATEQYGSVETNPLQHDGNDR

SEQ ID NO: 25454 - protein, 28 aa, Artificial Sequence
  Description of Artificial Sequence: Synthetic peptide
MENEIRTTNPVATECYGSVSTNLQVGNV

SEQ ID NO: 25455 - protein, 30 aa, Artificial Sequence
  Description of Artificial Sequence: Synthetic polypeptide
GEEEIRTTNPVATENYGSVSTNLQRGLNEL

SEQ ID NO: 25456 - protein, 28 aa, Artificial Sequence
  Description of Artificial Sequence: Synthetic peptide
DEVEIATTNPVATEQYGSVSTNEQHFNR

SEQ ID NO: 25457 - protein, 30 aa, Artificial Sequence
  Description of Artificial Sequence: Synthetic polypeptide
DEEEIRTTNPVATEQYGSVSTEPLQEEGNW

SEQ ID NO: 25458 - protein, 28 aa, Artificial Sequence
  Description of Artificial Sequence: Synthetic peptide
VEEEIRTTNPCCTEQYGSVSMNLERGNR

SEQ ID NO: 25459 - protein, 28 aa, Artificial Sequence
  Description of Artificial Sequence: Synthetic peptide
DEEEIRTTNPVATEQYGSVSTEEETGNY

SEQ ID NO: 25460 - protein, 28 aa, Artificial Sequence
  Description of Artificial Sequence: Synthetic peptide
DEEEIRTTNPFATEQYGSVSTPLDRGEY

SEQ ID NO: 25461 - protein, 31 aa, Artificial Sequence
  Description of Artificial Sequence: Synthetic polypeptide
DEEEIRTTNPVATEQYGSVDSTNEQREGDNF

SEQ ID NO: 25462 - protein, 29 aa, Artificial Sequence
  Description of Artificial Sequence: Synthetic peptide
DEEEIRTTNPVATEQYGSVDSDNDQLGNL

SEQ ID NO: 25463 - protein, 29 aa, Artificial Sequence
  Description of Artificial Sequence: Synthetic peptide
DEEEIRTTNPVATEQYGSVSENEMNQGNR

SEQ ID NO: 25464 - protein, 30 aa, Artificial Sequence
  Description of Artificial Sequence: Synthetic polypeptide
DESEIRTTNPVATEQYGDVSENLQCRGNDR

SEQ ID NO: 25465 - protein, 28 aa, Artificial Sequence
  Description of Artificial Sequence: Synthetic peptide
DEEEIRTTNPFATEQYGSVSTNLWDGEN

SEQ ID NO: 25466 - protein, 28 aa, Artificial Sequence
  Description of Artificial Sequence: Synthetic peptide
DEEEIRTTNIVATECYGSVDTDLQQGNR

SEQ ID NO: 25467 - protein, 28 aa, Artificial Sequence
  Description of Artificial Sequence: Synthetic peptide
DEEEIRPTNPVATEQYGSVSTDLQDGEL

SEQ ID NO: 25468 - protein, 30 aa, Artificial Sequence
  Description of Artificial Sequence: Synthetic polypeptide
DEEEIRTTNPVATEQYGSVNDCNLQAEGNR

SEQ ID NO: 25469 - protein, 29 aa, Artificial Sequence
  Description of Artificial Sequence: Synthetic peptide
DENEIRTTNPDATEQYGSVSTNLTEGVNR

SEQ ID NO: 25470 - protein, 30 aa, Artificial Sequence
  Description of Artificial Sequence: Synthetic polypeptide
DEEEIRATNPVATEQYGSVSTMNLQQEGNI

SEQ ID NO: 25471 - protein, 31 aa, Artificial Sequence
  Description of Artificial Sequence: Synthetic polypeptide
DEEEIRTTNPVATEQYGSVSTDLTQVRGEPR

SEQ ID NO: 25472 - protein, 28 aa, Artificial Sequence
  Description of Artificial Sequence: Synthetic peptide
DENEIRTTNIVATEQYGSVSENDQRGNQ

SEQ ID NO: 25473 - protein, 28 aa, Artificial Sequence
  Description of Artificial Sequence: Synthetic peptide
DEEEIRTTNPVATEQYGSVETDLQIGEF

SEQ ID NO: 25474 - protein, 28 aa, Artificial Sequence
  Description of Artificial Sequence: Synthetic peptide
DEEELRTTNPVASENYGSVSTNLQRGTQ

SEQ ID NO: 25475 - protein, 28 aa, Artificial Sequence
  Description of Artificial Sequence: Synthetic peptide
YEEEIRTTNPVSTEQYGAVSSNLQRGND

SEQ ID NO: 25476 - protein, 32 aa, Artificial Sequence
  Description of Artificial Sequence: Synthetic polypeptide
DEEEIRTTNPVATEQYGSVISTANLQREGVNF

SEQ ID NO: 25477 - protein, 29 aa, Artificial Sequence
  Description of Artificial Sequence: Synthetic peptide
DEEEIRTTNPVATECYGIYDTNLQNRGNR

SEQ ID NO: 25478 - protein, 30 aa, Artificial Sequence
  Description of Artificial Sequence: Synthetic polypeptide
DEQEVRTTNPVATEVYGSVSATNLQRNGNR

SEQ ID NO: 25479 - protein, 28 aa, Artificial Sequence
  Description of Artificial Sequence: Synthetic peptide
DEEEIRTTNIVAVEEYGCVGTNLQRGNR

SEQ ID NO: 25480 - protein, 29 aa, Artificial Sequence
  Description of Artificial Sequence: Synthetic peptide
DEEEIRTTNPVATEQYGIVYCTNLERGNM

SEQ ID NO: 25481 - protein, 29 aa, Artificial Sequence
  Description of Artificial Sequence: Synthetic peptide
DEEEIATTNPVATEQYGSVSATNLQTGDL

SEQ ID NO: 25482 - protein, 28 aa, Artificial Sequence
  Description of Artificial Sequence: Synthetic peptide
DEQEIRTTNPVATEQYGSVSTELEPGNI

SEQ ID NO: 25483 - protein, 28 aa, Artificial Sequence
  Description of Artificial Sequence: Synthetic peptide
DETEIRATNPVATEHYGCVATNLQRGNR

SEQ ID NO: 25484 - protein, 30 aa, Artificial Sequence
  Description of Artificial Sequence: Synthetic polypeptide
DEEELRTTNPVATEQWGSVSTNLEREGNDR

SEQ ID NO: 25485 - protein, 28 aa, Artificial Sequence
  Description of Artificial Sequence: Synthetic peptide
SEEEIRTTNPVATEQYGSYDTNLQGGNA

SEQ ID NO: 25486 - protein, 31 aa, Artificial Sequence
  Description of Artificial Sequence: Synthetic polypeptide
DEEEIGTTNPVATEQYGSVSTNQLQERMGNL

SEQ ID NO: 25487 - protein, 29 aa, Artificial Sequence
  Description of Artificial Sequence: Synthetic peptide
SEEEIRTTNPVATEQYGSVSENEQERGTR

SEQ ID NO: 25488 - protein, 28 aa, Artificial Sequence
  Description of Artificial Sequence: Synthetic peptide
DEEEIRTTNPFATEQYGSVSTDLQSGEH

SEQ ID NO: 25489 - protein, 28 aa, Artificial Sequence
  Description of Artificial Sequence: Synthetic peptide
DEEEIRTTNPVATECYGSVSTDLQWGDA

SEQ ID NO: 25490 - protein, 28 aa, Artificial Sequence
  Description of Artificial Sequence: Synthetic peptide
DEVEIRTTNPVCTEQYGCVSTNLERENR

SEQ ID NO: 25491 - protein, 28 aa, Artificial Sequence
  Description of Artificial Sequence: Synthetic peptide
EETEIRPTNPVATEQYGSVSDNLQRGTR

SEQ ID NO: 25492 - protein, 29 aa, Artificial Sequence
  Description of Artificial Sequence: Synthetic peptide
DEEEIRTTNPVCTEQYGTVDTNLQRGNDN

SEQ ID NO: 25493 - protein, 28 aa, Artificial Sequence
  Description of Artificial Sequence: Synthetic peptide
DEEEIRCVNPVATEQYGHVSTNLQHGNN

SEQ ID NO: 25494 - protein, 28 aa, Artificial Sequence
  Description of Artificial Sequence: Synthetic peptide
MEQEIRTTNPVATEQYGSVSTELQYGNN

SEQ ID NO: 25495 - protein, 30 aa, Artificial Sequence
  Description of Artificial Sequence: Synthetic polypeptide
SEVEIRTTNPVATETYGSVYSTANLQRGNR

SEQ ID NO: 25496 - protein, 28 aa, Artificial Sequence
  Description of Artificial Sequence: Synthetic peptide
DQEEIRTTNPVATECYGSVSTNLDFGNP

SEQ ID NO: 25497 - protein, 30 aa, Artificial Sequence
  Description of Artificial Sequence: Synthetic polypeptide
DEEEIRTTNPVATEQYGSVSADNLEYLGNR

SEQ ID NO: 25498 - protein, 28 aa, Artificial Sequence
  Description of Artificial Sequence: Synthetic peptide
DEEEIGTTNPVATELYGDVCTNWQRGNR

SEQ ID NO: 25499 - protein, 30 aa, Artificial Sequence
  Description of Artificial Sequence: Synthetic polypeptide
DEEEIRTTNPVATEQYGSVLCVNLQSPGNR

SEQ ID NO: 25500 - protein, 28 aa, Artificial Sequence
  Description of Artificial Sequence: Synthetic peptide
KEEEIRATNPVATEQYGSVSTDLQRGDA

SEQ ID NO: 25501 - protein, 31 aa, Artificial Sequence
  Description of Artificial Sequence: Synthetic polypeptide
DEEEIRTTNPVATEQYGSVHSTENLQPGDNQ

SEQ ID NO: 25502 - protein, 28 aa, Artificial Sequence
  Description of Artificial Sequence: Synthetic peptide
VEQEIVCTNPVSTEQYGSVSTNLQRGNR

SEQ ID NO: 25503 - protein, 30 aa, Artificial Sequence
  Description of Artificial Sequence: Synthetic polypeptide
DEEEIRTTNPVATEQYGSVDTQNLQTENFR

SEQ ID NO: 25504 - protein, 28 aa, Artificial Sequence
  Description of Artificial Sequence: Synthetic peptide
HEEEIRSTNPDATEQYGAVSTGLQRGNR

SEQ ID NO: 25505 - protein, 30 aa, Artificial Sequence
  Description of Artificial Sequence: Synthetic polypeptide
DEEEIRTTNPVATEQYGSVETELQEIGENR

SEQ ID NO: 25506 - protein, 30 aa, Artificial Sequence
  Description of Artificial Sequence: Synthetic polypeptide
KEEEIRTTNPVATEQYGSVSTNLQEYEGNL

SEQ ID NO: 25507 - protein, 28 aa, Artificial Sequence
  Description of Artificial Sequence: Synthetic peptide
DEECIRTTNPVATEQYWSVSDPLQRGER

SEQ ID NO: 25508 - protein, 28 aa, Artificial Sequence
  Description of Artificial Sequence: Synthetic peptide
DEEEIRTTNPVATEQYWSVETNLQDGEP

SEQ ID NO: 25509 - protein, 29 aa, Artificial Sequence
  Description of Artificial Sequence: Synthetic peptide
KEEEIRTTNPVATEQYGSVSTNLQDTGEL

SEQ ID NO: 25510 - protein, 30 aa, Artificial Sequence
  Description of Artificial Sequence: Synthetic polypeptide
DEEEIRTTNPDATEQYGSVSTNQQTRGENV

SEQ ID NO: 25511 - protein, 31 aa, Artificial Sequence
  Description of Artificial Sequence: Synthetic polypeptide
DENEIRTTNPVATEQYGSVDCTMNLQCRGNR

SEQ ID NO: 25512 - protein, 28 aa, Artificial Sequence
  Description of Artificial Sequence: Synthetic peptide
DEEEIRTTNPIATEIYGCVAMNLQRGNR

SEQ ID NO: 25513 - protein, 28 aa, Artificial Sequence
  Description of Artificial Sequence: Synthetic peptide
DEEEIRTTNPVATEQYGSVETNDQMEND

SEQ ID NO: 25514 - protein, 28 aa, Artificial Sequence
  Description of Artificial Sequence: Synthetic peptide
SENEIRTTNPVATEQYGWVSTNLQRGQA

SEQ ID NO: 25515 - protein, 32 aa, Artificial Sequence
  Description of Artificial Sequence: Synthetic polypeptide
DEEEIRTTNPVATEQYGSVTSTPNLVQIPGNR

SEQ ID NO: 25516 - protein, 29 aa, Artificial Sequence
  Description of Artificial Sequence: Synthetic peptide
DEEEIRTTNPVATEWYGSVDTNLQWQGDR

SEQ ID NO: 25517 - protein, 28 aa, Artificial Sequence
  Description of Artificial Sequence: Synthetic peptide
DEEEIRTTNPVATEQYGIASYNLMRGNQ

SEQ ID NO: 25518 - protein, 32 aa, Artificial Sequence
  Description of Artificial Sequence: Synthetic polypeptide
DEEEIRTTNPVATEQYGSVSETTNLERNGENR

SEQ ID NO: 25519 - protein, 30 aa, Artificial Sequence
  Description of Artificial Sequence: Synthetic polypeptide
DEEEIRTTNPVATEQYGSVSETNLQQGEEE

SEQ ID NO: 25520 - protein, 29 aa, Artificial Sequence
  Description of Artificial Sequence: Synthetic peptide
DEETIRTTNPVATEQYGEVSEYLQRGPNR

SEQ ID NO: 25521 - protein, 30 aa, Artificial Sequence
  Description of Artificial Sequence: Synthetic polypeptide
DEEEIRTTNPVATEQYGSVSTEPLQIFGER

SEQ ID NO: 25522 - protein, 28 aa, Artificial Sequence
  Description of Artificial Sequence: Synthetic peptide
DEEEIRTTNPVSTIQYGVVSTDLQAGNR

SEQ ID NO: 25523 - protein, 28 aa, Artificial Sequence
  Description of Artificial Sequence: Synthetic peptide
DEDEIRPTNPVATEQYGSVSECLQVGNR

SEQ ID NO: 25524 - protein, 30 aa, Artificial Sequence
  Description of Artificial Sequence: Synthetic polypeptide
SEEEIRTTNPVATEQYGSCSTNLQCAGGNR

SEQ ID NO: 25525 - protein, 28 aa, Artificial Sequence
  Description of Artificial Sequence: Synthetic peptide
MEQEIRTTNPVATEQYGSVSTELQNGNE

SEQ ID NO: 25526 - protein, 28 aa, Artificial Sequence
  Description of Artificial Sequence: Synthetic peptide
DEEEIRTTNPFATEQYGSVSENPDRGNS

SEQ ID NO: 25527 - protein, 28 aa, Artificial Sequence
  Description of Artificial Sequence: Synthetic peptide
DHEEIRTTNPVATEQYGSVWTEDQEGNR

SEQ ID NO: 25528 - protein, 30 aa, Artificial Sequence
  Description of Artificial Sequence: Synthetic polypeptide
DEEEIRTTNPSATEQYGSVSCTECYQRGNR

SEQ ID NO: 25529 - protein, 28 aa, Artificial Sequence
  Description of Artificial Sequence: Synthetic peptide
DEGEIRATNPTATEIYGDVSTNLQRGNR

SEQ ID NO: 25530 - protein, 29 aa, Artificial Sequence
  Description of Artificial Sequence: Synthetic peptide
DEEEIRTTNPVATEVYGSASTNLMRAMNR

SEQ ID NO: 25531 - protein, 28 aa, Artificial Sequence
  Description of Artificial Sequence: Synthetic peptide
DEHEIATVNPVSTEQYGSVSCNLQRGNR

SEQ ID NO: 25532 - protein, 28 aa, Artificial Sequence
  Description of Artificial Sequence: Synthetic peptide
DEQEIRCTNPVATECYGGVSSNLQRGNR

SEQ ID NO: 25533 - protein, 28 aa, Artificial Sequence
  Description of Artificial Sequence: Synthetic peptide
DELEIRTTNPVATEQYGSVSDCLQQQNR

SEQ ID NO: 25534 - protein, 29 aa, Artificial Sequence
  Description of Artificial Sequence: Synthetic peptide
QEQEIRTTNPVATEQYGEVSAENLQRGNR

SEQ ID NO: 25535 - protein, 28 aa, Artificial Sequence
  Description of Artificial Sequence: Synthetic peptide
DEEEIRTTNPEATELYGSVSTNPQFGNF

SEQ ID NO: 25536 - protein, 28 aa, Artificial Sequence
  Description of Artificial Sequence: Synthetic peptide
DEEEIRTTNPDATEQYGSVSTEDQWGER

SEQ ID NO: 25537 - protein, 28 aa, Artificial Sequence
  Description of Artificial Sequence: Synthetic peptide
AEEELRTTNPVATEMYGVVGTNLQRGNR

SEQ ID NO: 25538 - protein, 29 aa, Artificial Sequence
  Description of Artificial Sequence: Synthetic peptide
YEEEIRTVNPVATEQYGSASTNLQRGNDN

SEQ ID NO: 25539 - protein, 28 aa, Artificial Sequence
  Description of Artificial Sequence: Synthetic peptide
NEEEIKTTNIVATEQYGSVATNLQRSNR

SEQ ID NO: 25540 - protein, 28 aa, Artificial Sequence
  Description of Artificial Sequence: Synthetic peptide
DEEEIRTTNPTATELFGSVSTNPQRGNQ

SEQ ID NO: 25541 - protein, 28 aa, Artificial Sequence
  Description of Artificial Sequence: Synthetic peptide
DEEEIVTTNPVATECYGSVSTELQTGNQ

SEQ ID NO: 25542 - protein, 28 aa, Artificial Sequence
  Description of Artificial Sequence: Synthetic peptide
DEEEIVTTNPTATEFYGSVSLNLQNGNR

SEQ ID NO: 25543 - protein, 29 aa, Artificial Sequence
  Description of Artificial Sequence: Synthetic peptide
QEDEITTVNPVATEQYGSVSTNLQQRGNR

SEQ ID NO: 25544 - protein, 28 aa, Artificial Sequence
  Description of Artificial Sequence: Synthetic peptide
DEEEIRTTNPFATEQYGSVSTDLDLGNT

SEQ ID NO: 25545 - protein, 29 aa, Artificial Sequence
  Description of Artificial Sequence: Synthetic peptide
DEEEIRTTNPVATEWWGSVDTNLQWQGNR

SEQ ID NO: 25546 - protein, 29 aa, Artificial Sequence
  Description of Artificial Sequence: Synthetic peptide
YECEIRTTNPVATEQYGSVSTALQRGNDE

SEQ ID NO: 25547 - protein, 31 aa, Artificial Sequence
  Description of Artificial Sequence: Synthetic polypeptide
DEEEIRTTNPVAYEQSYGSYVSTNLDREGNR

SEQ ID NO: 25548 - protein, 28 aa, Artificial Sequence
  Description of Artificial Sequence: Synthetic peptide
DEEEIRTTNPFATEQYGSVSTPQDYGNR

SEQ ID NO: 25549 - protein, 29 aa, Artificial Sequence
  Description of Artificial Sequence: Synthetic peptide
DEQEIATTNPVATEQYGEVSAENLQRGNR

SEQ ID NO: 25550 - protein, 28 aa, Artificial Sequence
  Description of Artificial Sequence: Synthetic peptide
DEEEIRTTNPVATEQYWSVSTEPQMGNN

SEQ ID NO: 25551 - protein, 28 aa, Artificial Sequence
  Description of Artificial Sequence: Synthetic peptide
DEEEIATTNIVATEQYGSVSTNLQNGET

SEQ ID NO: 25552 - protein, 28 aa, Artificial Sequence
  Description of Artificial Sequence: Synthetic peptide
DEQEVRTTNPVASEQYGSVATNLERGNR

SEQ ID NO: 25553 - protein, 30 aa, Artificial Sequence
  Description of Artificial Sequence: Synthetic polypeptide
DEEEIRTTNPVATEQYGSVESTDELDTGNR

SEQ ID NO: 25554 - protein, 30 aa, Artificial Sequence
  Description of Artificial Sequence: Synthetic polypeptide
DEEEIRTTNPVATEQYGSAVSTANGQAGNE

SEQ ID NO: 25555 - protein, 29 aa, Artificial Sequence
  Description of Artificial Sequence: Synthetic peptide
DEEEIRCTNPVATEQYGSYSTNLMMRGNW

SEQ ID NO: 25556 - protein, 28 aa, Artificial Sequence
  Description of Artificial Sequence: Synthetic peptide
DEEEIRTTNPVATEQYGSVETEDEEGNR

SEQ ID NO: 25557 - protein, 30 aa, Artificial Sequence
  Description of Artificial Sequence: Synthetic polypeptide
DEEEIRTTNPVATEQYGSVSCTDDQENGNR

SEQ ID NO: 25558 - protein, 31 aa, Artificial Sequence
  Description of Artificial Sequence: Synthetic polypeptide
DEEEIRATNPVATEQYGISVSTNLQRQGTDR

SEQ ID NO: 25559 - protein, 28 aa, Artificial Sequence
  Description of Artificial Sequence: Synthetic peptide
MEEEIRTTNPVATEQYGSVSEDLQQGNT

SEQ ID NO: 25560 - protein, 28 aa, Artificial Sequence
  Description of Artificial Sequence: Synthetic peptide
DEEEIRATNPVATEFYGSVSTNEQHGNS

SEQ ID NO: 25561 - protein, 28 aa, Artificial Sequence
  Description of Artificial Sequence: Synthetic peptide
DEDEIGTTNPTGTEQYGSVSTNLQRGNF

SEQ ID NO: 25562 - protein, 28 aa, Artificial Sequence
  Description of Artificial Sequence: Synthetic peptide
DEEELRTTNPIATEHYGSVDTNLQRGDR

SEQ ID NO: 25563 - protein, 30 aa, Artificial Sequence
  Description of Artificial Sequence: Synthetic polypeptide
DEQEIRTTNPVASEQYGSVSAMNLQRNGNR

SEQ ID NO: 25564 - protein, 32 aa, Artificial Sequence
  Description of Artificial Sequence: Synthetic polypeptide
DEEEIRTTNPVATEQYGSVESATNLQIREGER

SEQ ID NO: 25565 - protein, 28 aa, Artificial Sequence
  Description of Artificial Sequence: Synthetic peptide
AEEEIRQTNPVATEQYGSVSENLEVGNR

SEQ ID NO: 25566 - protein, 31 aa, Artificial Sequence
  Description of Artificial Sequence: Synthetic polypeptide
DEEEIRTTNPTATEQYGSVISTNLQEFGNTR

SEQ ID NO: 25567 - protein, 32 aa, Artificial Sequence
  Description of Artificial Sequence: Synthetic polypeptide
DEEEIRTTNPVATEQYGSVSETNPLVERGDNR

SEQ ID NO: 25568 - protein, 30 aa, Artificial Sequence
  Description of Artificial Sequence: Synthetic polypeptide
DEEEIRTTNPEATEQYGSVSTNEQERGNDT

SEQ ID NO: 25569 - protein, 30 aa, Artificial Sequence
  Description of Artificial Sequence: Synthetic polypeptide
DEEEIRTTNPVATEQYGSVSTNLQDHGDDQ

SEQ ID NO: 25570 - protein, 28 aa, Artificial Sequence
  Description of Artificial Sequence: Synthetic peptide
DEEEIRCTNPVATEQYGSVDTNLMRGTA

SEQ ID NO: 25571 - protein, 28 aa, Artificial Sequence
  Description of Artificial Sequence: Synthetic peptide
DEEEICTTNPECTEIYGSVSTNLQQGNR

SEQ ID NO: 25572 - protein, 28 aa, Artificial Sequence
  Description of Artificial Sequence: Synthetic peptide
DEEEIRTVNPVCTEQWGSMSTNLQIGNR

SEQ ID NO: 25573 - protein, 28 aa, Artificial Sequence
  Description of Artificial Sequence: Synthetic peptide
DEEAIRTTNPVAAECYGSWSTNLQRGER

SEQ ID NO: 25574 - protein, 28 aa, Artificial Sequence
  Description of Artificial Sequence: Synthetic peptide
DEQEIATTNPVATEVYGVVSTNLMRGNR

SEQ ID NO: 25575 - protein, 28 aa, Artificial Sequence
  Description of Artificial Sequence: Synthetic peptide
DEQELRTVNPVATEQYGSVSMNLQRPNR

SEQ ID NO: 25576 - protein, 31 aa, Artificial Sequence
  Description of Artificial Sequence: Synthetic polypeptide
DEEEIRTTNPVCTEQYGSVSTMNLQCCRGNA

SEQ ID NO: 25577 - protein, 29 aa, Artificial Sequence
  Description of Artificial Sequence: Synthetic peptide
DETEIRTTNPVATEQYGCVSETNLQRLIR

SEQ ID NO: 25578 - protein, 28 aa, Artificial Sequence
  Description of Artificial Sequence: Synthetic peptide
DEEEIRTTNPVAVEQYGEVGENLQRGNW

SEQ ID NO: 25579 - protein, 29 aa, Artificial Sequence
  Description of Artificial Sequence: Synthetic peptide
DETEISTTNPVATEQYGSVSTNVQRGDNF

SEQ ID NO: 25580 - protein, 30 aa, Artificial Sequence
  Description of Artificial Sequence: Synthetic polypeptide
DEEEIRTTNPDATEQYGSVTSTADQRDGNR

SEQ ID NO: 25581 - protein, 28 aa, Artificial Sequence
  Description of Artificial Sequence: Synthetic peptide
REAEIRTTNPVATEQYGSVSTDLQRQER

SEQ ID NO: 25582 - protein, 28 aa, Artificial Sequence
  Description of Artificial Sequence: Synthetic peptide
DEQEIRTTNPDATEQYGSVSTNLENGER

SEQ ID NO: 25583 - protein, 29 aa, Artificial Sequence
  Description of Artificial Sequence: Synthetic peptide
DEEEIRSTNPVCSEQYGTVSTNLQIRGNR

SEQ ID NO: 25584 - protein, 28 aa, Artificial Sequence
  Description of Artificial Sequence: Synthetic peptide
DEEEICCTNPVCTEQYGSVSTNLERLNR

SEQ ID NO: 25585 - protein, 28 aa, Artificial Sequence
  Description of Artificial Sequence: Synthetic peptide
DEEEICTTNPVATEQYGDVSELLVRGNR

SEQ ID NO: 25586 - protein, 28 aa, Artificial Sequence
  Description of Artificial Sequence: Synthetic peptide
DEQEIRTTNPVATEQWGSVDENLQRGNA

SEQ ID NO: 25587 - protein, 28 aa, Artificial Sequence
  Description of Artificial Sequence: Synthetic peptide
DEEEIRTTNPECTEQYGSVSTAVQRGER

SEQ ID NO: 25588 - protein, 30 aa, Artificial Sequence
  Description of Artificial Sequence: Synthetic polypeptide
DEEEIRGTNCVATEQWGSYVSTNLQRGENR

SEQ ID NO: 25589 - protein, 29 aa, Artificial Sequence
  Description of Artificial Sequence: Synthetic peptide
DEEEIRTTNPVATEQFGGVSATNLYRGNF

SEQ ID NO: 25590 - protein, 29 aa, Artificial Sequence
  Description of Artificial Sequence: Synthetic peptide
DEEEIRTTNPVATEQYGSVSEDLQTGNDM

SEQ ID NO: 25591 - protein, 30 aa, Artificial Sequence
  Description of Artificial Sequence: Synthetic polypeptide
DEEEIRTTNPVATAQYGSYSTNLSERGFNR

SEQ ID NO: 25592 - protein, 31 aa, Artificial Sequence
  Description of Artificial Sequence: Synthetic polypeptide
DEEEIRTTNPVATEQYWGTSWSTDNLQRGER

SEQ ID NO: 25593 - protein, 31 aa, Artificial Sequence
  Description of Artificial Sequence: Synthetic polypeptide
DEEEIRTTNPVATEQYGSVESTELQIRGNDT

SEQ ID NO: 25594 - protein, 28 aa, Artificial Sequence
  Description of Artificial Sequence: Synthetic peptide
DEVEIRTTNPVATEQYGGVSENEQRGTR

SEQ ID NO: 25595 - protein, 30 aa, Artificial Sequence
  Description of Artificial Sequence: Synthetic polypeptide
DEEEIRTTNPVATEKYGMSVHTNPLQPGNR

SEQ ID NO: 25596 - protein, 28 aa, Artificial Sequence
  Description of Artificial Sequence: Synthetic peptide
DEEEIRSTNPDATEQYGNVSTNLDDGNR

SEQ ID NO: 25597 - protein, 28 aa, Artificial Sequence
  Description of Artificial Sequence: Synthetic peptide
NDAEIRATNPVATEQYGSVSTNLQRGTR

SEQ ID NO: 25598 - protein, 28 aa, Artificial Sequence
  Description of Artificial Sequence: Synthetic peptide
DEEEIRTTNPDATEQYGSVSTDLEDGNS

SEQ ID NO: 25599 - protein, 28 aa, Artificial Sequence
  Description of Artificial Sequence: Synthetic peptide
DEEEIRTTNPVATEQYGSVSTTCQREEM

SEQ ID NO: 25600 - protein, 28 aa, Artificial Sequence
  Description of Artificial Sequence: Synthetic peptide
DENEIRTTNPVATEQYGIVSTNEQTGTR

SEQ ID NO: 25601 - protein, 28 aa, Artificial Sequence
  Description of Artificial Sequence: Synthetic peptide
DEEEIVTTNPVCTEIYGSVSTNLEIGNR

SEQ ID NO: 25602 - protein, 28 aa, Artificial Sequence
  Description of Artificial Sequence: Synthetic peptide
DEEEISTTNILATEQYGSVSTNLARGNN

SEQ ID NO: 25603 - protein, 28 aa, Artificial Sequence
  Description of Artificial Sequence: Synthetic peptide
DENEIRSVNPVAYEMYGSVSTNLQRGNR

SEQ ID NO: 25604 - protein, 30 aa, Artificial Sequence
  Description of Artificial Sequence: Synthetic polypeptide
DEEEIRTTNPVATEQYGSWSLTNDQMSGNR

SEQ ID NO: 25605 - protein, 30 aa, Artificial Sequence
  Description of Artificial Sequence: Synthetic polypeptide
SEEEIRTTNPVATEQYGEVSTNLQDIGNDR

SEQ ID NO: 25606 - protein, 28 aa, Artificial Sequence
  Description of Artificial Sequence: Synthetic peptide
DEVEIRTTNPVSTEQYGSVSENGQRGNF

SEQ ID NO: 25607 - protein, 30 aa, Artificial Sequence
  Description of Artificial Sequence: Synthetic polypeptide
DEEEIRTTNPFATEQYGVVSATTNLERGNR

SEQ ID NO: 25608 - protein, 28 aa, Artificial Sequence
  Description of Artificial Sequence: Synthetic peptide
DEEEIRTTNIFATEQYGSVETNDDRGNR

SEQ ID NO: 25609 - protein, 28 aa, Artificial Sequence
  Description of Artificial Sequence: Synthetic peptide
DEEEVRTTNPVATEQYGDVSAELQVGNR

SEQ ID NO: 25610 - protein, 28 aa, Artificial Sequence
  Description of Artificial Sequence: Synthetic peptide
DEEEIRTTNPFATEQYGSVSTGQELGNR

SEQ ID NO: 25611 - protein, 28 aa, Artificial Sequence
  Description of Artificial Sequence: Synthetic peptide
DEEEIRTTNPCATEQYGSVDTNQQHGNN

SEQ ID NO: 25612 - protein, 31 aa, Artificial Sequence
  Description of Artificial Sequence: Synthetic polypeptide
DEEEIRTTNPVATEQYGSVDETENLERGNDR

SEQ ID NO: 25613 - protein, 28 aa, Artificial Sequence
  Description of Artificial Sequence: Synthetic peptide
DNEEIRTTNPEATEQYGSVSTNLDSGNA

SEQ ID NO: 25614 - protein, 28 aa, Artificial Sequence
  Description of Artificial Sequence: Synthetic peptide
DEEEIRTVNPVATEQYGSCATNLQWGDR

SEQ ID NO: 25615 - protein, 28 aa, Artificial Sequence
  Description of Artificial Sequence: Synthetic peptide
FEEEIRTVNPVATEPYGSVSENLQRGNT

SEQ ID NO: 25616 - protein, 30 aa, Artificial Sequence
  Description of Artificial Sequence: Synthetic polypeptide
DEEEIRTTNPVATEQYGESWDSTNLQREER

SEQ ID NO: 25617 - protein, 28 aa, Artificial Sequence
  Description of Artificial Sequence: Synthetic peptide
DEECIRTTNPVATEQGGSVETNLQQGDR

SEQ ID NO: 25618 - protein, 31 aa, Artificial Sequence
  Description of Artificial Sequence: Synthetic polypeptide
DEEEIRTTNPEATEQYGSVSVTNLQAGINPR

SEQ ID NO: 25619 - protein, 29 aa, Artificial Sequence
  Description of Artificial Sequence: Synthetic peptide
DEYEIRTTNPVATEQYGIVSITNLQPGER

SEQ ID NO: 25620 - protein, 28 aa, Artificial Sequence
  Description of Artificial Sequence: Synthetic peptide
CEEEIRTTNPVASEQYGSASYNLQRGNW

SEQ ID NO: 25621 - protein, 30 aa, Artificial Sequence
  Description of Artificial Sequence: Synthetic polypeptide
DEEEIRTTNPVATEQYGSWSTQNLDVVGNR

SEQ ID NO: 25622 - protein, 28 aa, Artificial Sequence
  Description of Artificial Sequence: Synthetic peptide
DEEELRTTNPCSTEQYGSVAYNLQRGNR

SEQ ID NO: 25623 - protein, 28 aa, Artificial Sequence
  Description of Artificial Sequence: Synthetic peptide
DDEEIRTTNPVATEMYGAVSTNLDRGDR

SEQ ID NO: 25624 - protein, 28 aa, Artificial Sequence
  Description of Artificial Sequence: Synthetic peptide
DEEEIRTTNPVATEQYGSVDEDLQGGNV

SEQ ID NO: 25625 - protein, 28 aa, Artificial Sequence
  Description of Artificial Sequence: Synthetic peptide
DEEEIRTTNPVATEQYGSVETNDEPGNF

SEQ ID NO: 25626 - protein, 28 aa, Artificial Sequence
  Description of Artificial Sequence: Synthetic peptide
DENEIVQTNPVAYEQYGSVSNNLQRGNR

SEQ ID NO: 25627 - protein, 28 aa, Artificial Sequence
  Description of Artificial Sequence: Synthetic peptide
DEEEIKTTNIVATEEYGYVSTNLQRGNT

SEQ ID NO: 25628 - protein, 28 aa, Artificial Sequence
  Description of Artificial Sequence: Synthetic peptide
QEEEIRTTNPVSTEQYGSASTVLQHGNR

SEQ ID NO: 25629 - protein, 28 aa, Artificial Sequence
  Description of Artificial Sequence: Synthetic peptide
DEDEIVTVNPVATENYGSVATNLQRGNR

SEQ ID NO: 25630 - protein, 31 aa, Artificial Sequence
  Description of Artificial Sequence: Synthetic polypeptide
DEEEIRTTNPVATEQYGSVSETNLQLINGND

SEQ ID NO: 25631 - protein, 28 aa, Artificial Sequence
  Description of Artificial Sequence: Synthetic peptide
DEEEIRTTNPVATEQYGSVSTCLDEGDA

SEQ ID NO: 25632 - protein, 28 aa, Artificial Sequence
  Description of Artificial Sequence: Synthetic peptide
DEVEIRTTNPVATEQYGTASTNLCRGNE

SEQ ID NO: 25633 - protein, 28 aa, Artificial Sequence
  Description of Artificial Sequence: Synthetic peptide
AESEIATTNPVATEEYGSASTNLQRGNR

SEQ ID NO: 25634 - protein, 32 aa, Artificial Sequence
  Description of Artificial Sequence: Synthetic polypeptide
DEEEIRTTNPVATEQYGSVSTCNGLQQREGNF

SEQ ID NO: 25635 - protein, 28 aa, Artificial Sequence
  Description of Artificial Sequence: Synthetic peptide
KEEEIATVNPVATEQYGSVSTNLQSGNC

SEQ ID NO: 25636 - protein, 28 aa, Artificial Sequence
  Description of Artificial Sequence: Synthetic peptide
DEEEINATNPVATEQYGSVSTNMQRGED

SEQ ID NO: 25637 - protein, 29 aa, Artificial Sequence
  Description of Artificial Sequence: Synthetic peptide
DEEEIRTTNPVATEQYGDVSENLQCHGNA

SEQ ID NO: 25638 - protein, 28 aa, Artificial Sequence
  Description of Artificial Sequence: Synthetic peptide
DEEELRTTNPVSTECYGSVANNLQRGNR

SEQ ID NO: 25639 - protein, 28 aa, Artificial Sequence
  Description of Artificial Sequence: Synthetic peptide
DENEIRTTNPVATECYGSVSTELQRGEA

SEQ ID NO: 25640 - protein, 28 aa, Artificial Sequence
  Description of Artificial Sequence: Synthetic peptide
DEEEIRTTNPVATEQYGDASTNEQHENR

SEQ ID NO: 25641 - protein, 28 aa, Artificial Sequence
  Description of Artificial Sequence: Synthetic peptide
DEEEVATTNPVATEVYGSVSTNLQRTNT

SEQ ID NO: 25642 - protein, 28 aa, Artificial Sequence
  Description of Artificial Sequence: Synthetic peptide
DEEEIRTTNPEATEQYGSVSTEDQDGER

SEQ ID NO: 25643 - protein, 30 aa, Artificial Sequence
  Description of Artificial Sequence: Synthetic polypeptide
KEEEIRTTNPVATEQYGSVSTNLQREGDDN

SEQ ID NO: 25644 - protein, 32 aa, Artificial Sequence
  Description of Artificial Sequence: Synthetic polypeptide
DEEEIRTTNPVATEQYGSVSCTNLQRDGENDC

SEQ ID NO: 25645 - protein, 28 aa, Artificial Sequence
  Description of Artificial Sequence: Synthetic peptide
DEHEIRTTNPVATEQYGTVDEELQRGNR

SEQ ID NO: 25646 - protein, 28 aa, Artificial Sequence
  Description of Artificial Sequence: Synthetic peptide
AEEEIRTTNPFATEQYGSVSEGLQVGNR

SEQ ID NO: 25647 - protein, 30 aa, Artificial Sequence
  Description of Artificial Sequence: Synthetic polypeptide
DEEEIRTTNPVATEQYGSVSTNGQLRNGEA

SEQ ID NO: 25648 - protein, 28 aa, Artificial Sequence
  Description of Artificial Sequence: Synthetic peptide
DEQEIRTTNPVATEQCGSVSDNLQTGNA

SEQ ID NO: 25649 - protein, 31 aa, Artificial Sequence
  Description of Artificial Sequence: Synthetic polypeptide
DEEEIRTTNPVATEQYGSVSATNLQLVNGND

SEQ ID NO: 25650 - protein, 28 aa, Artificial Sequence
  Description of Artificial Sequence: Synthetic peptide
DEEKIRTTNPVATEQYGCVSTNLLRMGR

SEQ ID NO: 25651 - protein, 30 aa, Artificial Sequence
  Description of Artificial Sequence: Synthetic polypeptide
DEEEIKTTNPVATELWGSVSATNLQRNGNR

SEQ ID NO: 25652 - protein, 28 aa, Artificial Sequence
  Description of Artificial Sequence: Synthetic peptide
DEEEVRTTNPVSTEIYGTVATNLQRGNR

SEQ ID NO: 25653 - protein, 31 aa, Artificial Sequence
  Description of Artificial Sequence: Synthetic polypeptide
DEEEIRTTNPDATEQYGSVSTNPLEREGENR

SEQ ID NO: 25654 - protein, 28 aa, Artificial Sequence
  Description of Artificial Sequence: Synthetic peptide
DEEEITSTNPVATEQYGSVSENLQRGTF

SEQ ID NO: 25655 - protein, 28 aa, Artificial Sequence
  Description of Artificial Sequence: Synthetic peptide
DEEEIRTTNIVGTECYGSVSTNLQITNR

SEQ ID NO: 25656 - protein, 29 aa, Artificial Sequence
  Description of Artificial Sequence: Synthetic peptide
DEEEIATTNPVATEQYGSVSTNLMHAFNR

SEQ ID NO: 25657 - protein, 28 aa, Artificial Sequence
  Description of Artificial Sequence: Synthetic peptide
DEEEIRTTNPVASELYGVVSTNLQRGTQ

SEQ ID NO: 25658 - protein, 29 aa, Artificial Sequence
  Description of Artificial Sequence: Synthetic peptide
DEEEIRTTNPEATEQYGSVSENLEREGER

SEQ ID NO: 25659 - protein, 28 aa, Artificial Sequence
  Description of Artificial Sequence: Synthetic peptide
DEEEIRTTNPVATEQYGIVDTNEQVGTR

SEQ ID NO: 25660 - protein, 28 aa, Artificial Sequence
  Description of Artificial Sequence: Synthetic peptide
DEDEIRATNPVSTELYGVVSTNLQRGNR

SEQ ID NO: 25661 - protein, 30 aa, Artificial Sequence
  Description of Artificial Sequence: Synthetic polypeptide
QEEEIRCTNPVATMQYGSVSTNLQFRGNER

SEQ ID NO: 25662 - protein, 30 aa, Artificial Sequence
  Description of Artificial Sequence: Synthetic polypeptide
REEEIRTTNPVATEIYGSVSAANLQLRGNR

SEQ ID NO: 25663 - protein, 30 aa, Artificial Sequence
  Description of Artificial Sequence: Synthetic polypeptide
DEEEIRTTNPVATECYGSVSTDLQERKGNI

SEQ ID NO: 25664 - protein, 29 aa, Artificial Sequence
  Description of Artificial Sequence: Synthetic peptide
DEEEIGTTNPVATEQYGSASCVLQRAGNR

SEQ ID NO: 25665 - protein, 29 aa, Artificial Sequence
  Description of Artificial Sequence: Synthetic peptide
DENEIRTVNPVATELYGSVSTNLQRGVLR

SEQ ID NO: 25666 - protein, 28 aa, Artificial Sequence
  Description of Artificial Sequence: Synthetic peptide
DEEEIYCTNPTATEQFGSVSTNLQRGNV

SEQ ID NO: 25667 - protein, 30 aa, Artificial Sequence
  Description of Artificial Sequence: Synthetic polypeptide
DEEEIRTTNPVATEQYGSWSTMNEQLRGNF

SEQ ID NO: 25668 - protein, 31 aa, Artificial Sequence
  Description of Artificial Sequence: Synthetic polypeptide
DEEEIRTTNPDATEQYGSVCSTVDLQRGENR

SEQ ID NO: 25669 - protein, 28 aa, Artificial Sequence
  Description of Artificial Sequence: Synthetic peptide
DDEEIRTTNPVATEQWGIVDTNLQVGNR

SEQ ID NO: 25670 - protein, 28 aa, Artificial Sequence
  Description of Artificial Sequence: Synthetic peptide
DEEEISTTNPVATECYGSVSTNLQDGEY

SEQ ID NO: 25671 - protein, 28 aa, Artificial Sequence
  Description of Artificial Sequence: Synthetic peptide
DEVEIRTTNPVSTEQFGCVSENLQRGNR

SEQ ID NO: 25672 - protein, 28 aa, Artificial Sequence
  Description of Artificial Sequence: Synthetic peptide
DENEIAQTNPVATEQYGSVSTCLQRGER

SEQ ID NO: 25673 - protein, 28 aa, Artificial Sequence
  Description of Artificial Sequence: Synthetic peptide
DEQEVATTNPVATELYGWVSTNLQRGNR

SEQ ID NO: 25674 - protein, 28 aa, Artificial Sequence
  Description of Artificial Sequence: Synthetic peptide
DEEEIRTTNPVATEQYWSVETNLDRGEP

SEQ ID NO: 25675 - protein, 28 aa, Artificial Sequence
  Description of Artificial Sequence: Synthetic peptide
DDEEIRTTNPVASEQYGWVSTNLQIGNN

SEQ ID NO: 25676 - protein, 29 aa, Artificial Sequence
  Description of Artificial Sequence: Synthetic peptide
DEVEIRTTNPVACEQYGSVSTIVQRSGNR

SEQ ID NO: 25677 - protein, 31 aa, Artificial Sequence
  Description of Artificial Sequence: Synthetic polypeptide
DEEEITTTNPVATEIYGSVSTNLQDRNGDNR

SEQ ID NO: 25678 - protein, 28 aa, Artificial Sequence
  Description of Artificial Sequence: Synthetic peptide
DEEEIRSTNPVAVECYGAVATNLQRGNR

SEQ ID NO: 25679 - protein, 28 aa, Artificial Sequence
  Description of Artificial Sequence: Synthetic peptide
DDEEISTTNPVAVEQYGSVSANLQRLNR

SEQ ID NO: 25680 - protein, 32 aa, Artificial Sequence
  Description of Artificial Sequence: Synthetic polypeptide
DEEEIRTTNPVATEQYGSVDSETNLQREGENF

SEQ ID NO: 25681 - protein, 28 aa, Artificial Sequence
  Description of Artificial Sequence: Synthetic peptide
QEEEIGTTNPVATEQYGIVSEVLQRGNR

SEQ ID NO: 25682 - protein, 28 aa, Artificial Sequence
  Description of Artificial Sequence: Synthetic peptide
DEEEVRCTNPVATEQYGTVGTNLQRGPR

SEQ ID NO: 25683 - protein, 32 aa, Artificial Sequence
  Description of Artificial Sequence: Synthetic polypeptide
DEEEIRSTNPVATEQYGSVTSTENLPQFRGNR

SEQ ID NO: 25684 - protein, 28 aa, Artificial Sequence
  Description of Artificial Sequence: Synthetic peptide
DEEEIVTTNPVATEQYGDVSENLNRGER

SEQ ID NO: 25685 - protein, 28 aa, Artificial Sequence
  Description of Artificial Sequence: Synthetic peptide
DEDEISTTNPAATEQYGEVSTNLQIGNR

SEQ ID NO: 25686 - protein, 28 aa, Artificial Sequence
  Description of Artificial Sequence: Synthetic peptide
AEEEIRQTNPVATEQYGDVSTPLQHGNR

SEQ ID NO: 25687 - protein, 29 aa, Artificial Sequence
  Description of Artificial Sequence: Synthetic peptide
DEQEIRTTNPVATEQYGMSCSNNLQEGNR

SEQ ID NO: 25688 - protein, 28 aa, Artificial Sequence
  Description of Artificial Sequence: Synthetic peptide
DEEEIRTTNPFATEQYGSVSTCLQPGEP

SEQ ID NO: 25689 - protein, 30 aa, Artificial Sequence
  Description of Artificial Sequence: Synthetic polypeptide
DEEEIRTTNPVATFQYGSVSTNLLREEYNR

SEQ ID NO: 25690 - protein, 29 aa, Artificial Sequence
  Description of Artificial Sequence: Synthetic peptide
DEECIRTTNPVATEQYGSWDYNLQRGDNR

SEQ ID NO: 25691 - protein, 28 aa, Artificial Sequence
  Description of Artificial Sequence: Synthetic peptide
DEECIRTTNPVATQQYGSVSDNLQEGER

SEQ ID NO: 25692 - protein, 30 aa, Artificial Sequence
  Description of Artificial Sequence: Synthetic polypeptide
DEEEIATTNPTATEQYGSVSTNEQDREGNR

SEQ ID NO: 25693 - protein, 28 aa, Artificial Sequence
  Description of Artificial Sequence: Synthetic peptide
DEEEIRCVNPVATEQYGAVSTNLQHGNF

SEQ ID NO: 25694 - protein, 28 aa, Artificial Sequence
  Description of Artificial Sequence: Synthetic peptide
DECECRTTNPVATEQYGVASSNLQRGNR

SEQ ID NO: 25695 - protein, 31 aa, Artificial Sequence
  Description of Artificial Sequence: Synthetic polypeptide
DEEEIRTTNPVATEQYGSVESETNLERGENG

SEQ ID NO: 25696 - protein, 31 aa, Artificial Sequence
  Description of Artificial Sequence: Synthetic polypeptide
DEEEIRTTNPVATEQYGSVDSTNPLQRGEDV

SEQ ID NO: 25697 - protein, 28 aa, Artificial Sequence
  Description of Artificial Sequence: Synthetic peptide
DDEEIRTTNPVAYEQYGAVGSNLQRGNR

SEQ ID NO: 25698 - protein, 28 aa, Artificial Sequence
  Description of Artificial Sequence: Synthetic peptide
DEEEIRTTNPVALEQYGSVNTNPQTGND

SEQ ID NO: 25699 - protein, 29 aa, Artificial Sequence
  Description of Artificial Sequence: Synthetic peptide
QEQEIRTTNPVATEQYGWVSAENLQRGNR

SEQ ID NO: 25700 - protein, 31 aa, Artificial Sequence
  Description of Artificial Sequence: Synthetic polypeptide
DEEEIAQTNPVATEQYGSVSTTNLQLRGENR

SEQ ID NO: 25701 - protein, 28 aa, Artificial Sequence
  Description of Artificial Sequence: Synthetic peptide
CEESIRTTNPVATEQYGSVSTNPQHGND

SEQ ID NO: 25702 - protein, 28 aa, Artificial Sequence
  Description of Artificial Sequence: Synthetic peptide
DEQEIRTTNIVAYEQYGSVSTNFQRGNT

SEQ ID NO: 25703 - protein, 28 aa, Artificial Sequence
  Description of Artificial Sequence: Synthetic peptide
DEEEIKTTNPVCTEQYGAVSTNWQRPNR

SEQ ID NO: 25704 - protein, 28 aa, Artificial Sequence
  Description of Artificial Sequence: Synthetic peptide
DENEIKGTNPVSTEQYGSVSTNLQRGQR

SEQ ID NO: 25705 - protein, 28 aa, Artificial Sequence
  Description of Artificial Sequence: Synthetic peptide
REGEICTTNPVATEQYGSVSTLLQRLNR

SEQ ID NO: 25706 - protein, 30 aa, Artificial Sequence
  Description of Artificial Sequence: Synthetic polypeptide
DEEEIRTTNPVATETYGEVSTANLQRGNQS

SEQ ID NO: 25707 - protein, 28 aa, Artificial Sequence
  Description of Artificial Sequence: Synthetic peptide
DEEEIATTNITATEQYGSVSTNLQNGER

SEQ ID NO: 25708 - protein, 28 aa, Artificial Sequence
  Description of Artificial Sequence: Synthetic peptide
DEVELATTNPVATEQYGGTSTNLQRGNR

SEQ ID NO: 25709 - protein, 28 aa, Artificial Sequence
  Description of Artificial Sequence: Synthetic peptide
DEEVICTTNIVATEQYGSVSTNLDRGNS

SEQ ID NO: 25710 - protein, 28 aa, Artificial Sequence
  Description of Artificial Sequence: Synthetic peptide
QEQEIRQTNPVATEQYGSVSTVLQHGNR

SEQ ID NO: 25711 - protein, 28 aa, Artificial Sequence
  Description of Artificial Sequence: Synthetic peptide
PEECIRTTNPVATEQYGSVSHNDDRGNR

SEQ ID NO: 25712 - protein, 29 aa, Artificial Sequence
  Description of Artificial Sequence: Synthetic peptide
SEQEIRTTNPVATEQYGWVTATNLQRGNR

SEQ ID NO: 25713 - protein, 30 aa, Artificial Sequence
  Description of Artificial Sequence: Synthetic polypeptide
DEEEIRTTNPVATEQYGSVSTNLQESEGES

SEQ ID NO: 25714 - protein, 29 aa, Artificial Sequence
  Description of Artificial Sequence: Synthetic peptide
DEENIRTTNPVATEIYGQVTTNLQRGSNR

SEQ ID NO: 25715 - protein, 28 aa, Artificial Sequence
  Description of Artificial Sequence: Synthetic peptide
DELEICTTNPVATEWYGDVSNNLQRGNR

SEQ ID NO: 25716 - protein, 28 aa, Artificial Sequence
  Description of Artificial Sequence: Synthetic peptide
DEEEIRTTNPEATEQYGSVSTEDQRGEF

SEQ ID NO: 25717 - protein, 32 aa, Artificial Sequence
  Description of Artificial Sequence: Synthetic polypeptide
DEEEIRTTNPVATEQYGSVSTQNPLQEWGNPR

SEQ ID NO: 25718 - protein, 30 aa, Artificial Sequence
  Description of Artificial Sequence: Synthetic polypeptide
DEEEIATTNPVATEQYGDVSTNLQCHGNDR

SEQ ID NO: 25719 - protein, 29 aa, Artificial Sequence
  Description of Artificial Sequence: Synthetic peptide
DEEEIRTTNPVATEQYGSVSDNDEYEGNR

SEQ ID NO: 25720 - protein, 28 aa, Artificial Sequence
  Description of Artificial Sequence: Synthetic peptide
DEEEIRSTNPEATEQYGAVSTNLQQGNF

SEQ ID NO: 25721 - protein, 28 aa, Artificial Sequence
  Description of Artificial Sequence: Synthetic peptide
DEEEIRTTNPVATEQYGNYSTALQVGTR

SEQ ID NO: 25722 - protein, 28 aa, Artificial Sequence
  Description of Artificial Sequence: Synthetic peptide
DEEEIRTTNPTATEQYGDVSTNEQNENR

SEQ ID NO: 25723 - protein, 29 aa, Artificial Sequence
  Description of Artificial Sequence: Synthetic peptide
DEEEIRTTNPVATEQYGDVSCENLCLGNR

SEQ ID NO: 25724 - protein, 28 aa, Artificial Sequence
  Description of Artificial Sequence: Synthetic peptide
DEEEIRTTNPVATEQYWSVSTNPNDGNP

SEQ ID NO: 25725 - protein, 29 aa, Artificial Sequence
  Description of Artificial Sequence: Synthetic peptide
DNEEIRTTNPVATCQYGSVSTNLCRMGNC

SEQ ID NO: 25726 - protein, 28 aa, Artificial Sequence
  Description of Artificial Sequence: Synthetic peptide
DEEEICATNPVATENYGLVSDNLQRGNR

SEQ ID NO: 25727 - protein, 31 aa, Artificial Sequence
  Description of Artificial Sequence: Synthetic polypeptide
DEEEIRTTNPVATEAYGASVSVSNGLQRGNR

SEQ ID NO: 25728 - protein, 32 aa, Artificial Sequence
  Description of Artificial Sequence: Synthetic polypeptide
DEEEIRTTNPVATEQYWGSVSDTNPLQRGEPR

SEQ ID NO: 25729 - protein, 28 aa, Artificial Sequence
  Description of Artificial Sequence: Synthetic peptide
DEEEIRTTNPVATEQYGSVSDGEQRGGI

SEQ ID NO: 25730 - protein, 31 aa, Artificial Sequence
  Description of Artificial Sequence: Synthetic polypeptide
DEEEIRTTNPVATEQYGYSMVSNANLQPGNR

SEQ ID NO: 25731 - protein, 28 aa, Artificial Sequence
  Description of Artificial Sequence: Synthetic peptide
DEEEIWTTNPVATEQYGTVSEVLQRGGR

SEQ ID NO: 25732 - protein, 28 aa, Artificial Sequence
  Description of Artificial Sequence: Synthetic peptide
DEQELRCTNPCATEQYGSVATNLQRGNR

SEQ ID NO: 25733 - protein, 29 aa, Artificial Sequence
  Description of Artificial Sequence: Synthetic peptide
DEEEIRTTNPVATEQYGSVSNCILQLGER

SEQ ID NO: 25734 - protein, 29 aa, Artificial Sequence
  Description of Artificial Sequence: Synthetic peptide
DEEEIAATNPVATEQYGAVSTNLEREGNR

SEQ ID NO: 25735 - protein, 31 aa, Artificial Sequence
  Description of Artificial Sequence: Synthetic polypeptide
DEEEIRTTNPVATEQYWGSVHWTNDQRHGNR

SEQ ID NO: 25736 - protein, 29 aa, Artificial Sequence
  Description of Artificial Sequence: Synthetic peptide
SEEEIRTTNPVATEVYGSVSTNLQWTGNF

SEQ ID NO: 25737 - protein, 31 aa, Artificial Sequence
  Description of Artificial Sequence: Synthetic polypeptide
DEEEIRTTNPVATEQYGSVSTNLQLVNGNDF

SEQ ID NO: 25738 - protein, 31 aa, Artificial Sequence
  Description of Artificial Sequence: Synthetic polypeptide
DEEEIRTTNPVATEQYGWVSATTNQVQRGNR

SEQ ID NO: 25739 - protein, 28 aa, Artificial Sequence
  Description of Artificial Sequence: Synthetic peptide
DEEEIRCTNPVATEQYGSVDTNLMRGDF

SEQ ID NO: 25740 - protein, 31 aa, Artificial Sequence
  Description of Artificial Sequence: Synthetic polypeptide
DEEEIRTTNPVATEQYGSVESETNDQRGNDY

SEQ ID NO: 25741 - protein, 30 aa, Artificial Sequence
  Description of Artificial Sequence: Synthetic polypeptide
DEEEIRTTNPFATEQYGSVSTNLVERNGER

SEQ ID NO: 25742 - protein, 28 aa, Artificial Sequence
  Description of Artificial Sequence: Synthetic peptide
DENEIRTTNPVATEQYGSVSECLQHGER

SEQ ID NO: 25743 - protein, 30 aa, Artificial Sequence
  Description of Artificial Sequence: Synthetic polypeptide
DEEEIRTVNPVASEQYGSVSTGELQIRGNR

SEQ ID NO: 25744 - protein, 31 aa, Artificial Sequence
  Description of Artificial Sequence: Synthetic polypeptide
DEEEIRTTNPVATEQYGSVDSTMNDVQRENR

SEQ ID NO: 25745 - protein, 29 aa, Artificial Sequence
  Description of Artificial Sequence: Synthetic peptide
KEEEIRTTNPVATEQYGWVSTNLEDTGNR

SEQ ID NO: 25746 - protein, 28 aa, Artificial Sequence
  Description of Artificial Sequence: Synthetic peptide
YEEEIATTNPVCTEQYGSVSEDLQRGNR

SEQ ID NO: 25747 - protein, 28 aa, Artificial Sequence
  Description of Artificial Sequence: Synthetic peptide
DEEEIRTTNIVATCEYGSVETNLSRGNR

SEQ ID NO: 25748 - protein, 28 aa, Artificial Sequence
  Description of Artificial Sequence: Synthetic peptide
DEQEIRTTNPVASEIYGCVATNLQRGNR

SEQ ID NO: 25749 - protein, 29 aa, Artificial Sequence
  Description of Artificial Sequence: Synthetic peptide
DEEEIRTTNPVATEQYGSVSDDLQMGNDN

SEQ ID NO: 25750 - protein, 31 aa, Artificial Sequence
  Description of Artificial Sequence: Synthetic polypeptide
DEEEIRTTNPVATEQYGSVSCTNPLQAGFLR

SEQ ID NO: 25751 - protein, 28 aa, Artificial Sequence
  Description of Artificial Sequence: Synthetic peptide
DEEEIRTTNPVATEQYGDVSTNLDNGEN

SEQ ID NO: 25752 - protein, 28 aa, Artificial Sequence
  Description of Artificial Sequence: Synthetic peptide
QETEIRATNPVATEQYGVVSTNLQRGGR

SEQ ID NO: 25753 - protein, 30 aa, Artificial Sequence
  Description of Artificial Sequence: Synthetic polypeptide
DEEEIRATNPVATEQYGDVSTPLTQRGINR

SEQ ID NO: 25754 - protein, 30 aa, Artificial Sequence
  Description of Artificial Sequence: Synthetic polypeptide
DEEEVRTTNPCATEQYGSVCDTNLQREGNR

SEQ ID NO: 25755 - protein, 32 aa, Artificial Sequence
  Description of Artificial Sequence: Synthetic polypeptide
DEEEIRTTNPVATEQYGSVSTVNPLEERDGNR

SEQ ID NO: 25756 - protein, 28 aa, Artificial Sequence
  Description of Artificial Sequence: Synthetic peptide
MEEEIATTNQVATEQYGSVSENLERGNR

SEQ ID NO: 25757 - protein, 28 aa, Artificial Sequence
  Description of Artificial Sequence: Synthetic peptide
DEDEIRCTNPAATEQYGSVSTNWQRGNF

SEQ ID NO: 25758 - protein, 28 aa, Artificial Sequence
  Description of Artificial Sequence: Synthetic peptide
DEEEIKTTNPVATAQYGSVNDNLQRGNM

SEQ ID NO: 25759 - protein, 28 aa, Artificial Sequence
  Description of Artificial Sequence: Synthetic peptide
DEEEIRQTNPVATENYGSVATILQRGNA

SEQ ID NO: 25760 - protein, 33 aa, Artificial Sequence
  Description of Artificial Sequence: Synthetic polypeptide
DEEEIRTTNPVATEQYGSVDSTNLQEREGDNER

SEQ ID NO: 25761 - protein, 31 aa, Artificial Sequence
  Description of Artificial Sequence: Synthetic polypeptide
DEEEIRTTNPVATEQYGSVSTNLQEIKGNDH

SEQ ID NO: 25762 - protein, 30 aa, Artificial Sequence
  Description of Artificial Sequence: Synthetic polypeptide
DEEEIYTTNPVATEQYGSVSITNLQILGNP

SEQ ID NO: 25763 - protein, 29 aa, Artificial Sequence
  Description of Artificial Sequence: Synthetic peptide
DEEEIRTTNPVATECYGYGSTNLQRGNDQ

SEQ ID NO: 25764 - protein, 28 aa, Artificial Sequence
  Description of Artificial Sequence: Synthetic peptide
QEEEIRTTNIVATEQYGEASENLQRGNR

SEQ ID NO: 25765 - protein, 31 aa, Artificial Sequence
  Description of Artificial Sequence: Synthetic polypeptide
DEEEIRTTNPVATEQYGSVSTVNGQIPGINR

SEQ ID NO: 25766 - protein, 29 aa, Artificial Sequence
  Description of Artificial Sequence: Synthetic peptide
KEEEIRATNPVATEQYGSVSTDLQIGNDR

SEQ ID NO: 25767 - protein, 30 aa, Artificial Sequence
  Description of Artificial Sequence: Synthetic polypeptide
DEEEIRTTNPVATEQYGSVETNDVQRGNDF

SEQ ID NO: 25768 - protein, 28 aa, Artificial Sequence
  Description of Artificial Sequence: Synthetic peptide
DEEEIRTTNPVATEQYWSVSTGQQYDNR

SEQ ID NO: 25769 - protein, 29 aa, Artificial Sequence
  Description of Artificial Sequence: Synthetic peptide
DEEEIRQTNPVATEQYGVVSTVLQRAGGR

SEQ ID NO: 25770 - protein, 29 aa, Artificial Sequence
  Description of Artificial Sequence: Synthetic peptide
DEEEIATTNPVATECYGSVSTNLQILGDR

SEQ ID NO: 25771 - protein, 28 aa, Artificial Sequence
  Description of Artificial Sequence: Synthetic peptide
DDEEIRSTNPVATEMYGSVSTNLERGNY

SEQ ID NO: 25772 - protein, 28 aa, Artificial Sequence
  Description of Artificial Sequence: Synthetic peptide
DEQEIRATNPVASEQYGCVSMNLQRGNR

SEQ ID NO: 25773 - protein, 32 aa, Artificial Sequence
  Description of Artificial Sequence: Synthetic polypeptide
DEEEIRTTNPVATEQYGESVSTNPLVQIGENR

SEQ ID NO: 25774 - protein, 30 aa, Artificial Sequence
  Description of Artificial Sequence: Synthetic polypeptide
DEEEIRTTNPDATEQYGSVASTGLVIRGNR

SEQ ID NO: 25775 - protein, 31 aa, Artificial Sequence
  Description of Artificial Sequence: Synthetic polypeptide
VEEEVRTTNPVATEQYGSVSTWNLDQRIGNR

SEQ ID NO: 25776 - protein, 28 aa, Artificial Sequence
  Description of Artificial Sequence: Synthetic peptide
ADEEIRATNPVATEQYGSVSTNQQRQNR

SEQ ID NO: 25777 - protein, 28 aa, Artificial Sequence
  Description of Artificial Sequence: Synthetic peptide
DEEEIRTTNIVATEQYGVVSTNNQNGND

SEQ ID NO: 25778 - protein, 28 aa, Artificial Sequence
  Description of Artificial Sequence: Synthetic peptide
DEEEIRTTNPVATEQYGSVETDEQMGDR

SEQ ID NO: 25779 - protein, 28 aa, Artificial Sequence
  Description of Artificial Sequence: Synthetic peptide
DEEEIRTTNPVATEQYGSWDTNDQRDDR

SEQ ID NO: 25780 - protein, 28 aa, Artificial Sequence
  Description of Artificial Sequence: Synthetic peptide
DEEEVRCTNPVATEIYGSVATNLERGNR

SEQ ID NO: 25781 - protein, 28 aa, Artificial Sequence
  Description of Artificial Sequence: Synthetic peptide
DEEEIRTTNPVATEQYGSVETDDQRGEA

SEQ ID NO: 25782 - protein, 31 aa, Artificial Sequence
  Description of Artificial Sequence: Synthetic polypeptide
YEEEIRCTNPVATEQYGSVSCTNLQRFGENR

SEQ ID NO: 25783 - protein, 30 aa, Artificial Sequence
  Description of Artificial Sequence: Synthetic polypeptide
DEEEIRTTNPVATEQYGSVSVSFNLQRVNI

SEQ ID NO: 25784 - protein, 30 aa, Artificial Sequence
  Description of Artificial Sequence: Synthetic polypeptide
DEEEIATTNPVATEQYGSVSTDLEDREGNR

SEQ ID NO: 25785 - protein, 28 aa, Artificial Sequence
  Description of Artificial Sequence: Synthetic peptide
DEQEIAATNPVATEMYGSVATNLQRGNR

SEQ ID NO: 25786 - protein, 28 aa, Artificial Sequence
  Description of Artificial Sequence: Synthetic peptide
DEEEIRTTNPEATEQYGSVSDNLQDENI

SEQ ID NO: 25787 - protein, 28 aa, Artificial Sequence
  Description of Artificial Sequence: Synthetic peptide
DEEEIRTTNIVATEQYGSVSTNLQDMVT

SEQ ID NO: 25788 - protein, 28 aa, Artificial Sequence
  Description of Artificial Sequence: Synthetic peptide
DEEEIRTTNPVCTEQYGVVDTDLQHGNR

SEQ ID NO: 25789 - protein, 28 aa, Artificial Sequence
  Description of Artificial Sequence: Synthetic peptide
DEEEIRTTNPVATEQYGSWSTCEQRGDP

SEQ ID NO: 25790 - protein, 28 aa, Artificial Sequence
  Description of Artificial Sequence: Synthetic peptide
DEEEIRTVNPVATEQYGWVSTNLEGGNG

SEQ ID NO: 25791 - protein, 28 aa, Artificial Sequence
  Description of Artificial Sequence: Synthetic peptide
DENEIVATNPVATEVYGVVSTNLQRGNR

SEQ ID NO: 25792 - protein, 29 aa, Artificial Sequence
  Description of Artificial Sequence: Synthetic peptide
QENEIRTTNPVATEQYGDVSTQLQRAGNR

SEQ ID NO: 25793 - protein, 28 aa, Artificial Sequence
  Description of Artificial Sequence: Synthetic peptide
HEGEIRTTNPVATEHYGTVSTNLQRGNG

SEQ ID NO: 25794 - protein, 28 aa, Artificial Sequence
  Description of Artificial Sequence: Synthetic peptide
NEEEIRTTNPVCTEQYGSVSMNLERGNH

SEQ ID NO: 25795 - protein, 30 aa, Artificial Sequence
  Description of Artificial Sequence: Synthetic polypeptide
DEEEIRTTNPVATEQYGSVSCTDLQCNGNN

SEQ ID NO: 25796 - protein, 28 aa, Artificial Sequence
  Description of Artificial Sequence: Synthetic peptide
DEETIRTTNPVACEQYGTVSGNLDRGNR

SEQ ID NO: 25797 - protein, 28 aa, Artificial Sequence
  Description of Artificial Sequence: Synthetic peptide
DEEEIRTTNPVGIEQYGSVSEDLQIGNR

SEQ ID NO: 25798 - protein, 32 aa, Artificial Sequence
  Description of Artificial Sequence: Synthetic polypeptide
DEEEIRTTNPEATEQYGSVISTENLQERGPNR

SEQ ID NO: 25799 - protein, 29 aa, Artificial Sequence
  Description of Artificial Sequence: Synthetic peptide
DEHEMRTTNPVATEQYGSVSMNIQERGNR

SEQ ID NO: 25800 - protein, 28 aa, Artificial Sequence
  Description of Artificial Sequence: Synthetic peptide
DEEEIRCTNPVATEIYGCVAMNLQRGNR

SEQ ID NO: 25801 - protein, 28 aa, Artificial Sequence
  Description of Artificial Sequence: Synthetic peptide
DEEEISSTNPVATEQYGSVDTNDQRGNP

SEQ ID NO: 25802 - protein, 31 aa, Artificial Sequence
  Description of Artificial Sequence: Synthetic polypeptide
DEEEIATTNPVATEQYGSVSTNLQDREGNTE

SEQ ID NO: 25803 - protein, 28 aa, Artificial Sequence
  Description of Artificial Sequence: Synthetic peptide
DEEEIRTTNPEATEQYGSVSTNDERGEM

SEQ ID NO: 25804 - protein, 28 aa, Artificial Sequence
  Description of Artificial Sequence: Synthetic peptide
QEQEIRTTNPVATEQYGEVSTQLQRGGR

SEQ ID NO: 25805 - protein, 28 aa, Artificial Sequence
  Description of Artificial Sequence: Synthetic peptide
DEEEIAACNPVATEQYGSVSTGPQRGNR

SEQ ID NO: 25806 - protein, 28 aa, Artificial Sequence
  Description of Artificial Sequence: Synthetic peptide
DEEEIRTTNPFATEQYGSVSTNEDVGNQ

SEQ ID NO: 25807 - protein, 31 aa, Artificial Sequence
  Description of Artificial Sequence: Synthetic polypeptide
DEEEIRTTNPVATEQYGSWSTNPDTQRGNDR

SEQ ID NO: 25808 - protein, 28 aa, Artificial Sequence
  Description of Artificial Sequence: Synthetic peptide
GEEEIRTTNPVAHENYGCVATNLQRGNR

SEQ ID NO: 25809 - protein, 28 aa, Artificial Sequence
  Description of Artificial Sequence: Synthetic peptide
DEEEIRTTNIVATEQYGTVCTNLFTGNR

SEQ ID NO: 25810 - protein, 28 aa, Artificial Sequence
  Description of Artificial Sequence: Synthetic peptide
DEEEIRTVNPDATEQYGSVSTDLQNGNE

SEQ ID NO: 25811 - protein, 28 aa, Artificial Sequence
  Description of Artificial Sequence: Synthetic peptide
DEEEIRTTNPDATEQYGSVSTDEQFGER

SEQ ID NO: 25812 - protein, 28 aa, Artificial Sequence
  Description of Artificial Sequence: Synthetic peptide
DDSEIHTTNPVACEQYGSVSTNLQRGTR

SEQ ID NO: 25813 - protein, 30 aa, Artificial Sequence
  Description of Artificial Sequence: Synthetic polypeptide
DEEEIRTTNPVATEQYGSVSTELQETEGNM

SEQ ID NO: 25814 - protein, 28 aa, Artificial Sequence
  Description of Artificial Sequence: Synthetic peptide
DEEEIRTTNPVATEQYGSVETPDEPGNR

SEQ ID NO: 25815 - protein, 29 aa, Artificial Sequence
  Description of Artificial Sequence: Synthetic peptide
DEEEIRTTNPVATEQYGDVSENLQCQGDR

SEQ ID NO: 25816 - protein, 29 aa, Artificial Sequence
  Description of Artificial Sequence: Synthetic peptide
DEEEIRTTNPDATEQYGSVSTGLVQRPIR

SEQ ID NO: 25817 - protein, 31 aa, Artificial Sequence
  Description of Artificial Sequence: Synthetic polypeptide
DEQEIRTTNPVATEQYGDVSCTMNLQRGNDR

SEQ ID NO: 25818 - protein, 31 aa, Artificial Sequence
  Description of Artificial Sequence: Synthetic polypeptide
DEEEIRTTNPEATEQYGSVSTNLQERDGDDR

SEQ ID NO: 25819 - protein, 31 aa, Artificial Sequence
  Description of Artificial Sequence: Synthetic polypeptide
DEEEIRTTNPEATEQYGVVSTLNLPQRGNFR

SEQ ID NO: 25820 - protein, 28 aa, Artificial Sequence
  Description of Artificial Sequence: Synthetic peptide
DEEEIRTTNIVATEQWGSVSTNLEQGER

SEQ ID NO: 25821 - protein, 29 aa, Artificial Sequence
  Description of Artificial Sequence: Synthetic peptide
DEEEIRQTNPVATEVYGSVSTNLPQIGNI

SEQ ID NO: 25822 - protein, 30 aa, Artificial Sequence
  Description of Artificial Sequence: Synthetic polypeptide
DEEEITTTNPVATEQYGSVSIFNLQIGNAR

SEQ ID NO: 25823 - protein, 28 aa, Artificial Sequence
  Description of Artificial Sequence: Synthetic peptide
DEEEIRTTNPEATEQYGSVSTNPQVGTV

SEQ ID NO: 25824 - protein, 30 aa, Artificial Sequence
  Description of Artificial Sequence: Synthetic polypeptide
DEQEIRTTNPVATEQYGSYVETPNPQRGNR

SEQ ID NO: 25825 - protein, 31 aa, Artificial Sequence
  Description of Artificial Sequence: Synthetic polypeptide
DEEEIRTTNPVATEQYGSVSTNLVEDHGNDR

SEQ ID NO: 25826 - protein, 30 aa, Artificial Sequence
  Description of Artificial Sequence: Synthetic polypeptide
DEEEIRTTNPVATEQYGSVDCTMDLQRGNL

SEQ ID NO: 25827 - protein, 28 aa, Artificial Sequence
  Description of Artificial Sequence: Synthetic peptide
QEQEIVTTNPVATEQYGDVSENLQRGNR

SEQ ID NO: 25828 - protein, 28 aa, Artificial Sequence
  Description of Artificial Sequence: Synthetic peptide
DEEEIGTTNPVATEQYGSVSTGLDWGNA

SEQ ID NO: 25829 - protein, 28 aa, Artificial Sequence
  Description of Artificial Sequence: Synthetic peptide
DEEEIRTTNPVATECYGSVSTILQQLNC

SEQ ID NO: 25830 - protein, 28 aa, Artificial Sequence
  Description of Artificial Sequence: Synthetic peptide
DEEEIRTTNPVATEQFGCVETNLDPGNR

SEQ ID NO: 25831 - protein, 28 aa, Artificial Sequence
  Description of Artificial Sequence: Synthetic peptide
DEEEIRATNPFATEQYGTVSTNLNVGNR

SEQ ID NO: 25832 - protein, 28 aa, Artificial Sequence
  Description of Artificial Sequence: Synthetic peptide
DEEEIRTTNIVATECYGSVSTNLQQGEI

SEQ ID NO: 25833 - protein, 29 aa, Artificial Sequence
  Description of Artificial Sequence: Synthetic peptide
DEEEIRQTNPVATEVYGSVSTVLQRAGGR

SEQ ID NO: 25834 - protein, 31 aa, Artificial Sequence
  Description of Artificial Sequence: Synthetic polypeptide
DEEEIRTTNPVATEQYGSVSCTMDLQRGNDC

SEQ ID NO: 25835 - protein, 28 aa, Artificial Sequence
  Description of Artificial Sequence: Synthetic peptide
VEDEIRCTNPVASEQYGGVSTNLQRGNR

SEQ ID NO: 25836 - protein, 28 aa, Artificial Sequence
  Description of Artificial Sequence: Synthetic peptide
DEEEIRTTNPVATEQYGFVSELLQYDNR

SEQ ID NO: 25837 - protein, 32 aa, Artificial Sequence
  Description of Artificial Sequence: Synthetic polypeptide
DEEEIRTTNPVATEQYGSVSETNLQVRGENDN

SEQ ID NO: 25838 - protein, 28 aa, Artificial Sequence
  Description of Artificial Sequence: Synthetic peptide
MEEEIRTTNPVCTDTYGSVATNLQRGNR

SEQ ID NO: 25839 - protein, 28 aa, Artificial Sequence
  Description of Artificial Sequence: Synthetic peptide
DEEEIRTTNPFATEQYGSVMTNLDVGNM

SEQ ID NO: 25840 - protein, 28 aa, Artificial Sequence
  Description of Artificial Sequence: Synthetic peptide
DEEEIRTTNPVATEQYGDVSENLQHGEN

SEQ ID NO: 25841 - protein, 29 aa, Artificial Sequence
  Description of Artificial Sequence: Synthetic peptide
MENEIRTTNPVATEQYGSVSTDLQNGNDR

SEQ ID NO: 25842 - protein, 30 aa, Artificial Sequence
  Description of Artificial Sequence: Synthetic polypeptide
CEEQIRTTNPVATEQYGSYVSDHNLQRGNR

SEQ ID NO: 25843 - protein, 29 aa, Artificial Sequence
  Description of Artificial Sequence: Synthetic peptide
DAGEIRTTNPVATEQYGSVSTNKLQLGMR

SEQ ID NO: 25844 - protein, 29 aa, Artificial Sequence
  Description of Artificial Sequence: Synthetic peptide
DEEEIRTTNPVATECWGSVSTNLEIRGDR

SEQ ID NO: 25845 - protein, 28 aa, Artificial Sequence
  Description of Artificial Sequence: Synthetic peptide
DEEEIRTTNPVATEQYGSVDTELDSGER

SEQ ID NO: 25846 - protein, 28 aa, Artificial Sequence
  Description of Artificial Sequence: Synthetic peptide
DEEEIGTTNPVATETYGVVSTLLQRGQR

SEQ ID NO: 25847 - protein, 28 aa, Artificial Sequence
  Description of Artificial Sequence: Synthetic peptide
DDEEIRCTNPVATEHFGSVSTNLQRGTR

SEQ ID NO: 25848 - protein, 28 aa, Artificial Sequence
  Description of Artificial Sequence: Synthetic peptide
DESEIRTTNPVSTECYGSVSTELCRGNR

SEQ ID NO: 25849 - protein, 28 aa, Artificial Sequence
  Description of Artificial Sequence: Synthetic peptide
DEEEIRTTNPTATELFGSVSTNPQRGTR

SEQ ID NO: 25850 - protein, 28 aa, Artificial Sequence
  Description of Artificial Sequence: Synthetic peptide
DENEIRTTNPVATEQYGDVSTCLCRGER

SEQ ID NO: 25851 - protein, 28 aa, Artificial Sequence
  Description of Artificial Sequence: Synthetic peptide
SEEEIRTTNPTATEQYGSVSENLQSGNN

SEQ ID NO: 25852 - protein, 29 aa, Artificial Sequence
  Description of Artificial Sequence: Synthetic peptide
DEEEIASTNPVAYEQYGEVSTNLQERGNR

SEQ ID NO: 25853 - protein, 31 aa, Artificial Sequence
  Description of Artificial Sequence: Synthetic polypeptide
DEEEIRTTNPDATEQYGSVSDTDNLVQRGER

SEQ ID NO: 25854 - protein, 30 aa, Artificial Sequence
  Description of Artificial Sequence: Synthetic polypeptide
DEEEIRQTNPVATENYGSVSTNLQRDGENC

SEQ ID NO: 25855 - protein, 28 aa, Artificial Sequence
  Description of Artificial Sequence: Synthetic peptide
DESEITCTNPVATEIYGTVSTNLQRGNR

SEQ ID NO: 25856 - protein, 29 aa, Artificial Sequence
  Description of Artificial Sequence: Synthetic peptide
DEEEIRTTNPVATEMMGSVSTNLQAAGNH

SEQ ID NO: 25857 - protein, 28 aa, Artificial Sequence
  Description of Artificial Sequence: Synthetic peptide
DENEIRTTNPVATEHYGSVSTNLQDGEN

SEQ ID NO: 25858 - protein, 28 aa, Artificial Sequence
  Description of Artificial Sequence: Synthetic peptide
DEEEIRTTNPVATDQYGSVSTNLMSGGA

SEQ ID NO: 25859 - protein, 29 aa, Artificial Sequence
  Description of Artificial Sequence: Synthetic peptide
DEEEIRTTNPVATEQYWSVEETPLQRGNP

SEQ ID NO: 25860 - protein, 30 aa, Artificial Sequence
  Description of Artificial Sequence: Synthetic polypeptide
DEEEIRTTNPVATEQYGTVSTNLQEAGDNC

SEQ ID NO: 25861 - protein, 28 aa, Artificial Sequence
  Description of Artificial Sequence: Synthetic peptide
DEEEIRQTNPVATEGYGIASTNLQRGMR

SEQ ID NO: 25862 - protein, 28 aa, Artificial Sequence
  Description of Artificial Sequence: Synthetic peptide
DEEEIRTTNPVATEQYGSWSTCDQFGNW

SEQ ID NO: 25863 - protein, 29 aa, Artificial Sequence
  Description of Artificial Sequence: Synthetic peptide
DEEEITTTNPVATEQYGDVSCENLQHGNR

SEQ ID NO: 25864 - protein, 28 aa, Artificial Sequence
  Description of Artificial Sequence: Synthetic peptide
SEEEIRCTNPIATEQYGSVSENLMRGNR

SEQ ID NO: 25865 - protein, 30 aa, Artificial Sequence
  Description of Artificial Sequence: Synthetic polypeptide
DEQEIRTTNPVATEQYGSVSTDGLQDRGNH

SEQ ID NO: 25866 - protein, 30 aa, Artificial Sequence
  Description of Artificial Sequence: Synthetic polypeptide
DEEEIRTTNPVATEQYGSVSCTDLQYGNDQ

SEQ ID NO: 25867 - protein, 29 aa, Artificial Sequence
  Description of Artificial Sequence: Synthetic peptide
DENEIRTTNPVAYEQYGSVSTNLQANGNG

SEQ ID NO: 25868 - protein, 28 aa, Artificial Sequence
  Description of Artificial Sequence: Synthetic peptide
DEFEIVTTNPVATEQYGEVSTNLQFGNF

SEQ ID NO: 25869 - protein, 31 aa, Artificial Sequence
  Description of Artificial Sequence: Synthetic polypeptide
DEEEIRTTNPVATEQYGSVSTQNNLLDRGNS

SEQ ID NO: 25870 - protein, 28 aa, Artificial Sequence
  Description of Artificial Sequence: Synthetic peptide
DEVEIRTTNPVASEQYGSVSTNLQGGTA

SEQ ID NO: 25871 - protein, 28 aa, Artificial Sequence
  Description of Artificial Sequence: Synthetic peptide
DEEEIRATNPVSTEIYGSVSTNLQRPQR

SEQ ID NO: 25872 - protein, 28 aa, Artificial Sequence
  Description of Artificial Sequence: Synthetic peptide
DTEEIRTTNPQATEHYGSVSFNLQRENR

SEQ ID NO: 25873 - protein, 28 aa, Artificial Sequence
  Description of Artificial Sequence: Synthetic peptide
DEGEIRSVNPVATEQYGSVSTNLQSGNA

SEQ ID NO: 25874 - protein, 28 aa, Artificial Sequence
  Description of Artificial Sequence: Synthetic peptide
DEEEIRTTNPVATECYGWVSTDLERGNA

SEQ ID NO: 25875 - protein, 28 aa, Artificial Sequence
  Description of Artificial Sequence: Synthetic peptide
DEEEIRTTNPVATEQYGSVSTGPYQGNF

SEQ ID NO: 25876 - protein, 29 aa, Artificial Sequence
  Description of Artificial Sequence: Synthetic peptide
DEQEIRTTNPVATEQYGSVSTNLQEGEEN

SEQ ID NO: 25877 - protein, 28 aa, Artificial Sequence
  Description of Artificial Sequence: Synthetic peptide
DEEEIRTTNPVATEQYGSVSTPDEIGNS

SEQ ID NO: 25878 - protein, 31 aa, Artificial Sequence
  Description of Artificial Sequence: Synthetic polypeptide
DEEEIRTTNPVATEQYGSVSCTMDLQRGNDD

SEQ ID NO: 25879 - protein, 28 aa, Artificial Sequence
  Description of Artificial Sequence: Synthetic peptide
CEEEIATTNPVATEQYGIVSTNLDRGNN

SEQ ID NO: 25880 - protein, 28 aa, Artificial Sequence
  Description of Artificial Sequence: Synthetic peptide
DEHEIRTTNPVATEQYGDVSTAWQNGNR

SEQ ID NO: 25881 - protein, 29 aa, Artificial Sequence
  Description of Artificial Sequence: Synthetic peptide
DEEEIRTTNPVATEQYGIVSDLPQRSGNR

SEQ ID NO: 25882 - protein, 28 aa, Artificial Sequence
  Description of Artificial Sequence: Synthetic peptide
DEEEIRTTNPVATEQYGCVSDNLQNGTG

SEQ ID NO: 25883 - protein, 28 aa, Artificial Sequence
  Description of Artificial Sequence: Synthetic peptide
AEEEIRTTNPVSTEQYGSVSTNQERGNH

SEQ ID NO: 25884 - protein, 28 aa, Artificial Sequence
  Description of Artificial Sequence: Synthetic peptide
DESEIRSTNPVATEQYGSVSTDLQNGER

SEQ ID NO: 25885 - protein, 28 aa, Artificial Sequence
  Description of Artificial Sequence: Synthetic peptide
DEEEIRTTNPVATELYGSVSTDLEVGNH

SEQ ID NO: 25886 - protein, 28 aa, Artificial Sequence
  Description of Artificial Sequence: Synthetic peptide
DEEEIATTNPVATEQYGSVSTDLQHGEM

SEQ ID NO: 25887 - protein, 28 aa, Artificial Sequence
  Description of Artificial Sequence: Synthetic peptide
MEEEIRTTNPVATECYGSVSTDLQTGNS

SEQ ID NO: 25888 - protein, 31 aa, Artificial Sequence
  Description of Artificial Sequence: Synthetic polypeptide
DEEEIRTTNPVATEQYGSVSTNPPQREGPFR

SEQ ID NO: 25889 - protein, 28 aa, Artificial Sequence
  Description of Artificial Sequence: Synthetic peptide
SEEEIRTTNPVATEQYGSVSTNEQHGTA

SEQ ID NO: 25890 - protein, 29 aa, Artificial Sequence
  Description of Artificial Sequence: Synthetic peptide
DENEIRTTNPVSTEQYGDVSATNLQRGGR

SEQ ID NO: 25891 - protein, 28 aa, Artificial Sequence
  Description of Artificial Sequence: Synthetic peptide
DEEEIRTTNPVATEQYGSVSTDDEEGNN

SEQ ID NO: 25892 - protein, 29 aa, Artificial Sequence
  Description of Artificial Sequence: Synthetic peptide
DEEEIRTTNPVAWEQYGSVSTNNLQIGDL

SEQ ID NO: 25893 - protein, 30 aa, Artificial Sequence
  Description of Artificial Sequence: Synthetic polypeptide
DEEEIRTTNPVATEGYGSVSAANMDQRGNR

SEQ ID NO: 25894 - protein, 30 aa, Artificial Sequence
  Description of Artificial Sequence: Synthetic polypeptide
DEEEIRTTNPVAYEQYGSVSTMNLVQGGNY

SEQ ID NO: 25895 - protein, 29 aa, Artificial Sequence
  Description of Artificial Sequence: Synthetic peptide
DEEEIRSTNPVATEQYGSVSTNLQIVGED

SEQ ID NO: 25896 - protein, 28 aa, Artificial Sequence
  Description of Artificial Sequence: Synthetic peptide
DENEIATTNPVATECYGSVSTNLQNGNL

SEQ ID NO: 25897 - protein, 29 aa, Artificial Sequence
  Description of Artificial Sequence: Synthetic peptide
MEEEIRTTNPVATEQYGSMSTNLQREGDL

SEQ ID NO: 25898 - protein, 28 aa, Artificial Sequence
  Description of Artificial Sequence: Synthetic peptide
DEEEIRTTNPVATEQYGSVSTEDDLGNV

SEQ ID NO: 25899 - protein, 28 aa, Artificial Sequence
  Description of Artificial Sequence: Synthetic peptide
DENEIRTTNPVATEQWGSVSTNEMRGNF

SEQ ID NO: 25900 - protein, 29 aa, Artificial Sequence
  Description of Artificial Sequence: Synthetic peptide
DEEEIRTTNPVATEQYGSVSTELQSGEDV

SEQ ID NO: 25901 - protein, 33 aa, Artificial Sequence
  Description of Artificial Sequence: Synthetic polypeptide
DEEEIRTTNPVATEQYGSVSETNGLQREGENDR

SEQ ID NO: 25902 - protein, 28 aa, Artificial Sequence
  Description of Artificial Sequence: Synthetic peptide
DEEEIRTTNPVATEQYGSVSTALEQGEH

SEQ ID NO: 25903 - protein, 28 aa, Artificial Sequence
  Description of Artificial Sequence: Synthetic peptide
AEEELRATNPVSTEQYGSVSTNLQRGNM

SEQ ID NO: 25904 - protein, 28 aa, Artificial Sequence
  Description of Artificial Sequence: Synthetic peptide
DEEEIRTVNPVATEGYGEASTNLQRGER

SEQ ID NO: 25905 - protein, 28 aa, Artificial Sequence
  Description of Artificial Sequence: Synthetic peptide
DENEIATTNPVATEQYGSVSTDLERGNL

SEQ ID NO: 25906 - protein, 28 aa, Artificial Sequence
  Description of Artificial Sequence: Synthetic peptide
DEEEIRTTNPVATEQYGDVSENLDNGER

SEQ ID NO: 25907 - protein, 28 aa, Artificial Sequence
  Description of Artificial Sequence: Synthetic peptide
MEEEIRTTNPVATEQYGSVATNLQVGEL

SEQ ID NO: 25908 - protein, 32 aa, Artificial Sequence
  Description of Artificial Sequence: Synthetic polypeptide
DEEEIRTTNPVATEQYGSVSATNLQLRNGNDT

SEQ ID NO: 25909 - protein, 28 aa, Artificial Sequence
  Description of Artificial Sequence: Synthetic peptide
DENEIATTNPVATECYGSVSTNLQHGER

SEQ ID NO: 25910 - protein, 28 aa, Artificial Sequence
  Description of Artificial Sequence: Synthetic peptide
DEEEIATTNPVATEQYGSTSTNLQPGEL

SEQ ID NO: 25911 - protein, 30 aa, Artificial Sequence
  Description of Artificial Sequence: Synthetic polypeptide
MEEEIRTTNPVATEQYGSVSTNLQEVGNDN

SEQ ID NO: 25912 - protein, 30 aa, Artificial Sequence
  Description of Artificial Sequence: Synthetic polypeptide
DEEEIRTTNPVATEQYGSVSTMDLQYGNDV

SEQ ID NO: 25913 - protein, 28 aa, Artificial Sequence
  Description of Artificial Sequence: Synthetic peptide
DEEEIRTTNPVATECYGVVSTNLQHGEM

SEQ ID NO: 25914 - protein, 30 aa, Artificial Sequence
  Description of Artificial Sequence: Synthetic polypeptide
DEEEIRTTNPVATEQYGIVSENLQLYGNDR

SEQ ID NO: 25915 - protein, 28 aa, Artificial Sequence
  Description of Artificial Sequence: Synthetic peptide
DENEIRCTNPVATEQYGEVSENLQRGNM

SEQ ID NO: 25916 - protein, 28 aa, Artificial Sequence
  Description of Artificial Sequence: Synthetic peptide
HDEEIYTTNPVATEQWGSVSTNLQQGNR

SEQ ID NO: 25917 - protein, 30 aa, Artificial Sequence
  Description of Artificial Sequence: Synthetic polypeptide
DEEEIRTTNPVATEQYGSVSDNLPQVGPNI

SEQ ID NO: 25918 - protein, 32 aa, Artificial Sequence
  Description of Artificial Sequence: Synthetic polypeptide
DEEEIRTTNPVATEQYGMSVESTPNLDRGENR

SEQ ID NO: 25919 - protein, 31 aa, Artificial Sequence
  Description of Artificial Sequence: Synthetic polypeptide
DEEEIRTTNPVATEQYGSVSTNLQEQEGNDD

SEQ ID NO: 25920 - protein, 28 aa, Artificial Sequence
  Description of Artificial Sequence: Synthetic peptide
DEEEIRTTNPVATELWGSVSENLQIGNF

SEQ ID NO: 25921 - protein, 28 aa, Artificial Sequence
  Description of Artificial Sequence: Synthetic peptide
QEQEIRTTNPVATEQYGSVSTDLERGER

SEQ ID NO: 25922 - protein, 28 aa, Artificial Sequence
  Description of Artificial Sequence: Synthetic peptide
DEQEIRTTNPVATEQYGSVSTEDERGER

SEQ ID NO: 25923 - protein, 28 aa, Artificial Sequence
  Description of Artificial Sequence: Synthetic peptide
DEEEIRTTNPVATEQYGSVCTVLQDGEM

SEQ ID NO: 25924 - protein, 28 aa, Artificial Sequence
  Description of Artificial Sequence: Synthetic peptide
DEEEIRTTNPVATEQYGSVSEDLQRDEY

SEQ ID NO: 25925 - protein, 28 aa, Artificial Sequence
  Description of Artificial Sequence: Synthetic peptide
DEEEIVATNPVASEGYGSVSTNLQRGNI

SEQ ID NO: 25926 - protein, 28 aa, Artificial Sequence
  Description of Artificial Sequence: Synthetic peptide
DEEEIRTTNPFAGESYGSVATNLQDGNR

SEQ ID NO: 25927 - protein, 28 aa, Artificial Sequence
  Description of Artificial Sequence: Synthetic peptide
MENEIRTTNPVATEQYGVVSTNLQLGNM

SEQ ID NO: 25928 - protein, 28 aa, Artificial Sequence
  Description of Artificial Sequence: Synthetic peptide
DEEEIRTTNPVATEQYGSVSTGDQEGEW

SEQ ID NO: 25929 - protein, 28 aa, Artificial Sequence
  Description of Artificial Sequence: Synthetic peptide
DEEEVRTTNPVATEQYGCVSANLEIGNR

SEQ ID NO: 25930 - protein, 31 aa, Artificial Sequence
  Description of Artificial Sequence: Synthetic polypeptide
DEEEIRTTNPVATEQYGSVSTNPQNKGDNDR

SEQ ID NO: 25931 - protein, 29 aa, Artificial Sequence
  Description of Artificial Sequence: Synthetic peptide
DEEEIVTTNPVATEQYGSVAENLQVRGNF

SEQ ID NO: 25932 - protein, 30 aa, Artificial Sequence
  Description of Artificial Sequence: Synthetic polypeptide
DEEEIRTTNPVCTEQYGSVATNPLQRGTNF

SEQ ID NO: 25933 - protein, 28 aa, Artificial Sequence
  Description of Artificial Sequence: Synthetic peptide
DEVEIATTNPVATEQYGSVSTNPQQGNL

SEQ ID NO: 25934 - protein, 28 aa, Artificial Sequence
  Description of Artificial Sequence: Synthetic peptide
NETEIRTTNPVATENYGDCSTNLQRGNR

SEQ ID NO: 25935 - protein, 28 aa, Artificial Sequence
  Description of Artificial Sequence: Synthetic peptide
DEEEIRTTNPVATEQYGSVSTDDEYGNL

SEQ ID NO: 25936 - protein, 31 aa, Artificial Sequence
  Description of Artificial Sequence: Synthetic polypeptide
DEEEIRTTNPVATEQYGSVSNTNLQQVGNEP

SEQ ID NO: 25937 - protein, 28 aa, Artificial Sequence
  Description of Artificial Sequence: Synthetic peptide
DEEEIRTTNPVATELYGSVSTNEMQGNL

SEQ ID NO: 25938 - protein, 28 aa, Artificial Sequence
  Description of Artificial Sequence: Synthetic peptide
DEEEIATTNPVASEQYGVVSTNLQHGND

SEQ ID NO: 25939 - protein, 28 aa, Artificial Sequence
  Description of Artificial Sequence: Synthetic peptide
YEEEIKTTNPVATEQYGSCSDVLQRGNR

SEQ ID NO: 25940 - protein, 28 aa, Artificial Sequence
  Description of Artificial Sequence: Synthetic peptide
DEEEIATTNPVATEQYGSVSTDLEIGNF

SEQ ID NO: 25941 - protein, 28 aa, Artificial Sequence
  Description of Artificial Sequence: Synthetic peptide
SEECIRTTNPVATEQYGSVETGLQNGNR

SEQ ID NO: 25942 - protein, 28 aa, Artificial Sequence
  Description of Artificial Sequence: Synthetic peptide
SEEEIRATNPTATEQYGSVSTNPQRGDR

SEQ ID NO: 25943 - protein, 28 aa, Artificial Sequence
  Description of Artificial Sequence: Synthetic peptide
DEEEIRTVNPVATEQYGVVSTELQRGDD

SEQ ID NO: 25944 - protein, 28 aa, Artificial Sequence
  Description of Artificial Sequence: Synthetic peptide
DETEIRTTNPVATEQYGCVSSELQRGTR

SEQ ID NO: 25945 - protein, 32 aa, Artificial Sequence
  Description of Artificial Sequence: Synthetic polypeptide
DEEEIRTTNPVATEQYGSVYSTLNLQREGDNG

SEQ ID NO: 25946 - protein, 28 aa, Artificial Sequence
  Description of Artificial Sequence: Synthetic peptide
DEQEIRTTNPVATECYGSVSTALQTGNL

SEQ ID NO: 25947 - protein, 28 aa, Artificial Sequence
  Description of Artificial Sequence: Synthetic peptide
MEEEIRSTNPVATECYGSVSTNLQVGNA

SEQ ID NO: 25948 - protein, 28 aa, Artificial Sequence
  Description of Artificial Sequence: Synthetic peptide
DEAEIRTTNPVATEQYGDVSTNIQFGNF

SEQ ID NO: 25949 - protein, 29 aa, Artificial Sequence
  Description of Artificial Sequence: Synthetic peptide
DEEEIRTTNPVATEQYGSVSEDLQRDENN

SEQ ID NO: 25950 - protein, 29 aa, Artificial Sequence
  Description of Artificial Sequence: Synthetic peptide
DEEEIRTTNPTATEQYGSVSTNEQNGDNL

SEQ ID NO: 25951 - protein, 29 aa, Artificial Sequence
  Description of Artificial Sequence: Synthetic peptide
SEEEIRTTNPVATECFGSVSTNLQDLGNR

SEQ ID NO: 25952 - protein, 28 aa, Artificial Sequence
  Description of Artificial Sequence: Synthetic peptide
DEEEIRTTNPVATEQYGSVSTPDERGEG

SEQ ID NO: 25953 - protein, 31 aa, Artificial Sequence
  Description of Artificial Sequence: Synthetic polypeptide
DEEEIRQTNPVATEQYGSVSTNGLVEDRGNR

SEQ ID NO: 25954 - protein, 30 aa, Artificial Sequence
  Description of Artificial Sequence: Synthetic polypeptide
DEEEIRTTNPVASEQYGSVSENLQRGVNDF

SEQ ID NO: 25955 - protein, 28 aa, Artificial Sequence
  Description of Artificial Sequence: Synthetic peptide
DESEIRTTNPVATELYGGVSTDLQRGNQ

SEQ ID NO: 25956 - protein, 28 aa, Artificial Sequence
  Description of Artificial Sequence: Synthetic peptide
DEEEIRTTNPTATEQYGSVSTNPQQGTY

SEQ ID NO: 25957 - protein, 30 aa, Artificial Sequence
  Description of Artificial Sequence: Synthetic polypeptide
DEEEIRTTNPVATEQYGSVSTNEQELGNTA

SEQ ID NO: 25958 - protein, 28 aa, Artificial Sequence
  Description of Artificial Sequence: Synthetic peptide
SEEEIRCTNPVATEQYGSVSTNLQTGTM

SEQ ID NO: 25959 - protein, 31 aa, Artificial Sequence
  Description of Artificial Sequence: Synthetic polypeptide
DEEEIRTTNPVATEQYGSVSVTIDLQRKGNS

SEQ ID NO: 25960 - protein, 28 aa, Artificial Sequence
  Description of Artificial Sequence: Synthetic peptide
DEEEIVTTNPCATEQYGSVSTTLQGGNS

SEQ ID NO: 25961 - protein, 28 aa, Artificial Sequence
  Description of Artificial Sequence: Synthetic peptide
DEEEIRTTNPVATEQYGSVDTNDQQGGH

SEQ ID NO: 25962 - protein, 29 aa, Artificial Sequence
  Description of Artificial Sequence: Synthetic peptide
DEEEIRTTNPCATEGYGSVSATVLQRGNK

SEQ ID NO: 25963 - protein, 32 aa, Artificial Sequence
  Description of Artificial Sequence: Synthetic polypeptide
DEEEIRTTNPVATEQYGSCVSMPNPLQRGNPR

SEQ ID NO: 25964 - protein, 28 aa, Artificial Sequence
  Description of Artificial Sequence: Synthetic peptide
DEEEIATTNPVATECYGSVSTNLEHGER

SEQ ID NO: 25965 - protein, 28 aa, Artificial Sequence
  Description of Artificial Sequence: Synthetic peptide
SEEEIRTTNPVATEQYGDVSTPEQRGNP

SEQ ID NO: 25966 - protein, 29 aa, Artificial Sequence
  Description of Artificial Sequence: Synthetic peptide
DEQEIATTNPVATEQYGSVSTNLQRGEDQ

SEQ ID NO: 25967 - protein, 31 aa, Artificial Sequence
  Description of Artificial Sequence: Synthetic polypeptide
DEQEIRTTNPVATEQYGSVDSTNLQREEENR

SEQ ID NO: 25968 - protein, 28 aa, Artificial Sequence
  Description of Artificial Sequence: Synthetic peptide
HEQEIRTTNPVATEQYGEVSTNLNRGNL

SEQ ID NO: 25969 - protein, 28 aa, Artificial Sequence
  Description of Artificial Sequence: Synthetic peptide
KEEEIRTTNPVATEMYGVVSTNLQIGER

SEQ ID NO: 25970 - protein, 28 aa, Artificial Sequence
  Description of Artificial Sequence: Synthetic peptide
DEQEIRTTNPVATEQYGDVSTDLQHGNA

SEQ ID NO: 25971 - protein, 28 aa, Artificial Sequence
  Description of Artificial Sequence: Synthetic peptide
DEEEIRTTNPFATEQYGSVSTNLFDGEP

SEQ ID NO: 25972 - protein, 30 aa, Artificial Sequence
  Description of Artificial Sequence: Synthetic polypeptide
DEEEIRTTNPVATEQYGQSVDAMNYQRGNR

SEQ ID NO: 25973 - protein, 28 aa, Artificial Sequence
  Description of Artificial Sequence: Synthetic peptide
DENEIRQTNPVATEQYGSVSTDLQHGNL

SEQ ID NO: 25974 - protein, 28 aa, Artificial Sequence
  Description of Artificial Sequence: Synthetic peptide
DEEEIRTTNPYATEQWGSVSTNDIPGNR

SEQ ID NO: 25975 - protein, 28 aa, Artificial Sequence
  Description of Artificial Sequence: Synthetic peptide
DDEEIRTTNPVATEQYGIVSTALQQGNQ

SEQ ID NO: 25976 - protein, 28 aa, Artificial Sequence
  Description of Artificial Sequence: Synthetic peptide
DEEEIRTTNPVATEQYGSVETEDQGGNQ

SEQ ID NO: 25977 - protein, 28 aa, Artificial Sequence
  Description of Artificial Sequence: Synthetic peptide
DEQEIATTNPVATEQYGSVSTNLQNGEM

SEQ ID NO: 25978 - protein, 28 aa, Artificial Sequence
  Description of Artificial Sequence: Synthetic peptide
NETEIVTTNPVATEQYGSVSTNLQMGNM

SEQ ID NO: 25979 - protein, 29 aa, Artificial Sequence
  Description of Artificial Sequence: Synthetic peptide
SEEEIRTTNPVATELYGSVSENLQRGDTR

SEQ ID NO: 25980 - protein, 28 aa, Artificial Sequence
  Description of Artificial Sequence: Synthetic peptide
DENEIRTTNPVACEQYGLVSTQLQRGND

SEQ ID NO: 25981 - protein, 30 aa, Artificial Sequence
  Description of Artificial Sequence: Synthetic polypeptide
DEEEIATTNPVCTEQYGSVSVTNLQVSGNR

SEQ ID NO: 25982 - protein, 29 aa, Artificial Sequence
  Description of Artificial Sequence: Synthetic peptide
DEAEIRTTNPVATEQYGSASTNLENGNDR

SEQ ID NO: 25983 - protein, 28 aa, Artificial Sequence
  Description of Artificial Sequence: Synthetic peptide
NEEEIRTTNPCATEPYGSVSTNLQFGNF

SEQ ID NO: 25984 - protein, 28 aa, Artificial Sequence
  Description of Artificial Sequence: Synthetic peptide
DEEEIRTTNPVATEQYGDVSEELQYGNI

SEQ ID NO: 25985 - protein, 28 aa, Artificial Sequence
  Description of Artificial Sequence: Synthetic peptide
DEHEIRTTNPVATEQYGSVSEDLQHGNA

SEQ ID NO: 25986 - protein, 30 aa, Artificial Sequence
  Description of Artificial Sequence: Synthetic polypeptide
SEEEIRTTNPVATELYGIVSTNLQRNGNDR

SEQ ID NO: 25987 - protein, 28 aa, Artificial Sequence
  Description of Artificial Sequence: Synthetic peptide
HEEEIRSTNPVATEQYGSVSENLDRGNT

SEQ ID NO: 25988 - protein, 29 aa, Artificial Sequence
  Description of Artificial Sequence: Synthetic peptide
DEEEIRTTNPVATEQYGSVSSADQLAGNR

SEQ ID NO: 25989 - protein, 28 aa, Artificial Sequence
  Description of Artificial Sequence: Synthetic peptide
DEEEIRSTNPVATEQWGSYSTNLERGNF

SEQ ID NO: 25990 - protein, 30 aa, Artificial Sequence
  Description of Artificial Sequence: Synthetic polypeptide
DEEEIRATNPVATETYGSVSMMDNLQRGNR

SEQ ID NO: 25991 - protein, 28 aa, Artificial Sequence
  Description of Artificial Sequence: Synthetic peptide
DENEIRTTNPVATEQYGVVSTNQDRGND

SEQ ID NO: 25992 - protein, 28 aa, Artificial Sequence
  Description of Artificial Sequence: Synthetic peptide
SEEEIRTTNPTATEQYGSVSTNLQVGTF

SEQ ID NO: 25993 - protein, 30 aa, Artificial Sequence
  Description of Artificial Sequence: Synthetic polypeptide
DEEEIRTTNPVATEQYGSVISTNEQVGNTG

SEQ ID NO: 25994 - protein, 29 aa, Artificial Sequence
  Description of Artificial Sequence: Synthetic peptide
DEQEIRTTNPVATEQYGSVSENEQNLGNR

SEQ ID NO: 25995 - protein, 28 aa, Artificial Sequence
  Description of Artificial Sequence: Synthetic peptide
DEEEIYTTNPVATEQYGSVSTNGQNGDH

SEQ ID NO: 25996 - protein, 28 aa, Artificial Sequence
  Description of Artificial Sequence: Synthetic peptide
DEEEIRTTNPVATEQYGSVSTEDQYGDT

SEQ ID NO: 25997 - protein, 32 aa, Artificial Sequence
  Description of Artificial Sequence: Synthetic polypeptide
DEEEIRTTNPVATEQYGSVSDTQNLQVLGNSR

SEQ ID NO: 25998 - protein, 28 aa, Artificial Sequence
  Description of Artificial Sequence: Synthetic peptide
DDEEIRTTNPVASEQYGCVSSNQQRGNR

SEQ ID NO: 25999 - protein, 28 aa, Artificial Sequence
  Description of Artificial Sequence: Synthetic peptide
DEEEIRTTNPVATECFGSVSNNLQRENA

SEQ ID NO: 26000 - protein, 28 aa, Artificial Sequence
  Description of Artificial Sequence: Synthetic peptide
DEEEIATTNPVATECYGSVSTNLQHGEL

SEQ ID NO: 26001 - protein, 28 aa, Artificial Sequence
  Description of Artificial Sequence: Synthetic peptide
DEEEIRTTNPVATEQFGLVSTDLARGNT

SEQ ID NO: 26002 - protein, 31 aa, Artificial Sequence
  Description of Artificial Sequence: Synthetic polypeptide
DEEEIRTTNPVATEQYGSVCSTNLQMGDEDR

SEQ ID NO: 26003 - protein, 28 aa, Artificial Sequence
  Description of Artificial Sequence: Synthetic peptide
DEEEIRTTNPVATEQYGSVDTPLLEGNL

SEQ ID NO: 26004 - protein, 29 aa, Artificial Sequence
  Description of Artificial Sequence: Synthetic peptide
DEAEIRTTNPVATEQYGSVSTDEQRDQNR

SEQ ID NO: 26005 - protein, 29 aa, Artificial Sequence
  Description of Artificial Sequence: Synthetic peptide
MEEEIRTTNPVATEQYGVVSTNLQSGNDW

SEQ ID NO: 26006 - protein, 28 aa, Artificial Sequence
  Description of Artificial Sequence: Synthetic peptide
DEEEIRTTNPVATEQYGSVSTLPQLENW

SEQ ID NO: 26007 - protein, 28 aa, Artificial Sequence
  Description of Artificial Sequence: Synthetic peptide
DEQEIRTTNPVATEQYGSVSTEEQYGNM

SEQ ID NO: 26008 - protein, 28 aa, Artificial Sequence
  Description of Artificial Sequence: Synthetic peptide
DEEEIRTTNPVATEQYGSVSTDDELGNS

SEQ ID NO: 26009 - protein, 30 aa, Artificial Sequence
  Description of Artificial Sequence: Synthetic polypeptide
DEEEIRTTNPVATEQYGCVSTGNEQDRGNG

SEQ ID NO: 26010 - protein, 31 aa, Artificial Sequence
  Description of Artificial Sequence: Synthetic polypeptide
DEEEIRTTNPVATEQYGSVESTPNGIRGMNR

SEQ ID NO: 26011 - protein, 30 aa, Artificial Sequence
  Description of Artificial Sequence: Synthetic polypeptide
DEEEIRTTNPVATEQYGSVSTDLVDPGNDR

SEQ ID NO: 26012 - protein, 29 aa, Artificial Sequence
  Description of Artificial Sequence: Synthetic peptide
DEVEIRTTNPVATEQYGSVSTDIQRGIND

SEQ ID NO: 26013 - protein, 28 aa, Artificial Sequence
  Description of Artificial Sequence: Synthetic peptide
SEEEIRTTNPVATEQWGSVDTNLQRGDW

SEQ ID NO: 26014 - protein, 29 aa, Artificial Sequence
  Description of Artificial Sequence: Synthetic peptide
DEEEIATTNPVATEQYGSVSTNYQNGINA

SEQ ID NO: 26015 - protein, 29 aa, Artificial Sequence
  Description of Artificial Sequence: Synthetic peptide
DEEEIRGTNPVATEQYGSVSTNLQREDDM

SEQ ID NO: 26016 - protein, 29 aa, Artificial Sequence
  Description of Artificial Sequence: Synthetic peptide
DEEEIRTTNPVATEQYGSVSTELQEAGDT

SEQ ID NO: 26017 - protein, 29 aa, Artificial Sequence
  Description of Artificial Sequence: Synthetic peptide
DEEEIRTTNPVATEQYGVVSTELQDWGER

SEQ ID NO: 26018 - protein, 28 aa, Artificial Sequence
  Description of Artificial Sequence: Synthetic peptide
DEEEIRTTNPVATEQYGSVDTNEQREDL

SEQ ID NO: 26019 - protein, 28 aa, Artificial Sequence
  Description of Artificial Sequence: Synthetic peptide
QEEEIRTTNPVATEQYGIASENLQRGGR

SEQ ID NO: 26020 - protein, 28 aa, Artificial Sequence
  Description of Artificial Sequence: Synthetic peptide
DEEEIRCTNPVATEQYGSVSENLDVGNQ

SEQ ID NO: 26021 - protein, 28 aa, Artificial Sequence
  Description of Artificial Sequence: Synthetic peptide
DEEEIRTTNPVATEQYGSVSTDLEDGEF

SEQ ID NO: 26022 - protein, 28 aa, Artificial Sequence
  Description of Artificial Sequence: Synthetic peptide
GDEEIRPTNPVATEQYGSVSTNLQRLNL

SEQ ID NO: 26023 - protein, 29 aa, Artificial Sequence
  Description of Artificial Sequence: Synthetic peptide
DEEEIRATNPVGTEQYGSVSTALQDEGNR

SEQ ID NO: 26024 - protein, 31 aa, Artificial Sequence
  Description of Artificial Sequence: Synthetic polypeptide
DEEEIRTTNPVATEQYGSVSETNLEDRGEND

SEQ ID NO: 26025 - protein, 30 aa, Artificial Sequence
  Description of Artificial Sequence: Synthetic polypeptide
DEEEIATTNPVATEQYGSVPEATNLQVGNR

SEQ ID NO: 26026 - protein, 28 aa, Artificial Sequence
  Description of Artificial Sequence: Synthetic peptide
DEEEIRTTNPVATEQYGSVSTPEQMGDV

SEQ ID NO: 26027 - protein, 31 aa, Artificial Sequence
  Description of Artificial Sequence: Synthetic polypeptide
DEQEIRTTNPVATEQYGSVSETPNLQRKGNG

SEQ ID NO: 26028 - protein, 28 aa, Artificial Sequence
  Description of Artificial Sequence: Synthetic peptide
DEGEIRCTNPCATEQYGSVDTNLQRGNG

SEQ ID NO: 26029 - protein, 30 aa, Artificial Sequence
  Description of Artificial Sequence: Synthetic polypeptide
DEEEIRTTNPVATEQYGSYSTNEQQAGLNR

SEQ ID NO: 26030 - protein, 28 aa, Artificial Sequence
  Description of Artificial Sequence: Synthetic peptide
DEEEIRCTNPVATEVYGSVSNNWQRGNF

SEQ ID NO: 26031 - protein, 29 aa, Artificial Sequence
  Description of Artificial Sequence: Synthetic peptide
MEEEIRTTNPVATEQYGSVSTDLQIGNDY

SEQ ID NO: 26032 - protein, 28 aa, Artificial Sequence
  Description of Artificial Sequence: Synthetic peptide
KEEEIRTTNPVATEQYGSVSENLQYGDV

SEQ ID NO: 26033 - protein, 28 aa, Artificial Sequence
  Description of Artificial Sequence: Synthetic peptide
DEQEIRTTNPVATEQYGSVSTNLQVEEF

SEQ ID NO: 26034 - protein, 28 aa, Artificial Sequence
  Description of Artificial Sequence: Synthetic peptide
SEEEIRATNPTATEQYGSVSENLQNGNR

SEQ ID NO: 26035 - protein, 32 aa, Artificial Sequence
  Description of Artificial Sequence: Synthetic polypeptide
DEEEIRTTNPVATEQYGSVSTNPLPQDRDGER

SEQ ID NO: 26036 - protein, 28 aa, Artificial Sequence
  Description of Artificial Sequence: Synthetic peptide
DEEEIRTTNPVCTEQYGSVSTALEGGNH

SEQ ID NO: 26037 - protein, 29 aa, Artificial Sequence
  Description of Artificial Sequence: Synthetic peptide
DEEEIRTTNPVATECYGSVSTNLQHENDM

SEQ ID NO: 26038 - protein, 31 aa, Artificial Sequence
  Description of Artificial Sequence: Synthetic polypeptide
NEEEIRTTNPVATEQYGSVSTNLQDRKGENY

SEQ ID NO: 26039 - protein, 28 aa, Artificial Sequence
  Description of Artificial Sequence: Synthetic peptide
DEEEIRTTNPVATEQYGIVSTNLMLGDY

SEQ ID NO: 26040 - protein, 31 aa, Artificial Sequence
  Description of Artificial Sequence: Synthetic polypeptide
DEEEIRTTNPVATEQYGSVSVLNGLQRGPNH

SEQ ID NO: 26041 - protein, 28 aa, Artificial Sequence
  Description of Artificial Sequence: Synthetic peptide
DEVEIRTTNPVATETYGSVSTNDQRGPF

SEQ ID NO: 26042 - protein, 28 aa, Artificial Sequence
  Description of Artificial Sequence: Synthetic peptide
DEEEIRTTNPSATETYGEVSSNLQRGNK

SEQ ID NO: 26043 - protein, 28 aa, Artificial Sequence
  Description of Artificial Sequence: Synthetic peptide
DEEEIRTTNPVATECYGSVSTDLQQGDY

SEQ ID NO: 26044 - protein, 32 aa, Artificial Sequence
  Description of Artificial Sequence: Synthetic polypeptide
DEEEIRTTNPVATEQYGSVSTTDNLVQRGEND

SEQ ID NO: 26045 - protein, 31 aa, Artificial Sequence
  Description of Artificial Sequence: Synthetic polypeptide
DEEEIRTTNPVATEQYGSVSETNLERGENEE

SEQ ID NO: 26046 - protein, 28 aa, Artificial Sequence
  Description of Artificial Sequence: Synthetic peptide
DEEEIGTTNPVATEFYGSVCENLQRGNF

SEQ ID NO: 26047 - protein, 32 aa, Artificial Sequence
  Description of Artificial Sequence: Synthetic polypeptide
DEEEIRTTNPVATEQYGSVSTNLQMRNGENEP

SEQ ID NO: 26048 - protein, 28 aa, Artificial Sequence
  Description of Artificial Sequence: Synthetic peptide
DEEEIRTTNPVATEQYGSVSENEQIGTG

SEQ ID NO: 26049 - protein, 29 aa, Artificial Sequence
  Description of Artificial Sequence: Synthetic peptide
DEEEIRTTNPVCTEQYGSVSDQLQIRGNG

SEQ ID NO: 26050 - protein, 28 aa, Artificial Sequence
  Description of Artificial Sequence: Synthetic peptide
DENEIRTTNPVATEWWGSVSTNLMRGNL

SEQ ID NO: 26051 - protein, 28 aa, Artificial Sequence
  Description of Artificial Sequence: Synthetic peptide
DENEIVTTNPVATELYGGVSTNLQHGNR

SEQ ID NO: 26052 - protein, 28 aa, Artificial Sequence
  Description of Artificial Sequence: Synthetic peptide
DEEEIRTTNPVATECYGSVSTELQIGED

SEQ ID NO: 26053 - protein, 30 aa, Artificial Sequence
  Description of Artificial Sequence: Synthetic polypeptide
SEEEIRTTNPTATEQFGSVSTNLQDRGDNR

SEQ ID NO: 26054 - protein, 28 aa, Artificial Sequence
  Description of Artificial Sequence: Synthetic peptide
DTEEIRTTNPVATEWWGSVSENLQEGNR

SEQ ID NO: 26055 - protein, 28 aa, Artificial Sequence
  Description of Artificial Sequence: Synthetic peptide
DEEEIRTTNPVCTEQYGDVSTNLQHENQ

SEQ ID NO: 26056 - protein, 28 aa, Artificial Sequence
  Description of Artificial Sequence: Synthetic peptide
DEEEIRTTNPVATELYGVVSTALQRGEQ

SEQ ID NO: 26057 - protein, 28 aa, Artificial Sequence
  Description of Artificial Sequence: Synthetic peptide
DEEEIRTTNPVATEQWGSVSENLMIGNA

SEQ ID NO: 26058 - protein, 28 aa, Artificial Sequence
  Description of Artificial Sequence: Synthetic peptide
DEEEIRTTNPVATEQYGDASTNLQHENN

SEQ ID NO: 26059 - protein, 28 aa, Artificial Sequence
  Description of Artificial Sequence: Synthetic peptide
DEEEIRTTNPVATEQYGSVSTDQEVGND

SEQ ID NO: 26060 - protein, 30 aa, Artificial Sequence
  Description of Artificial Sequence: Synthetic polypeptide
DEEEIRTTNPVATEQYGSVSDNDEVRGNPR

SEQ ID NO: 26061 - protein, 28 aa, Artificial Sequence
  Description of Artificial Sequence: Synthetic peptide
QEEEIATTNPVATECYGSVSTNLQRGEF

SEQ ID NO: 26062 - protein, 28 aa, Artificial Sequence
  Description of Artificial Sequence: Synthetic peptide
DEMEICTTNPVATEQYGSVGTNLQHGMR

SEQ ID NO: 26063 - protein, 29 aa, Artificial Sequence
  Description of Artificial Sequence: Synthetic peptide
DEREIRTTNPVATEQYGEVSENLQRYGNY

SEQ ID NO: 26064 - protein, 30 aa, Artificial Sequence
  Description of Artificial Sequence: Synthetic polypeptide
DEEEIRTTNPVATEQYGSVSATDLQHEGER

SEQ ID NO: 26065 - protein, 31 aa, Artificial Sequence
  Description of Artificial Sequence: Synthetic polypeptide
DEEEIRTTNPVATEQYGSVSATNLQLDNGNL

SEQ ID NO: 26066 - protein, 28 aa, Artificial Sequence
  Description of Artificial Sequence: Synthetic peptide
DEEEIRTTNPAATECYGSVSTNEQSGNL

SEQ ID NO: 26067 - protein, 31 aa, Artificial Sequence
  Description of Artificial Sequence: Synthetic polypeptide
DEEEIRTTNPVATEQYGSVSTDLQESEGNDR

SEQ ID NO: 26068 - protein, 28 aa, Artificial Sequence
  Description of Artificial Sequence: Synthetic peptide
DEEEIRTTNPVATEQYGSVSTDLEIGEA

SEQ ID NO: 26069 - protein, 28 aa, Artificial Sequence
  Description of Artificial Sequence: Synthetic peptide
QEECIESTNPVATEQYGSVSTNLQRGND

SEQ ID NO: 26070 - protein, 30 aa, Artificial Sequence
  Description of Artificial Sequence: Synthetic polypeptide
DEEAIRTTNPVAYEQYGSVTSTNLQRGDFR

SEQ ID NO: 26071 - protein, 29 aa, Artificial Sequence
  Description of Artificial Sequence: Synthetic peptide
DEQEIVTTNPVATEQYGWVSAENLQRGNR

SEQ ID NO: 26072 - protein, 28 aa, Artificial Sequence
  Description of Artificial Sequence: Synthetic peptide
DEEEIAATNPTATELYGSVSTNLQRGNF

SEQ ID NO: 26073 - protein, 31 aa, Artificial Sequence
  Description of Artificial Sequence: Synthetic polypeptide
CEEEIRTTNPVATEVYGSVASTNLVQREGNR

SEQ ID NO: 26074 - protein, 28 aa, Artificial Sequence
  Description of Artificial Sequence: Synthetic peptide
AEEEIRTTNPVASEMYGFVSTNLQRGGR

SEQ ID NO: 26075 - protein, 31 aa, Artificial Sequence
  Description of Artificial Sequence: Synthetic polypeptide
DEEEIRTTNPVATEQYGSVSTDLVQDREGER

SEQ ID NO: 26076 - protein, 28 aa, Artificial Sequence
  Description of Artificial Sequence: Synthetic peptide
DEQEIATTNPVATEQYGSVSTDLQRGEL

SEQ ID NO: 26077 - protein, 31 aa, Artificial Sequence
  Description of Artificial Sequence: Synthetic polypeptide
DEEEIRTTNPVATEQYGSVESTPGLQRGNDQ

SEQ ID NO: 26078 - protein, 29 aa, Artificial Sequence
  Description of Artificial Sequence: Synthetic peptide
DEEEIRTVNPVATEQYGSVSTEELEPGNR

SEQ ID NO: 26079 - protein, 28 aa, Artificial Sequence
  Description of Artificial Sequence: Synthetic peptide
DENEIRTTNPVATEQYGWVSTAPIRGNR

SEQ ID NO: 26080 - protein, 28 aa, Artificial Sequence
  Description of Artificial Sequence: Synthetic peptide
DEDEICTTNPVSTEQYGSVSTNLQSGNA

SEQ ID NO: 26081 - protein, 30 aa, Artificial Sequence
  Description of Artificial Sequence: Synthetic polypeptide
DEEEIVTTNPVATEQYGSVSATELQANGNR

SEQ ID NO: 26082 - protein, 28 aa, Artificial Sequence
  Description of Artificial Sequence: Synthetic peptide
DEEEIRTTNPVATEQWGSVSENLEQGTR

SEQ ID NO: 26083 - protein, 30 aa, Artificial Sequence
  Description of Artificial Sequence: Synthetic polypeptide
DEQEIRTTNPVATEIYGAVSATNLQRNGNR

SEQ ID NO: 26084 - protein, 28 aa, Artificial Sequence
  Description of Artificial Sequence: Synthetic peptide
DEEEIRTTNPVATEQYGSVSTDLEQGEF

SEQ ID NO: 26085 - protein, 28 aa, Artificial Sequence
  Description of Artificial Sequence: Synthetic peptide
DEEEIRTTNPVATECYGEVSTNPQREER

SEQ ID NO: 26086 - protein, 28 aa, Artificial Sequence
  Description of Artificial Sequence: Synthetic peptide
MEQEIRTTNPVATEQYGSVSTDLQGGNI

SEQ ID NO: 26087 - protein, 28 aa, Artificial Sequence
  Description of Artificial Sequence: Synthetic peptide
DEDEIRTVNPVATEQYGSCAENLQRGNR

SEQ ID NO: 26088 - protein, 28 aa, Artificial Sequence
  Description of Artificial Sequence: Synthetic peptide
DEEEIRTTNPVATEQYGSVSENPQAGEI

SEQ ID NO: 26089 - protein, 28 aa, Artificial Sequence
  Description of Artificial Sequence: Synthetic peptide
DEEEIRTTNPVATEQWGSVSTNEELGTR

SEQ ID NO: 26090 - protein, 28 aa, Artificial Sequence
  Description of Artificial Sequence: Synthetic peptide
QENEIRTTNPVATECYGSVPTNLQHGNR

SEQ ID NO: 26091 - protein, 29 aa, Artificial Sequence
  Description of Artificial Sequence: Synthetic peptide
DEEEIRTTNPVATECYGSVSTNLQETGES

SEQ ID NO: 26092 - protein, 28 aa, Artificial Sequence
  Description of Artificial Sequence: Synthetic peptide
DEEEIRTTNPVATEQYGSVDTNPNAGNG

SEQ ID NO: 26093 - protein, 30 aa, Artificial Sequence
  Description of Artificial Sequence: Synthetic polypeptide
MEEEIRTTNPVATEQYGSVSTNLQENGNDM

SEQ ID NO: 26094 - protein, 31 aa, Artificial Sequence
  Description of Artificial Sequence: Synthetic polypeptide
DEEEIRTTNPVATEQYGSVVSSTNGLQRGLD

SEQ ID NO: 26095 - protein, 30 aa, Artificial Sequence
  Description of Artificial Sequence: Synthetic polypeptide
DENEIRTTNPVATEQYGSVSTNLQESGNDW

SEQ ID NO: 26096 - protein, 28 aa, Artificial Sequence
  Description of Artificial Sequence: Synthetic peptide
DEVEIRTTNPVATEQYGEVSTNPQRGDQ

SEQ ID NO: 26097 - protein, 28 aa, Artificial Sequence
  Description of Artificial Sequence: Synthetic peptide
DEGEIRTTNPVCTEQYGTVSVNPQRGNR

SEQ ID NO: 26098 - protein, 29 aa, Artificial Sequence
  Description of Artificial Sequence: Synthetic peptide
DEEEIRTTNPVATEQYGSVSENEMMRGNM

SEQ ID NO: 26099 - protein, 28 aa, Artificial Sequence
  Description of Artificial Sequence: Synthetic peptide
DEEEIRTTNPVATETYGSVQGNLQGGNP

SEQ ID NO: 26100 - protein, 28 aa, Artificial Sequence
  Description of Artificial Sequence: Synthetic peptide
DEEEIRTTNPVATEQWGDVSTILQQENR

SEQ ID NO: 26101 - protein, 30 aa, Artificial Sequence
  Description of Artificial Sequence: Synthetic polypeptide
DEEEIRTTNPVATEQYGSVSTNPQENGNTV

SEQ ID NO: 26102 - protein, 28 aa, Artificial Sequence
  Description of Artificial Sequence: Synthetic peptide
QEHEITTTNPVATEQYGSVSTNLQHGMR

SEQ ID NO: 26103 - protein, 32 aa, Artificial Sequence
  Description of Artificial Sequence: Synthetic polypeptide
DEEEIRTTNPVATEQYGSVSATNLQERNGNDE

SEQ ID NO: 26104 - protein, 28 aa, Artificial Sequence
  Description of Artificial Sequence: Synthetic peptide
DEEEIRTTNPVATEAYGSVETNLQHPNM

SEQ ID NO: 26105 - protein, 29 aa, Artificial Sequence
  Description of Artificial Sequence: Synthetic peptide
DENEIRTTNPVATEQWGSVSTNLQMQGNW

SEQ ID NO: 26106 - protein, 32 aa, Artificial Sequence
  Description of Artificial Sequence: Synthetic polypeptide
DEEEIRTTNPVATEQYGSVSTNLVQIPDGNPR

SEQ ID NO: 26107 - protein, 28 aa, Artificial Sequence
  Description of Artificial Sequence: Synthetic peptide
DEEEIRTTNPVATEQYGCVSTNLLAGDY

SEQ ID NO: 26108 - protein, 30 aa, Artificial Sequence
  Description of Artificial Sequence: Synthetic polypeptide
DEEEIATTNPVATEQYGSVSTNLQHKGEDR

SEQ ID NO: 26109 - protein, 30 aa, Artificial Sequence
  Description of Artificial Sequence: Synthetic polypeptide
DEEEIRTTNPVATEQYGSIVGETNLQIGNI

SEQ ID NO: 26110 - protein, 30 aa, Artificial Sequence
  Description of Artificial Sequence: Synthetic polypeptide
YEDEIRTTNPVATEQYGSVSTENLQQVGNR

SEQ ID NO: 26111 - protein, 30 aa, Artificial Sequence
  Description of Artificial Sequence: Synthetic polypeptide
MEEEIRTTNPVATEQYGSVSTDLQENGNDR

SEQ ID NO: 26112 - protein, 28 aa, Artificial Sequence
  Description of Artificial Sequence: Synthetic peptide
MENEIRTTNPVATEQYGVVSTNLQLGNI

SEQ ID NO: 26113 - protein, 28 aa, Artificial Sequence
  Description of Artificial Sequence: Synthetic peptide
DEEEIRTTNPVATEQYGIYSTNLMTGDR

SEQ ID NO: 26114 - protein, 30 aa, Artificial Sequence
  Description of Artificial Sequence: Synthetic polypeptide
DEEEIRTTNPVATEQYGDMSTNLQERGNDM

SEQ ID NO: 26115 - protein, 30 aa, Artificial Sequence
  Description of Artificial Sequence: Synthetic polypeptide
KEEEIRTTNPVATEQYGSVSTNLQEQEGNA

SEQ ID NO: 26116 - protein, 28 aa, Artificial Sequence
  Description of Artificial Sequence: Synthetic peptide
DEEEIASTNPVATELYGSVSTNLQQGNN

SEQ ID NO: 26117 - protein, 28 aa, Artificial Sequence
  Description of Artificial Sequence: Synthetic peptide
DEQEIRTTNPVATEQYGSVSTDDQIGNF

SEQ ID NO: 26118 - protein, 28 aa, Artificial Sequence
  Description of Artificial Sequence: Synthetic peptide
SEEEIRTTNPTATEQYGSVSNAPQRGNR

SEQ ID NO: 26119 - protein, 31 aa, Artificial Sequence
  Description of Artificial Sequence: Synthetic polypeptide
DEEEIRTTNPVATEQYGSVSTNLEDREGEDR

SEQ ID NO: 26120 - protein, 28 aa, Artificial Sequence
  Description of Artificial Sequence: Synthetic peptide
DEEEIRTTNPVATECYGSASTDLQTGNI

SEQ ID NO: 26121 - protein, 28 aa, Artificial Sequence
  Description of Artificial Sequence: Synthetic peptide
NEEEIRGTNPVATEQYGSVSTNWQDGNG

SEQ ID NO: 26122 - protein, 30 aa, Artificial Sequence
  Description of Artificial Sequence: Synthetic polypeptide
MEEEIRTTNPVATEQYGSVSTELQDNGNDR

SEQ ID NO: 26123 - protein, 32 aa, Artificial Sequence
  Description of Artificial Sequence: Synthetic polypeptide
DEEEIRTTNPVATEQYGSVSTFNGLQRDGEPR

SEQ ID NO: 26124 - protein, 30 aa, Artificial Sequence
  Description of Artificial Sequence: Synthetic polypeptide
DEEEIRTTNPVATEQYGSVSTDLQTEGNDQ

SEQ ID NO: 26125 - protein, 28 aa, Artificial Sequence
  Description of Artificial Sequence: Synthetic peptide
QENEIATTNPVATEQYGSVSTNLQSGNV

SEQ ID NO: 26126 - protein, 31 aa, Artificial Sequence
  Description of Artificial Sequence: Synthetic polypeptide
DEEEIRTTNPVATCQYGSVSDTNLLQRGFNA

SEQ ID NO: 26127 - protein, 28 aa, Artificial Sequence
  Description of Artificial Sequence: Synthetic peptide
KEEEIRTTNPVATECYGSVSTNLQFGDA

SEQ ID NO: 26128 - protein, 31 aa, Artificial Sequence
  Description of Artificial Sequence: Synthetic polypeptide
DEEEIRTTNPVATEQYGVVSETNLQVRGEER

SEQ ID NO: 26129 - protein, 28 aa, Artificial Sequence
  Description of Artificial Sequence: Synthetic peptide
DEQEIGTTNPVATEQYGWVSTNLQEGNQ

SEQ ID NO: 26130 - protein, 28 aa, Artificial Sequence
  Description of Artificial Sequence: Synthetic peptide
DEEEIRTTNPVATEQYGSVSTDPEYGNV

SEQ ID NO: 26131 - protein, 28 aa, Artificial Sequence
  Description of Artificial Sequence: Synthetic peptide
DEEEIRTTNPVAYQQYGSVSTDLDRGNP

SEQ ID NO: 26132 - protein, 28 aa, Artificial Sequence
  Description of Artificial Sequence: Synthetic peptide
DEEEIRTTNPVATEQWGSVSENEMRGNF

SEQ ID NO: 26133 - protein, 30 aa, Artificial Sequence
  Description of Artificial Sequence: Synthetic polypeptide
DEEEIRTTNPVATEQYGSVSTDLQQNGNDN

SEQ ID NO: 26134 - protein, 29 aa, Artificial Sequence
  Description of Artificial Sequence: Synthetic peptide
MEEEIRTTNPVATEQYGSVSTDLQESGNA

SEQ ID NO: 26135 - protein, 28 aa, Artificial Sequence
  Description of Artificial Sequence: Synthetic peptide
SEEEIRATNPVATEQYGSVSTGLQRGTG

SEQ ID NO: 26136 - protein, 30 aa, Artificial Sequence
  Description of Artificial Sequence: Synthetic polypeptide
DEEEIRTTNPVATEQYGSVSTEPLQIIGER

SEQ ID NO: 26137 - protein, 30 aa, Artificial Sequence
  Description of Artificial Sequence: Synthetic polypeptide
DEQEIRTTNPVATEQYGSVEATNLQIGENR

SEQ ID NO: 26138 - protein, 28 aa, Artificial Sequence
  Description of Artificial Sequence: Synthetic peptide
DDNEIRTTNPVATEWYGSVSTADQRGNR

SEQ ID NO: 26139 - protein, 28 aa, Artificial Sequence
  Description of Artificial Sequence: Synthetic peptide
DEQEIATTNPVATEQYGSVSTDLEHGNR

SEQ ID NO: 26140 - protein, 30 aa, Artificial Sequence
  Description of Artificial Sequence: Synthetic polypeptide
DEEEIRTTNPEATEQYGSVSTNPLQQGNPH

SEQ ID NO: 26141 - protein, 28 aa, Artificial Sequence
  Description of Artificial Sequence: Synthetic peptide
SEEEIRTTNPVATEQYGGVSTNPQHGNG

SEQ ID NO: 26142 - protein, 28 aa, Artificial Sequence
  Description of Artificial Sequence: Synthetic peptide
DEEEIRTTNPMATEHYGSVSTNLYEGNV

SEQ ID NO: 26143 - protein, 28 aa, Artificial Sequence
  Description of Artificial Sequence: Synthetic peptide
DEEEIRTTNPVATEQYGSVSTPDEEGNL

SEQ ID NO: 26144 - protein, 28 aa, Artificial Sequence
  Description of Artificial Sequence: Synthetic peptide
DEEEIRTTNPCATEWYGAVSNNLERGNR

SEQ ID NO: 26145 - protein, 31 aa, Artificial Sequence
  Description of Artificial Sequence: Synthetic polypeptide
DEEEIRTTNPVATECYGSVSETNLEVRNGNR

SEQ ID NO: 26146 - protein, 28 aa, Artificial Sequence
  Description of Artificial Sequence: Synthetic peptide
DEQEIRTTNPVATEQWGSVSENEQRGNM

SEQ ID NO: 26147 - protein, 28 aa, Artificial Sequence
  Description of Artificial Sequence: Synthetic peptide
DEEEIVTTNPVATEQYGDVSTNPQNGER

SEQ ID NO: 26148 - protein, 28 aa, Artificial Sequence
  Description of Artificial Sequence: Synthetic peptide
DEEEIAATNPVATEQFGGVSENLQRGNR

SEQ ID NO: 26149 - protein, 28 aa, Artificial Sequence
  Description of Artificial Sequence: Synthetic peptide
DENEIRTTNPVATEQWGSVSENLQVGNA

SEQ ID NO: 26150 - protein, 30 aa, Artificial Sequence
  Description of Artificial Sequence: Synthetic polypeptide
DEEEIRTTNPVATECYGSVSTNLQRNGEDL

SEQ ID NO: 26151 - protein, 30 aa, Artificial Sequence
  Description of Artificial Sequence: Synthetic polypeptide
DEEEIRTTNPVATECYGSVTSTNLQLFGNG

SEQ ID NO: 26152 - protein, 28 aa, Artificial Sequence
  Description of Artificial Sequence: Synthetic peptide
DEEEIRTTNPVATEQYGSVSDALEHGDR

SEQ ID NO: 26153 - protein, 28 aa, Artificial Sequence
  Description of Artificial Sequence: Synthetic peptide
DEQEIATTNPVATEQYGSASTVLQHGNR

SEQ ID NO: 26154 - protein, 28 aa, Artificial Sequence
  Description of Artificial Sequence: Synthetic peptide
DEEEIRTTNPVATEQYGSVSTELENEDR

SEQ ID NO: 26155 - protein, 28 aa, Artificial Sequence
  Description of Artificial Sequence: Synthetic peptide
DEEEIRTTNPVATEQYGDVSENLMHGNL

SEQ ID NO: 26156 - protein, 30 aa, Artificial Sequence
  Description of Artificial Sequence: Synthetic polypeptide
DEEEIRTTNPVATEQYGSVSETGNLDNGNL

SEQ ID NO: 26157 - protein, 28 aa, Artificial Sequence
  Description of Artificial Sequence: Synthetic peptide
DEEEIRTTNPVACEQYGSVSENEQHGNN

SEQ ID NO: 26158 - protein, 28 aa, Artificial Sequence
  Description of Artificial Sequence: Synthetic peptide
MEQEIRTTNPVATEQYGSVSTNLQHGEI

SEQ ID NO: 26159 - protein, 30 aa, Artificial Sequence
  Description of Artificial Sequence: Synthetic polypeptide
DEEEIRTTNPVATEQYGSVSTDLQEVNGND

SEQ ID NO: 26160 - protein, 30 aa, Artificial Sequence
  Description of Artificial Sequence: Synthetic polypeptide
DEEEIRTTNPVATEQYGSVSATHPLQYGNQ

SEQ ID NO: 26161 - protein, 29 aa, Artificial Sequence
  Description of Artificial Sequence: Synthetic peptide
DEEEIRTVNPVATEQYGSVASGGLQRGNH

SEQ ID NO: 26162 - protein, 31 aa, Artificial Sequence
  Description of Artificial Sequence: Synthetic polypeptide
DEEEIRTTNPVATEQYGSVETNNLQMRGDNS

SEQ ID NO: 26163 - protein, 30 aa, Artificial Sequence
  Description of Artificial Sequence: Synthetic polypeptide
DEEEIRTTNPVATEQYGSVSTDLEEVGNDR

SEQ ID NO: 26164 - protein, 28 aa, Artificial Sequence
  Description of Artificial Sequence: Synthetic peptide
DEEEIRATNPVATEQYGSVSANLQREPS

SEQ ID NO: 26165 - protein, 28 aa, Artificial Sequence
  Description of Artificial Sequence: Synthetic peptide
DEDEIRTTNPVATEQYGETSTNLQRGDS

SEQ ID NO: 26166 - protein, 29 aa, Artificial Sequence
  Description of Artificial Sequence: Synthetic peptide
VEEEIGTTNPVATEQYGSVSTNDQVKGNR

SEQ ID NO: 26167 - protein, 28 aa, Artificial Sequence
  Description of Artificial Sequence: Synthetic peptide
DEEEIRATNPTATELYGSVSENLQQGNR

SEQ ID NO: 26168 - protein, 30 aa, Artificial Sequence
  Description of Artificial Sequence: Synthetic polypeptide
DEEEIATTNPVATEQYGSVSTDLQEREGNF

SEQ ID NO: 26169 - protein, 28 aa, Artificial Sequence
  Description of Artificial Sequence: Synthetic peptide
DEEEIRTTNPVATEQYGSVETDDERGNQ

SEQ ID NO: 26170 - protein, 28 aa, Artificial Sequence
  Description of Artificial Sequence: Synthetic peptide
QEEEIRTTNPVATECYGSVSTDLQSGNL

SEQ ID NO: 26171 - protein, 28 aa, Artificial Sequence
  Description of Artificial Sequence: Synthetic peptide
REEEIRTTNPVATEQYGSVSTNLQLMEP

SEQ ID NO: 26172 - protein, 31 aa, Artificial Sequence
  Description of Artificial Sequence: Synthetic polypeptide
DEEEIRTTNPVATEIYGSVSTNLQIAGENDR

SEQ ID NO: 26173 - protein, 29 aa, Artificial Sequence
  Description of Artificial Sequence: Synthetic peptide
DENEIRTTNPVATEQWGSVSENEQMRGNR

SEQ ID NO: 26174 - protein, 29 aa, Artificial Sequence
  Description of Artificial Sequence: Synthetic peptide
DDEEIRTTNPVATEMYGSVSTELQEIGNR

SEQ ID NO: 26175 - protein, 28 aa, Artificial Sequence
  Description of Artificial Sequence: Synthetic peptide
DEEEIRATNPVATEMYGSVSTDLQSGDR

SEQ ID NO: 26176 - protein, 29 aa, Artificial Sequence
  Description of Artificial Sequence: Synthetic peptide
DEEEIRATNPVATEIYGSVAATNLQPGNR

SEQ ID NO: 26177 - protein, 28 aa, Artificial Sequence
  Description of Artificial Sequence: Synthetic peptide
DENEIRTTNPVATEQWGSVSTNLMRGTQ

SEQ ID NO: 26178 - protein, 28 aa, Artificial Sequence
  Description of Artificial Sequence: Synthetic peptide
DEEEIRTTNPVATEQYGSVSTAEEVGNY

SEQ ID NO: 26179 - protein, 28 aa, Artificial Sequence
  Description of Artificial Sequence: Synthetic peptide
KEEEIATTNPVATEQYGDVSTNLQRENN

SEQ ID NO: 26180 - protein, 30 aa, Artificial Sequence
  Description of Artificial Sequence: Synthetic polypeptide
DEEEIRTTNPVATEQYGSVISTGLPQGGPR

SEQ ID NO: 26181 - protein, 30 aa, Artificial Sequence
  Description of Artificial Sequence: Synthetic polypeptide
DEEEIRTTNPVATEQYGSVSTNLQDVEGEL

SEQ ID NO: 26182 - protein, 29 aa, Artificial Sequence
  Description of Artificial Sequence: Synthetic peptide
DEEEIRTTNPVSTEQYGSVSTNDQIQGDR

SEQ ID NO: 26183 - protein, 29 aa, Artificial Sequence
  Description of Artificial Sequence: Synthetic peptide
DEEEIRQTNPVATEQYGSVSTVLQHAGGR

SEQ ID NO: 26184 - protein, 28 aa, Artificial Sequence
  Description of Artificial Sequence: Synthetic peptide
DEVEIRTTNPVATEQYGSASTNDQHGNH

SEQ ID NO: 26185 - protein, 31 aa, Artificial Sequence
  Description of Artificial Sequence: Synthetic polypeptide
DEEEIRTTNPVATEQYGSVSSTGNPLQDGNF

SEQ ID NO: 26186 - protein, 30 aa, Artificial Sequence
  Description of Artificial Sequence: Synthetic polypeptide
DEEEIRTTNPVATEQYGSVSTDPEQRDGER

SEQ ID NO: 26187 - protein, 31 aa, Artificial Sequence
  Description of Artificial Sequence: Synthetic polypeptide
DEEEIRTTNPVATEQYGSVSTNLQEVEGNDQ

SEQ ID NO: 26188 - protein, 28 aa, Artificial Sequence
  Description of Artificial Sequence: Synthetic peptide
DEEEISTTNPVATEVYGSVSTALQRGTQ

SEQ ID NO: 26189 - protein, 28 aa, Artificial Sequence
  Description of Artificial Sequence: Synthetic peptide
DENEIRTTNPVATEQYGSVSTDLQLGEI

SEQ ID NO: 26190 - protein, 28 aa, Artificial Sequence
  Description of Artificial Sequence: Synthetic peptide
YEEEITTTNPVATEQYGEVSTVLQRGNH

SEQ ID NO: 26191 - protein, 30 aa, Artificial Sequence
  Description of Artificial Sequence: Synthetic polypeptide
DEQEIRTTNPVATEQYGSVSDTELQRGENE

SEQ ID NO: 26192 - protein, 28 aa, Artificial Sequence
  Description of Artificial Sequence: Synthetic peptide
DDEEIRTTNPVATEQYGVVSVPLQRGNL

SEQ ID NO: 26193 - protein, 30 aa, Artificial Sequence
  Description of Artificial Sequence: Synthetic polypeptide
DEEEIRTTNPVATEQYGSVSTCNLQCKGDE

SEQ ID NO: 26194 - protein, 30 aa, Artificial Sequence
  Description of Artificial Sequence: Synthetic polypeptide
DEEEIRTTNPVATEQYGDASTNEQERGNDR

SEQ ID NO: 26195 - protein, 32 aa, Artificial Sequence
  Description of Artificial Sequence: Synthetic polypeptide
DEEEIRTTNPVATEQYGSVSITPNLVDLRGNR

SEQ ID NO: 26196 - protein, 28 aa, Artificial Sequence
  Description of Artificial Sequence: Synthetic peptide
DEEEIRTTNPTATEQFGSVSTNPQFGNE

SEQ ID NO: 26197 - protein, 28 aa, Artificial Sequence
  Description of Artificial Sequence: Synthetic peptide
DEEEIRTVNPCATEQYGSVSDNLQVGNS

SEQ ID NO: 26198 - protein, 28 aa, Artificial Sequence
  Description of Artificial Sequence: Synthetic peptide
DENEIRTTNPVATEQYGSVPTNPQHGER

SEQ ID NO: 26199 - protein, 28 aa, Artificial Sequence
  Description of Artificial Sequence: Synthetic peptide
GEGEIYTTNPVATEQYGEVSCNLQRGNR

SEQ ID NO: 26200 - protein, 28 aa, Artificial Sequence
  Description of Artificial Sequence: Synthetic peptide
DEEEIRTTNPVATEQYGSVSTDLEGGET

SEQ ID NO: 26201 - protein, 32 aa, Artificial Sequence
  Description of Artificial Sequence: Synthetic polypeptide
DEEEIRTTNPVATEQYGSVSTTNPLQNGVNWR

SEQ ID NO: 26202 - protein, 28 aa, Artificial Sequence
  Description of Artificial Sequence: Synthetic peptide
DEEEIRTTNPVACEQYGTVDTNLQDGTR

SEQ ID NO: 26203 - protein, 29 aa, Artificial Sequence
  Description of Artificial Sequence: Synthetic peptide
DEQEIRTTNPVATEMYGSVSENLQSRGNF

SEQ ID NO: 26204 - protein, 28 aa, Artificial Sequence
  Description of Artificial Sequence: Synthetic peptide
SEQELRTTNPVATEVYGSVSTNLQRGNG

SEQ ID NO: 26205 - protein, 28 aa, Artificial Sequence
  Description of Artificial Sequence: Synthetic peptide
DEEEIATTNPVCTEQYGVVSTNLQSGNQ

SEQ ID NO: 26206 - protein, 30 aa, Artificial Sequence
  Description of Artificial Sequence: Synthetic polypeptide
DEEEIRTTNPVATEQYGSVSITNQQRLVNN

SEQ ID NO: 26207 - protein, 31 aa, Artificial Sequence
  Description of Artificial Sequence: Synthetic polypeptide
DEEEIRTTNPVATEQYGVVSETNLQMEGNDR

SEQ ID NO: 26208 - protein, 28 aa, Artificial Sequence
  Description of Artificial Sequence: Synthetic peptide
NEEEIRCTNPVATEQYGCVATNLQRGTR

SEQ ID NO: 26209 - protein, 28 aa, Artificial Sequence
  Description of Artificial Sequence: Synthetic peptide
DEEEIRTTNPVATEQYGAVSTALEHGND

SEQ ID NO: 26210 - protein, 28 aa, Artificial Sequence
  Description of Artificial Sequence: Synthetic peptide
DEEEIATTNPTATEQYGSVSTNPQQGNF

SEQ ID NO: 26211 - protein, 28 aa, Artificial Sequence
  Description of Artificial Sequence: Synthetic peptide
DEEEIRTTNPVATEQWGSVSTNLMTGTQ

SEQ ID NO: 26212 - protein, 31 aa, Artificial Sequence
  Description of Artificial Sequence: Synthetic polypeptide
DEEEIRTTNPVATEQYGESVDSTPLDRGDNR

SEQ ID NO: 26213 - protein, 30 aa, Artificial Sequence
  Description of Artificial Sequence: Synthetic polypeptide
DEEEIRTTNPVATEQYGSVSTMGPQQGDNR

SEQ ID NO: 26214 - protein, 29 aa, Artificial Sequence
  Description of Artificial Sequence: Synthetic peptide
DENEIRTTNPVATEQYGSVSENLQDFGNW

SEQ ID NO: 26215 - protein, 31 aa, Artificial Sequence
  Description of Artificial Sequence: Synthetic polypeptide
DEEEIRTTNPVATEQYGSVSTNLQDDNGNDE

SEQ ID NO: 26216 - protein, 28 aa, Artificial Sequence
  Description of Artificial Sequence: Synthetic peptide
AELEIRTTNPVATEQYGSVSENVQRGER

SEQ ID NO: 26217 - protein, 28 aa, Artificial Sequence
  Description of Artificial Sequence: Synthetic peptide
DEEEIRTTNPVATEQYGSVSMDLEDENR

SEQ ID NO: 26218 - protein, 28 aa, Artificial Sequence
  Description of Artificial Sequence: Synthetic peptide
DEEEIRSTNPVASEIYGSTSTNLQRGDR

SEQ ID NO: 26219 - protein, 30 aa, Artificial Sequence
  Description of Artificial Sequence: Synthetic polypeptide
DEEEIRTVNPVATEQYGSVSVTAEQRNGNR

SEQ ID NO: 26220 - protein, 30 aa, Artificial Sequence
  Description of Artificial Sequence: Synthetic polypeptide
DEEEIRTTNPVATEQYGDVCPENLQRGVNR

SEQ ID NO: 26221 - protein, 31 aa, Artificial Sequence
  Description of Artificial Sequence: Synthetic polypeptide
DEEEIRTTNPVATEQYGSVESTPGLQRNGNI

SEQ ID NO: 26222 - protein, 28 aa, Artificial Sequence
  Description of Artificial Sequence: Synthetic peptide
DEEEIATTNPTATEQYGSVSTNPQVGNA

SEQ ID NO: 26223 - protein, 28 aa, Artificial Sequence
  Description of Artificial Sequence: Synthetic peptide
DEEEIATTNPVATEQYGSVSTDLQHGEI

SEQ ID NO: 26224 - protein, 28 aa, Artificial Sequence
  Description of Artificial Sequence: Synthetic peptide
DEEEIRTTNPVATEPYGFVDTNLQAGNN

SEQ ID NO: 26225 - protein, 31 aa, Artificial Sequence
  Description of Artificial Sequence: Synthetic polypeptide
DEQEIRTTNPVATEQYGSVESTNLQERGNDG

SEQ ID NO: 26226 - protein, 28 aa, Artificial Sequence
  Description of Artificial Sequence: Synthetic peptide
DEEEIRTTNPVATEQYGDVSENLQHEER

SEQ ID NO: 26227 - protein, 28 aa, Artificial Sequence
  Description of Artificial Sequence: Synthetic peptide
DEEEIATTNPVATEQYGDVSEDLQRGNA

SEQ ID NO: 26228 - protein, 29 aa, Artificial Sequence
  Description of Artificial Sequence: Synthetic peptide
DEEEIRTTNPVATEIYGSVSTDLQLGNDQ

SEQ ID NO: 26229 - protein, 28 aa, Artificial Sequence
  Description of Artificial Sequence: Synthetic peptide
DEHEIRTTNPVATEQYGDVSEELQRGNF

SEQ ID NO: 26230 - protein, 31 aa, Artificial Sequence
  Description of Artificial Sequence: Synthetic polypeptide
DEEEIRTTNPVATEQYGSVSLTNLQIRENNI

SEQ ID NO: 26231 - protein, 28 aa, Artificial Sequence
  Description of Artificial Sequence: Synthetic peptide
DEEEIATTNPVATECYGSVSTNLENGNY

SEQ ID NO: 26232 - protein, 28 aa, Artificial Sequence
  Description of Artificial Sequence: Synthetic peptide
DEQEIRTTNPVATEQYGSVSEDLQMGNA

SEQ ID NO: 26233 - protein, 28 aa, Artificial Sequence
  Description of Artificial Sequence: Synthetic peptide
QEEEIRTTNPVATEQYGWVSTNLQNGEG

SEQ ID NO: 26234 - protein, 28 aa, Artificial Sequence
  Description of Artificial Sequence: Synthetic peptide
DEEEIRTTNPVATEQYGDASENLQRGEA

SEQ ID NO: 26235 - protein, 28 aa, Artificial Sequence
  Description of Artificial Sequence: Synthetic peptide
DENEIRTTNPVATEQYGSVSEDLQGGNM

SEQ ID NO: 26236 - protein, 30 aa, Artificial Sequence
  Description of Artificial Sequence: Synthetic polypeptide
DEEEIRSTNPVATEQYGSVSTNGLQQGNDG

SEQ ID NO: 26237 - protein, 28 aa, Artificial Sequence
  Description of Artificial Sequence: Synthetic peptide
DEQEIRTTNPVATEQYGSVSTNLDQGDN

SEQ ID NO: 26238 - protein, 28 aa, Artificial Sequence
  Description of Artificial Sequence: Synthetic peptide
DEEELRATNPCATEQYGSVPTNVQRGNR

SEQ ID NO: 26239 - protein, 31 aa, Artificial Sequence
  Description of Artificial Sequence: Synthetic polypeptide
DEEEIRTTNPVATEQYGSVSTNLIQFDGEMR

SEQ ID NO: 26240 - protein, 28 aa, Artificial Sequence
  Description of Artificial Sequence: Synthetic peptide
DEEEIRCTNPVATEMYGSVSTGLQQGNG

SEQ ID NO: 26241 - protein, 28 aa, Artificial Sequence
  Description of Artificial Sequence: Synthetic peptide
DENEIRTTNPVATEQYGSVDENLQGGNQ

SEQ ID NO: 26242 - protein, 28 aa, Artificial Sequence
  Description of Artificial Sequence: Synthetic peptide
DEDEIRATNPEATEQYGSVSTNLQHGNQ

SEQ ID NO: 26243 - protein, 29 aa, Artificial Sequence
  Description of Artificial Sequence: Synthetic peptide
DEQEIRTTNPVATEQYGSVSTNLEDEGND

SEQ ID NO: 26244 - protein, 28 aa, Artificial Sequence
  Description of Artificial Sequence: Synthetic peptide
NEEEVRTTNPVATENYGVVATNLQRGNR

SEQ ID NO: 26245 - protein, 28 aa, Artificial Sequence
  Description of Artificial Sequence: Synthetic peptide
DEQEIATTNPVATECYGSVSTNLQHGER

SEQ ID NO: 26246 - protein, 28 aa, Artificial Sequence
  Description of Artificial Sequence: Synthetic peptide
QEEEIRTTNPVATETYGSISTNLQLGNH

SEQ ID NO: 26247 - protein, 29 aa, Artificial Sequence
  Description of Artificial Sequence: Synthetic peptide
DEEEIRTTNPVATEQWGSVSENEQNRGNW

SEQ ID NO: 26248 - protein, 28 aa, Artificial Sequence
  Description of Artificial Sequence: Synthetic peptide
DEEEIATTNPFATEQYGSVSTNQERGND

SEQ ID NO: 26249 - protein, 28 aa, Artificial Sequence
  Description of Artificial Sequence: Synthetic peptide
DEEEIRTTNPVATESYGSVSTAIQVGNI

SEQ ID NO: 26250 - protein, 29 aa, Artificial Sequence
  Description of Artificial Sequence: Synthetic peptide
DEEEIRTTNPVAVEQYGSVSEINEQRENR

SEQ ID NO: 26251 - protein, 28 aa, Artificial Sequence
  Description of Artificial Sequence: Synthetic peptide
QEEEIRTTNPVATECYGSVSTDLQLGND

SEQ ID NO: 26252 - protein, 29 aa, Artificial Sequence
  Description of Artificial Sequence: Synthetic peptide
DEHEIRTTNPVATEQYGDVSEMNLQGGNR

SEQ ID NO: 26253 - protein, 30 aa, Artificial Sequence
  Description of Artificial Sequence: Synthetic polypeptide
DEEEIRTTNPVATEQYGIVNSTTNLNEGNR

SEQ ID NO: 26254 - protein, 32 aa, Artificial Sequence
  Description of Artificial Sequence: Synthetic polypeptide
DEEEIRTTNPVATEQYGSVESTPGLQIRGENR

SEQ ID NO: 26255 - protein, 28 aa, Artificial Sequence
  Description of Artificial Sequence: Synthetic peptide
DEEEIRTTNPIATEQYGTVSQDLQEGNR

SEQ ID NO: 26256 - protein, 29 aa, Artificial Sequence
  Description of Artificial Sequence: Synthetic peptide
DEQEIRTTNPVATEQYGSVSTDLQGGNDS

SEQ ID NO: 26257 - protein, 29 aa, Artificial Sequence
  Description of Artificial Sequence: Synthetic peptide
DEEEIRTTNPVATEQYGSVDTNLEMVGNM

SEQ ID NO: 26258 - protein, 28 aa, Artificial Sequence
  Description of Artificial Sequence: Synthetic peptide
DEVEIRTTNPVATEQYGHVSTGLQVGNE

SEQ ID NO: 26259 - protein, 28 aa, Artificial Sequence
  Description of Artificial Sequence: Synthetic peptide
DEEEIRTTNPVATECYGVVSTNLQWGES

SEQ ID NO: 26260 - protein, 28 aa, Artificial Sequence
  Description of Artificial Sequence: Synthetic peptide
SEEEIRTTNPTATEQYGSVSTNLQIGTH

SEQ ID NO: 26261 - protein, 28 aa, Artificial Sequence
  Description of Artificial Sequence: Synthetic peptide
NEHEIRTTNPVATEQYGSVSTNDQHGNS

SEQ ID NO: 26262 - protein, 30 aa, Artificial Sequence
  Description of Artificial Sequence: Synthetic polypeptide
DEEEIRTTNPVATEQYGSVDETDEQRKGNR

SEQ ID NO: 26263 - protein, 28 aa, Artificial Sequence
  Description of Artificial Sequence: Synthetic peptide
DEAEIRTTNPVATEQYGSVDTYLQGGNQ

SEQ ID NO: 26264 - protein, 28 aa, Artificial Sequence
  Description of Artificial Sequence: Synthetic peptide
DEEEIRTTNPVATEQYGSVSTNDDVGEP

SEQ ID NO: 26265 - protein, 28 aa, Artificial Sequence
  Description of Artificial Sequence: Synthetic peptide
DEEEIRTTNPVATEMYGSVSTNDQVENE

SEQ ID NO: 26266 - protein, 28 aa, Artificial Sequence
  Description of Artificial Sequence: Synthetic peptide
MEESIRTTNPVATEQYGSVSTNLQVLNM

SEQ ID NO: 26267 - protein, 28 aa, Artificial Sequence
  Description of Artificial Sequence: Synthetic peptide
DEVEIVTTNPCATEQYGSVSTNLQNGNA

SEQ ID NO: 26268 - protein, 28 aa, Artificial Sequence
  Description of Artificial Sequence: Synthetic peptide
DLNEIATTNPVATEQYGVVSTNLQRGNF

SEQ ID NO: 26269 - protein, 30 aa, Artificial Sequence
  Description of Artificial Sequence: Synthetic polypeptide
DEEEIRTTNPVATEQYGSVSTEDDQRGNDN

SEQ ID NO: 26270 - protein, 28 aa, Artificial Sequence
  Description of Artificial Sequence: Synthetic peptide
DEGEIRCTNPVATEQYGQVSTNLYRGND

SEQ ID NO: 26271 - protein, 28 aa, Artificial Sequence
  Description of Artificial Sequence: Synthetic peptide
DENEIRGTNPVATEQYGWVSTNLQHFNR

SEQ ID NO: 26272 - protein, 28 aa, Artificial Sequence
  Description of Artificial Sequence: Synthetic peptide
DENEIRTTNPVATEQYGSVSTNPQFGQD

SEQ ID NO: 26273 - protein, 30 aa, Artificial Sequence
  Description of Artificial Sequence: Synthetic polypeptide
DEEEIRTTNPVATEQYGSVSTINLQISGEV

SEQ ID NO: 26274 - protein, 28 aa, Artificial Sequence
  Description of Artificial Sequence: Synthetic peptide
DEEEIRTTNPVATEQYGSVETNLANGEM

SEQ ID NO: 26275 - protein, 28 aa, Artificial Sequence
  Description of Artificial Sequence: Synthetic peptide
AEEEIRTTNPVATEQYGWVSENCQRGTR

SEQ ID NO: 26276 - protein, 28 aa, Artificial Sequence
  Description of Artificial Sequence: Synthetic peptide
VEEEISTTNPVATEQYGSASTNLMRLNR

SEQ ID NO: 26277 - protein, 28 aa, Artificial Sequence
  Description of Artificial Sequence: Synthetic peptide
DEQEIRTTNPVATEQYGSVSTDLQLGEP

SEQ ID NO: 26278 - protein, 29 aa, Artificial Sequence
  Description of Artificial Sequence: Synthetic peptide
DENEIRTTNPVATEQWGSVSTNLENQGNR

SEQ ID NO: 26279 - protein, 28 aa, Artificial Sequence
  Description of Artificial Sequence: Synthetic peptide
DEEEIRTTNPVATEQYGEVSEVLQHGER

SEQ ID NO: 26280 - protein, 28 aa, Artificial Sequence
  Description of Artificial Sequence: Synthetic peptide
DENEIRTTNPVATEQWGSVSTNEQQGTR

SEQ ID NO: 26281 - protein, 30 aa, Artificial Sequence
  Description of Artificial Sequence: Synthetic polypeptide
DEEEIRTTNPVATEQYGSVSTANEQEIGNH

SEQ ID NO: 26282 - protein, 29 aa, Artificial Sequence
  Description of Artificial Sequence: Synthetic peptide
MENEIRTTNPVATEQYGSVSTNLQNEGNM

SEQ ID NO: 26283 - protein, 29 aa, Artificial Sequence
  Description of Artificial Sequence: Synthetic peptide
DEDEIATTNPVATEQYGSVSTNLQEPGNQ

SEQ ID NO: 26284 - protein, 28 aa, Artificial Sequence
  Description of Artificial Sequence: Synthetic peptide
DEEEIRQTNPVATEQYGSVPTNLQREEK

SEQ ID NO: 26285 - protein, 30 aa, Artificial Sequence
  Description of Artificial Sequence: Synthetic polypeptide
DEEEIRTTNPVATEQYGVVSITDLQQHGNR

SEQ ID NO: 26286 - protein, 28 aa, Artificial Sequence
  Description of Artificial Sequence: Synthetic peptide
DEEEIRTTNPVATEQYGSVSDEEDRGNG

SEQ ID NO: 26287 - protein, 28 aa, Artificial Sequence
  Description of Artificial Sequence: Synthetic peptide
DEEEIRTTNPVSTEIFGAVSTNLQPGNR

SEQ ID NO: 26288 - protein, 31 aa, Artificial Sequence
  Description of Artificial Sequence: Synthetic polypeptide
DEEEIATTNPVATEQYGSVSATNLEREGNDR

SEQ ID NO: 26289 - protein, 29 aa, Artificial Sequence
  Description of Artificial Sequence: Synthetic peptide
DEEEIRTTNPVATEQWGSVSTNEMNRGNW

SEQ ID NO: 26290 - protein, 28 aa, Artificial Sequence
  Description of Artificial Sequence: Synthetic peptide
SEEEIRCTNPVATEQYGSYSTNLQGGNW

SEQ ID NO: 26291 - protein, 29 aa, Artificial Sequence
  Description of Artificial Sequence: Synthetic peptide
DENEIRTTNPVATEQWGSVSTNLQMIGNM

SEQ ID NO: 26292 - protein, 28 aa, Artificial Sequence
  Description of Artificial Sequence: Synthetic peptide
DEEEITTTNPVATEHYGSVSEVMQRGNR

SEQ ID NO: 26293 - protein, 30 aa, Artificial Sequence
  Description of Artificial Sequence: Synthetic polypeptide
DEEEIRTTNPVATEQYGSVSTANPQENGNG

SEQ ID NO: 26294 - protein, 28 aa, Artificial Sequence
  Description of Artificial Sequence: Synthetic peptide
DEEEIRATNPVATECYGSVSTNLQSGEE

SEQ ID NO: 26295 - protein, 28 aa, Artificial Sequence
  Description of Artificial Sequence: Synthetic peptide
DEEEIRPTNPVASEQYGSCSTDLQFGNR

SEQ ID NO: 26296 - protein, 29 aa, Artificial Sequence
  Description of Artificial Sequence: Synthetic peptide
KEEEIRTTNPVATELYGSVSTNLQDQGNN

SEQ ID NO: 26297 - protein, 28 aa, Artificial Sequence
  Description of Artificial Sequence: Synthetic peptide
DEQEIRTTNPVATECYGWVSTNLQAGNM

SEQ ID NO: 26298 - protein, 30 aa, Artificial Sequence
  Description of Artificial Sequence: Synthetic polypeptide
DEEEIRCTNPCATEQYGSVSATNDQRFGNR

SEQ ID NO: 26299 - protein, 28 aa, Artificial Sequence
  Description of Artificial Sequence: Synthetic peptide
DEEEIRTTNPVATEQYGDVSENLMQGNM

SEQ ID NO: 26300 - protein, 28 aa, Artificial Sequence
  Description of Artificial Sequence: Synthetic peptide
DEQEIRTTNPVATEQYGSVSTNDQHENF

SEQ ID NO: 26301 - protein, 30 aa, Artificial Sequence
  Description of Artificial Sequence: Synthetic polypeptide
DEREIRTTNPVATEQYGSVSTPNLQRGMEQ

SEQ ID NO: 26302 - protein, 28 aa, Artificial Sequence
  Description of Artificial Sequence: Synthetic peptide
MEEEIRSTNPVATEQYGSVSTNLLFGER

SEQ ID NO: 26303 - protein, 28 aa, Artificial Sequence
  Description of Artificial Sequence: Synthetic peptide
DEEEIATTNPVATECYGSVSTNLQEGEL

SEQ ID NO: 26304 - protein, 28 aa, Artificial Sequence
  Description of Artificial Sequence: Synthetic peptide
DEEEIRATNPVATECYGSVSTDLQGGNT

SEQ ID NO: 26305 - protein, 28 aa, Artificial Sequence
  Description of Artificial Sequence: Synthetic peptide
YEEEIRTTNPVCTELYGCVSTNLQEGNR

SEQ ID NO: 26306 - protein, 28 aa, Artificial Sequence
  Description of Artificial Sequence: Synthetic peptide
KEEEIRTTNPVATECYGSVSTELQYGND

SEQ ID NO: 26307 - protein, 31 aa, Artificial Sequence
  Description of Artificial Sequence: Synthetic polypeptide
DEEEIRTTNPVATEQYGSVHTNLNQIRGDNP

SEQ ID NO: 26308 - protein, 28 aa, Artificial Sequence
  Description of Artificial Sequence: Synthetic peptide
DENEIRTTNPVATDQYGSVVTNLWDGNR

SEQ ID NO: 26309 - protein, 29 aa, Artificial Sequence
  Description of Artificial Sequence: Synthetic peptide
DEEEIRSTNPVATEIYGAVSTNLQRNGND

SEQ ID NO: 26310 - protein, 31 aa, Artificial Sequence
  Description of Artificial Sequence: Synthetic polypeptide
DEEEIRTTNPVATEQYGSVETDDGLQREGNR

SEQ ID NO: 26311 - protein, 28 aa, Artificial Sequence
  Description of Artificial Sequence: Synthetic peptide
GEEEIRTTNPCATEQYGAVSTELQRGNL

SEQ ID NO: 26312 - protein, 28 aa, Artificial Sequence
  Description of Artificial Sequence: Synthetic peptide
DEEEIRTTNPVATEQWGSVSTNEMRGDQ

SEQ ID NO: 26313 - protein, 30 aa, Artificial Sequence
  Description of Artificial Sequence: Synthetic polypeptide
DENEIRTTNPVATECYGSVSATNLQREGER

SEQ ID NO: 26314 - protein, 28 aa, Artificial Sequence
  Description of Artificial Sequence: Synthetic peptide
DEEEIRTTNPVATEQYGSVSTDDEAGNM

SEQ ID NO: 26315 - protein, 28 aa, Artificial Sequence
  Description of Artificial Sequence: Synthetic peptide
DEEEIRTTNPVATEQYGSVSTNDEWGEE

SEQ ID NO: 26316 - protein, 28 aa, Artificial Sequence
  Description of Artificial Sequence: Synthetic peptide
SEEEIRTTNPVATEQYGSVSTNPQSGTV

SEQ ID NO: 26317 - protein, 30 aa, Artificial Sequence
  Description of Artificial Sequence: Synthetic polypeptide
DEEEIRTTNPVATEQYGSVSTINLQNKGEF

SEQ ID NO: 26318 - protein, 28 aa, Artificial Sequence
  Description of Artificial Sequence: Synthetic peptide
DEEEIRCTNPVSTEQYGIVSTNEMRGNR

SEQ ID NO: 26319 - protein, 31 aa, Artificial Sequence
  Description of Artificial Sequence: Synthetic polypeptide
DEEEIRTTNPVATEQYGDVSCEMNLQRGNDR

SEQ ID NO: 26320 - protein, 28 aa, Artificial Sequence
  Description of Artificial Sequence: Synthetic peptide
DEMEIRTTNPVATEQYGSVSCNDQRGTT

SEQ ID NO: 26321 - protein, 28 aa, Artificial Sequence
  Description of Artificial Sequence: Synthetic peptide
NENEISTTNPVATEQYGSVSNNLQRPNR

SEQ ID NO: 26322 - protein, 30 aa, Artificial Sequence
  Description of Artificial Sequence: Synthetic polypeptide
DEEEIRTTNPVATEQYGSVSTNPQEIGNTG

SEQ ID NO: 26323 - protein, 28 aa, Artificial Sequence
  Description of Artificial Sequence: Synthetic peptide
CESEIRTTNPVATEQYGVVSTDLQIGNR

SEQ ID NO: 26324 - protein, 28 aa, Artificial Sequence
  Description of Artificial Sequence: Synthetic peptide
QEAEIRTTNPVATECYGSVSTNLQYGND

SEQ ID NO: 26325 - protein, 29 aa, Artificial Sequence
  Description of Artificial Sequence: Synthetic peptide
DEEEIRTTNPVATEQYGDVSCENLQLGNV

SEQ ID NO: 26326 - protein, 31 aa, Artificial Sequence
  Description of Artificial Sequence: Synthetic polypeptide
DEEEIRTTNPVATEQYGVVSITNLQRNGNPD

SEQ ID NO: 26327 - protein, 30 aa, Artificial Sequence
  Description of Artificial Sequence: Synthetic polypeptide
DEEEIRTVNPVATEQYGSVSAENLQRGPQR

SEQ ID NO: 26328 - protein, 28 aa, Artificial Sequence
  Description of Artificial Sequence: Synthetic peptide
DEEEIRTTNPVATEQYGWVSTELQFGDH

SEQ ID NO: 26329 - protein, 29 aa, Artificial Sequence
  Description of Artificial Sequence: Synthetic peptide
DEAEIVTTNPVATEQYGSVSTLALQRGNQ

SEQ ID NO: 26330 - protein, 29 aa, Artificial Sequence
  Description of Artificial Sequence: Synthetic peptide
MEQEIRTTNPVATEQYGSVSTNLQENGNS

SEQ ID NO: 26331 - protein, 28 aa, Artificial Sequence
  Description of Artificial Sequence: Synthetic peptide
DENELRTTNPVSTEQYGSVSTVVQRGNR

SEQ ID NO: 26332 - protein, 28 aa, Artificial Sequence
  Description of Artificial Sequence: Synthetic peptide
DEEEIRTTNPVATEQYGDVSKNDLRGDR

SEQ ID NO: 26333 - protein, 28 aa, Artificial Sequence
  Description of Artificial Sequence: Synthetic peptide
KEEEIATTNPVATECYGSVSTNLQLGNE

SEQ ID NO: 26334 - protein, 28 aa, Artificial Sequence
  Description of Artificial Sequence: Synthetic peptide
AEEEIRTTNPVSTEQYGSVPDNPQRGNR

SEQ ID NO: 26335 - protein, 32 aa, Artificial Sequence
  Description of Artificial Sequence: Synthetic polypeptide
DEEEIRATNPVATEQYGSVCSTENLQRDGDNR

SEQ ID NO: 26336 - protein, 28 aa, Artificial Sequence
  Description of Artificial Sequence: Synthetic peptide
DEEEIRCTNPVSTEQYGSVSNNLARGNT

SEQ ID NO: 26337 - protein, 31 aa, Artificial Sequence
  Description of Artificial Sequence: Synthetic polypeptide
DENEIRTTNPVATEQYGSVSTENLQNNGDNR

SEQ ID NO: 26338 - protein, 30 aa, Artificial Sequence
  Description of Artificial Sequence: Synthetic polypeptide
DENEIRTTNPVATEQYGDVSETNLQQRGER

SEQ ID NO: 26339 - protein, 28 aa, Artificial Sequence
  Description of Artificial Sequence: Synthetic peptide
DEQEIATTNPVATEQYGSVSTDLERGNM

SEQ ID NO: 26340 - protein, 28 aa, Artificial Sequence
  Description of Artificial Sequence: Synthetic peptide
DEEMIRTTNPVATEQWGSVHTNEQRGDR

SEQ ID NO: 26341 - protein, 28 aa, Artificial Sequence
  Description of Artificial Sequence: Synthetic peptide
DEEEIRTTNPVATEQYGVVSANLQHENG

SEQ ID NO: 26342 - protein, 30 aa, Artificial Sequence
  Description of Artificial Sequence: Synthetic polypeptide
DEEEIRTTNPEATEQYGSVSTNLQDKGDNQ

SEQ ID NO: 26343 - protein, 28 aa, Artificial Sequence
  Description of Artificial Sequence: Synthetic peptide
DEEEIKTTNPVATEQYGSISTNLQVLND

SEQ ID NO: 26344 - protein, 28 aa, Artificial Sequence
  Description of Artificial Sequence: Synthetic peptide
DEEEIRTTNPVATENYGCVANNLERGNR

SEQ ID NO: 26345 - protein, 28 aa, Artificial Sequence
  Description of Artificial Sequence: Synthetic peptide
DEQEIRTTNPVATEQYGSVDTDEDRGNR

SEQ ID NO: 26346 - protein, 28 aa, Artificial Sequence
  Description of Artificial Sequence: Synthetic peptide
DEEEIRVTNPVATEWYGSVSTGLDRGND

SEQ ID NO: 26347 - protein, 28 aa, Artificial Sequence
  Description of Artificial Sequence: Synthetic peptide
DEEEIRTTNPVATEQYGVVGENLQAGNT

SEQ ID NO: 26348 - protein, 30 aa, Artificial Sequence
  Description of Artificial Sequence: Synthetic polypeptide
DEEEIRQTNPVATEQYGSVSTDLQLVNGNR

SEQ ID NO: 26349 - protein, 28 aa, Artificial Sequence
  Description of Artificial Sequence: Synthetic peptide
DEEEIRQTNPVATEQYGSVSTGQERGNF

SEQ ID NO: 26350 - protein, 28 aa, Artificial Sequence
  Description of Artificial Sequence: Synthetic peptide
DEEEIRTTNPTATEQYGSVSTNPQVGTQ

SEQ ID NO: 26351 - protein, 30 aa, Artificial Sequence
  Description of Artificial Sequence: Synthetic polypeptide
DEMEIRTTNPVATEQYGSVVENLQRTGNSR

SEQ ID NO: 26352 - protein, 29 aa, Artificial Sequence
  Description of Artificial Sequence: Synthetic peptide
DEEEIRTTNPVATEQYGSVSTNLQTEEDV

SEQ ID NO: 26353 - protein, 28 aa, Artificial Sequence
  Description of Artificial Sequence: Synthetic peptide
DEQEIAATNPVATEIYGTVSTNLQRGNR

SEQ ID NO: 26354 - protein, 30 aa, Artificial Sequence
  Description of Artificial Sequence: Synthetic polypeptide
DEEEIRTTNPVATEQYGSVDTMDLQQHGNR

SEQ ID NO: 26355 - protein, 29 aa, Artificial Sequence
  Description of Artificial Sequence: Synthetic peptide
SEEEIRTTNPVATEQYGSVSENLQQGDDR

SEQ ID NO: 26356 - protein, 29 aa, Artificial Sequence
  Description of Artificial Sequence: Synthetic peptide
DEEEIRTTNPVATEQYGDVSTNLMNQGDR

SEQ ID NO: 26357 - protein, 30 aa, Artificial Sequence
  Description of Artificial Sequence: Synthetic polypeptide
DEEEIRTTNPVATEQYGSVSTDLEINGDNR

SEQ ID NO: 26358 - protein, 28 aa, Artificial Sequence
  Description of Artificial Sequence: Synthetic peptide
DEEEIRTTNPVATECWGSVSENEQRGNF

SEQ ID NO: 26359 - protein, 28 aa, Artificial Sequence
  Description of Artificial Sequence: Synthetic peptide
DEEEIRTTNPVATEQYGSVSTDLEVGEA

SEQ ID NO: 26360 - protein, 29 aa, Artificial Sequence
  Description of Artificial Sequence: Synthetic peptide
DEEEIRTTNPVATEQYGSVSTPPDDRGNG

SEQ ID NO: 26361 - protein, 28 aa, Artificial Sequence
  Description of Artificial Sequence: Synthetic peptide
DEQEIRTTNPVATECYGSVSTDLQAGNH

SEQ ID NO: 26362 - protein, 28 aa, Artificial Sequence
  Description of Artificial Sequence: Synthetic peptide
DEMEIRATNPVATEQYGSVSTNLNSGNA

SEQ ID NO: 26363 - protein, 28 aa, Artificial Sequence
  Description of Artificial Sequence: Synthetic peptide
DEQEIRTTNPVATEQYGMVSTQLQTGMR

SEQ ID NO: 26364 - protein, 28 aa, Artificial Sequence
  Description of Artificial Sequence: Synthetic peptide
KEEEIRTTNPVATECYGSVSTNLQIGDE

SEQ ID NO: 26365 - protein, 30 aa, Artificial Sequence
  Description of Artificial Sequence: Synthetic polypeptide
DENEIRTTNPVATEIYGSVSTGNLQREGDR

SEQ ID NO: 26366 - protein, 28 aa, Artificial Sequence
  Description of Artificial Sequence: Synthetic peptide
DENEIRQTNPVATEQYGSVSTVLQHGNK

SEQ ID NO: 26367 - protein, 28 aa, Artificial Sequence
  Description of Artificial Sequence: Synthetic peptide
DEEEIRTTNPVATEQYGSVSTELEVENA

SEQ ID NO: 26368 - protein, 28 aa, Artificial Sequence
  Description of Artificial Sequence: Synthetic peptide
SEEEIRTTNPVATEMYGSVSTDLDRGNF

SEQ ID NO: 26369 - protein, 28 aa, Artificial Sequence
  Description of Artificial Sequence: Synthetic peptide
DEQEIRTTNPVATEQYGSVSTPDDRGDR

SEQ ID NO: 26370 - protein, 28 aa, Artificial Sequence
  Description of Artificial Sequence: Synthetic peptide
DEEEIRTTNPVATEQYGSVSTGDDQGNV

SEQ ID NO: 26371 - protein, 28 aa, Artificial Sequence
  Description of Artificial Sequence: Synthetic peptide
HETEICSTNPVATEQYGSVSTNLQRGNI

SEQ ID NO: 26372 - protein, 30 aa, Artificial Sequence
  Description of Artificial Sequence: Synthetic polypeptide
DEEEIRTTNPVATEQYGSVNTGNLQMQGNE

SEQ ID NO: 26373 - protein, 28 aa, Artificial Sequence
  Description of Artificial Sequence: Synthetic peptide
DEEEIRTTNPVATEQYGDVSENEQQGNF

SEQ ID NO: 26374 - protein, 30 aa, Artificial Sequence
  Description of Artificial Sequence: Synthetic polypeptide
DEEEIRTTNPVATEVYGVVSVTNLQQRGNE

SEQ ID NO: 26375 - protein, 31 aa, Artificial Sequence
  Description of Artificial Sequence: Synthetic polypeptide
DEEEIRTTNPVATEQYGSVSTNLQDPDGNDH

SEQ ID NO: 26376 - protein, 28 aa, Artificial Sequence
  Description of Artificial Sequence: Synthetic peptide
VEEEIRTTNPVASEQYGSVSMNLQRGTQ

SEQ ID NO: 26377 - protein, 28 aa, Artificial Sequence
  Description of Artificial Sequence: Synthetic peptide
DEEEIRSTNPCATEQFGSVASNLQRGNR

SEQ ID NO: 26378 - protein, 28 aa, Artificial Sequence
  Description of Artificial Sequence: Synthetic peptide
DEEEIVTTNPVATEQYGEVATNLERGND

SEQ ID NO: 26379 - protein, 31 aa, Artificial Sequence
  Description of Artificial Sequence: Synthetic polypeptide
DEEEIRTTNPVATELYGSVSTMALQQREGNR

SEQ ID NO: 26380 - protein, 29 aa, Artificial Sequence
  Description of Artificial Sequence: Synthetic peptide
DEEEIRTTNPVATECYGSVSTNLQHGEDL

SEQ ID NO: 26381 - protein, 28 aa, Artificial Sequence
  Description of Artificial Sequence: Synthetic peptide
DEEEIRTTNPVATEQYGSVDTDWQHGNQ

SEQ ID NO: 26382 - protein, 28 aa, Artificial Sequence
  Description of Artificial Sequence: Synthetic peptide
DEEEIRCTNPVCTESYGSVSTNLQAGNE

SEQ ID NO: 26383 - protein, 28 aa, Artificial Sequence
  Description of Artificial Sequence: Synthetic peptide
SEEEIRTTNPVATEIFGSVSTNLQQGNF

SEQ ID NO: 26384 - protein, 30 aa, Artificial Sequence
  Description of Artificial Sequence: Synthetic polypeptide
DEEEIRTTNCVATEQYGSVSTGNMQVGNNR

SEQ ID NO: 26385 - protein, 29 aa, Artificial Sequence
  Description of Artificial Sequence: Synthetic peptide
AEEEISTTNPVATEQYGTVSATNLQRGGR

SEQ ID NO: 26386 - protein, 30 aa, Artificial Sequence
  Description of Artificial Sequence: Synthetic polypeptide
DEEEIRTTNPTATEQYGSVSTGNEQREGNQ

SEQ ID NO: 26387 - protein, 31 aa, Artificial Sequence
  Description of Artificial Sequence: Synthetic polypeptide
DEEEIRTTNPVATEQYGSVSTNGLVQEGDER

SEQ ID NO: 26388 - protein, 28 aa, Artificial Sequence
  Description of Artificial Sequence: Synthetic peptide
DEEEIAQTNPVATEQYGVVSTNLQRGED

SEQ ID NO: 26389 - protein, 30 aa, Artificial Sequence
  Description of Artificial Sequence: Synthetic polypeptide
DEEEIRTTNPVATEQYGSVSTGNLQVGDDQ

SEQ ID NO: 26390 - protein, 29 aa, Artificial Sequence
  Description of Artificial Sequence: Synthetic peptide
DENEIRTTNPVATEQYGSVSTDLERKGER

SEQ ID NO: 26391 - protein, 28 aa, Artificial Sequence
  Description of Artificial Sequence: Synthetic peptide
DEEEIRTTNPVACEQYGSVSVNLQAMND

SEQ ID NO: 26392 - protein, 31 aa, Artificial Sequence
  Description of Artificial Sequence: Synthetic polypeptide
DEEEIRTTNPVATECYGSVSATNLEDREGNR

SEQ ID NO: 26393 - protein, 28 aa, Artificial Sequence
  Description of Artificial Sequence: Synthetic peptide
DEEEIRSTNPVAVEQYGSVSTNWQQGNF

SEQ ID NO: 26394 - protein, 28 aa, Artificial Sequence
  Description of Artificial Sequence: Synthetic peptide
DENEIRTTNPVATECYGSVSTNLQSGDM

SEQ ID NO: 26395 - protein, 28 aa, Artificial Sequence
  Description of Artificial Sequence: Synthetic peptide
SEEEIRTTNPTATELFGSVSTNLQQGNR

SEQ ID NO: 26396 - protein, 30 aa, Artificial Sequence
  Description of Artificial Sequence: Synthetic polypeptide
DEGEIRTTNPVATEQYGSVCSSNGDQRGNR

SEQ ID NO: 26397 - protein, 33 aa, Artificial Sequence
  Description of Artificial Sequence: Synthetic polypeptide
DEEEIRTTNPVATEQYGSVISTENGLPQRGINR

SEQ ID NO: 26398 - protein, 28 aa, Artificial Sequence
  Description of Artificial Sequence: Synthetic peptide
DEEEIRTTNPVATEQYGIVSTNDQLGDY

SEQ ID NO: 26399 - protein, 30 aa, Artificial Sequence
  Description of Artificial Sequence: Synthetic polypeptide
DEEEIRTTNPVATEQYGSTSTNLQNDGIKR

SEQ ID NO: 26400 - protein, 31 aa, Artificial Sequence
  Description of Artificial Sequence: Synthetic polypeptide
DEEEIRTTNPVATEQYGSVCSTNNLDRGNEL

SEQ ID NO: 26401 - protein, 31 aa, Artificial Sequence
  Description of Artificial Sequence: Synthetic polypeptide
DEVEIRTTNPVATEQYGSVDSTENLPQGGNR

SEQ ID NO: 26402 - protein, 28 aa, Artificial Sequence
  Description of Artificial Sequence: Synthetic peptide
NEEELRTTNPVACEQYGCVSTNLERGNR

SEQ ID NO: 26403 - protein, 31 aa, Artificial Sequence
  Description of Artificial Sequence: Synthetic polypeptide
DEEEIRTTNPVATEQYGSVSWENLQRDGIND

SEQ ID NO: 26404 - protein, 30 aa, Artificial Sequence
  Description of Artificial Sequence: Synthetic polypeptide
DEEEIRATNPVATEQYGSVSEANLQRGNTV

SEQ ID NO: 26405 - protein, 28 aa, Artificial Sequence
  Description of Artificial Sequence: Synthetic peptide
DEAEVSTVNPVATEQYGAVSTNLQRGNR

SEQ ID NO: 26406 - protein, 29 aa, Artificial Sequence
  Description of Artificial Sequence: Synthetic peptide
DEEEIRTTNPVATEQWGSVSTNEQILGNW

SEQ ID NO: 26407 - protein, 30 aa, Artificial Sequence
  Description of Artificial Sequence: Synthetic polypeptide
DEEEIRTTNPMATEQYGSVIATNLQRGNHA

SEQ ID NO: 26408 - protein, 30 aa, Artificial Sequence
  Description of Artificial Sequence: Synthetic polypeptide
DENEIRTTNPVATEQYGVVDSTDLQRGNDR

SEQ ID NO: 26409 - protein, 28 aa, Artificial Sequence
  Description of Artificial Sequence: Synthetic peptide
DEEEIGTTNPVATEQYGSVPEVLQRGER

SEQ ID NO: 26410 - protein, 28 aa, Artificial Sequence
  Description of Artificial Sequence: Synthetic peptide
DETEVRTTNPVATEQYGEVSDNLQRGNS

SEQ ID NO: 26411 - protein, 28 aa, Artificial Sequence
  Description of Artificial Sequence: Synthetic peptide
DENEIATTNPVATEQYGSVSTNLQNGEV

SEQ ID NO: 26412 - protein, 28 aa, Artificial Sequence
  Description of Artificial Sequence: Synthetic peptide
AEHEIRCTNPVATEQYGSVSDDLQRGNR

SEQ ID NO: 26413 - protein, 29 aa, Artificial Sequence
  Description of Artificial Sequence: Synthetic peptide
DEEEIRTTNPVCTEQYGSVSMADQTRGNR

SEQ ID NO: 26414 - protein, 28 aa, Artificial Sequence
  Description of Artificial Sequence: Synthetic peptide
SEEEIRTTNPVATEQYGEVSENEQIGNR

SEQ ID NO: 26415 - protein, 28 aa, Artificial Sequence
  Description of Artificial Sequence: Synthetic peptide
DEEEIRTTNPVATEQYGSVSEEDQVGNL

SEQ ID NO: 26416 - protein, 28 aa, Artificial Sequence
  Description of Artificial Sequence: Synthetic peptide
DEEEIRTTNPVATEQWGSVSTNEMRGTQ

SEQ ID NO: 26417 - protein, 28 aa, Artificial Sequence
  Description of Artificial Sequence: Synthetic peptide
DEEEIRTTNPVATEQYGIVSTNDMRGTQ

SEQ ID NO: 26418 - protein, 28 aa, Artificial Sequence
  Description of Artificial Sequence: Synthetic peptide
DENEIRTTNPVATEQYGSSSENLQEENR

SEQ ID NO: 26419 - protein, 28 aa, Artificial Sequence
  Description of Artificial Sequence: Synthetic peptide
MENEIRTTNPVATECYGSVSTNLQHGNE

SEQ ID NO: 26420 - protein, 28 aa, Artificial Sequence
  Description of Artificial Sequence: Synthetic peptide
DEEEIAQTNPVATEQYGVVSTNLERGDR

SEQ ID NO: 26421 - protein, 29 aa, Artificial Sequence
  Description of Artificial Sequence: Synthetic peptide
DEQEIRTTNPVATEQYGSVSENEQMRGNA

SEQ ID NO: 26422 - protein, 31 aa, Artificial Sequence
  Description of Artificial Sequence: Synthetic polypeptide
DEEEIRTTNPVATEQYGSVSTMNEQDIGDNR

SEQ ID NO: 26423 - protein, 31 aa, Artificial Sequence
  Description of Artificial Sequence: Synthetic polypeptide
DEEEIRTTNPVATEQYGSVSTNLQEAEGNDQ

SEQ ID NO: 26424 - protein, 31 aa, Artificial Sequence
  Description of Artificial Sequence: Synthetic polypeptide
DEEEIRTTNPVATEQYGSVSTNLELVNGENR

SEQ ID NO: 26425 - protein, 28 aa, Artificial Sequence
  Description of Artificial Sequence: Synthetic peptide
DEEEIRTTNPVATEQYGSVSTADFLGNM

SEQ ID NO: 26426 - protein, 29 aa, Artificial Sequence
  Description of Artificial Sequence: Synthetic peptide
DENEISTTNPVATEQYGSVSTDLQRGNDF

SEQ ID NO: 26427 - protein, 28 aa, Artificial Sequence
  Description of Artificial Sequence: Synthetic peptide
DEEEIRTTNPVATEQYGSVSTGDDAGNL

SEQ ID NO: 26428 - protein, 29 aa, Artificial Sequence
  Description of Artificial Sequence: Synthetic peptide
DEQEIRTTNPVATEQYGSVSTNEQNIGNS

SEQ ID NO: 26429 - protein, 30 aa, Artificial Sequence
  Description of Artificial Sequence: Synthetic polypeptide
DEEEIRTTNPVATEQYGSVSTEPLQEDGNW

SEQ ID NO: 26430 - protein, 28 aa, Artificial Sequence
  Description of Artificial Sequence: Synthetic peptide
GEEEIATTNPVATEQYGTVSTNLDRGDR

SEQ ID NO: 26431 - protein, 28 aa, Artificial Sequence
  Description of Artificial Sequence: Synthetic peptide
DEEEIATTNPVATEQYGSVSTDLQVGEA

SEQ ID NO: 26432 - protein, 30 aa, Artificial Sequence
  Description of Artificial Sequence: Synthetic polypeptide
DEHEISTTNPVATEQYGSVSTMNLQTQGNR

SEQ ID NO: 26433 - protein, 28 aa, Artificial Sequence
  Description of Artificial Sequence: Synthetic peptide
DEQEIASTNPVATEVYGWVSTNLQRGNR

SEQ ID NO: 26434 - protein, 28 aa, Artificial Sequence
  Description of Artificial Sequence: Synthetic peptide
AENEIVTTNPVATEQYGWVSDNLQRGNR

SEQ ID NO: 26435 - protein, 28 aa, Artificial Sequence
  Description of Artificial Sequence: Synthetic peptide
DEEEIAATNPVATELYGSVSTNLQQGDR

SEQ ID NO: 26436 - protein, 28 aa, Artificial Sequence
  Description of Artificial Sequence: Synthetic peptide
NEEEIRTTNPVATEQYGSVSTADQMGND

SEQ ID NO: 26437 - protein, 31 aa, Artificial Sequence
  Description of Artificial Sequence: Synthetic polypeptide
DEEEIRTTNPVATEQYGSVSTGLQNEGENDR

SEQ ID NO: 26438 - protein, 33 aa, Artificial Sequence
  Description of Artificial Sequence: Synthetic polypeptide
DEEEIRTTNPVATEQYGSVSTTDNLVQREGDNR

SEQ ID NO: 26439 - protein, 29 aa, Artificial Sequence
  Description of Artificial Sequence: Synthetic peptide
SEEEIRTTNPVATEQYGSVSTNWQEQGNH

SEQ ID NO: 26440 - protein, 29 aa, Artificial Sequence
  Description of Artificial Sequence: Synthetic peptide
DEEEIRTTNPDATEQYGSVSTNDEEVGNR

SEQ ID NO: 26441 - protein, 30 aa, Artificial Sequence
  Description of Artificial Sequence: Synthetic polypeptide
DEEEIRTTNPVATEQYGSVSTNLQENGEDF

SEQ ID NO: 26442 - protein, 28 aa, Artificial Sequence
  Description of Artificial Sequence: Synthetic peptide
DEEEIRTTNPVASEQYGSVSTELEQGNI

SEQ ID NO: 26443 - protein, 30 aa, Artificial Sequence
  Description of Artificial Sequence: Synthetic polypeptide
DEEEIATTNPVATEQYGSVSATDLQEHGNR

SEQ ID NO: 26444 - protein, 28 aa, Artificial Sequence
  Description of Artificial Sequence: Synthetic peptide
SEEEIRTTNPTATEQYGSVSTNLQQGTS

SEQ ID NO: 26445 - protein, 28 aa, Artificial Sequence
  Description of Artificial Sequence: Synthetic peptide
DEEEIRTTNPVATEQYGWASTNWEFGNR

SEQ ID NO: 26446 - protein, 28 aa, Artificial Sequence
  Description of Artificial Sequence: Synthetic peptide
DEEEIRTTNPIATEQYGSVSTGLQVGYP

SEQ ID NO: 26447 - protein, 28 aa, Artificial Sequence
  Description of Artificial Sequence: Synthetic peptide
DEEEIRTTNPVAYQQYGWVSTNLDRGNP

SEQ ID NO: 26448 - protein, 28 aa, Artificial Sequence
  Description of Artificial Sequence: Synthetic peptide
DEEEIRTTNPVATEQWGSVSENEQQGNA

SEQ ID NO: 26449 - protein, 30 aa, Artificial Sequence
  Description of Artificial Sequence: Synthetic polypeptide
DEEEIVTTNPVATEQYGVVSVTNGQRNGNR

SEQ ID NO: 26450 - protein, 28 aa, Artificial Sequence
  Description of Artificial Sequence: Synthetic peptide
DEEEIRTTNPVATEQYGSVSTEDDEGNF

SEQ ID NO: 26451 - protein, 31 aa, Artificial Sequence
  Description of Artificial Sequence: Synthetic polypeptide
DENEIRTTNPVATEQYGSVSTNLQEREGNDM

SEQ ID NO: 26452 - protein, 28 aa, Artificial Sequence
  Description of Artificial Sequence: Synthetic peptide
DEEEIRTTNPVATEQYGSVSTEFYQGNF

SEQ ID NO: 26453 - protein, 29 aa, Artificial Sequence
  Description of Artificial Sequence: Synthetic peptide
DEEEIRTTNPVATEQYGSVSEMDLQHGNV

SEQ ID NO: 26454 - protein, 29 aa, Artificial Sequence
  Description of Artificial Sequence: Synthetic peptide
DEEEIRTTNPVATEQYGSVSTNEMNQGNS

SEQ ID NO: 26455 - protein, 28 aa, Artificial Sequence
  Description of Artificial Sequence: Synthetic peptide
DEEEIRTTNPVATEQYGSVDTGLEGGNG

SEQ ID NO: 26456 - protein, 29 aa, Artificial Sequence
  Description of Artificial Sequence: Synthetic peptide
MEEEIRTTNPVATEQYGSVSTDLQNGNDA

SEQ ID NO: 26457 - protein, 28 aa, Artificial Sequence
  Description of Artificial Sequence: Synthetic peptide
SEEELRTTNPVATELYGVVSTNLQRPNR

SEQ ID NO: 26458 - protein, 29 aa, Artificial Sequence
  Description of Artificial Sequence: Synthetic peptide
DEEEIRTTNPVATEQWGSVSENEQMRGNM

SEQ ID NO: 26459 - protein, 28 aa, Artificial Sequence
  Description of Artificial Sequence: Synthetic peptide
DEEEIRSTNPVATEQYGSVSTDLQLGDT

SEQ ID NO: 26460 - protein, 28 aa, Artificial Sequence
  Description of Artificial Sequence: Synthetic peptide
DEEEIRTTNPVCTEQYGVASTNLERGND

SEQ ID NO: 26461 - protein, 28 aa, Artificial Sequence
  Description of Artificial Sequence: Synthetic peptide
DEEEIRSTNPVATEQYGSVSTNLEHGES

SEQ ID NO: 26462 - protein, 31 aa, Artificial Sequence
  Description of Artificial Sequence: Synthetic polypeptide
DEEEIRTTNPVATEQYGSVSTINPLQADGER

SEQ ID NO: 26463 - protein, 30 aa, Artificial Sequence
  Description of Artificial Sequence: Synthetic polypeptide
DEQEIRTTNPVATEIYGCVSATNLQREGNR

SEQ ID NO: 26464 - protein, 28 aa, Artificial Sequence
  Description of Artificial Sequence: Synthetic peptide
DEQEIRTTNPVATSQYGSVSTELQGGNM

SEQ ID NO: 26465 - protein, 33 aa, Artificial Sequence
  Description of Artificial Sequence: Synthetic polypeptide
DEEEIRTTNPVATEQYGSVSETNLVQREGENDR

SEQ ID NO: 26466 - protein, 28 aa, Artificial Sequence
  Description of Artificial Sequence: Synthetic peptide
QENEIATTNPVATEQYGIVSDNLQRGNR

SEQ ID NO: 26467 - protein, 28 aa, Artificial Sequence
  Description of Artificial Sequence: Synthetic peptide
DEEEIRTTNPVATECYGSVSEELQRGEM

SEQ ID NO: 26468 - protein, 29 aa, Artificial Sequence
  Description of Artificial Sequence: Synthetic peptide
DEEEIATTNPVATEQYGSVSDNVQQGNFR

SEQ ID NO: 26469 - protein, 29 aa, Artificial Sequence
  Description of Artificial Sequence: Synthetic peptide
DEEEIRTTNPVATEQYGSVSTDLEEVGNS

SEQ ID NO: 26470 - protein, 28 aa, Artificial Sequence
  Description of Artificial Sequence: Synthetic peptide
DEQEIRTTNPVATEQYGSVSTNLDDGDF

SEQ ID NO: 26471 - protein, 28 aa, Artificial Sequence
  Description of Artificial Sequence: Synthetic peptide
DEEEIATTNPTATEQYGSVSTNPQIGNS

SEQ ID NO: 26472 - protein, 28 aa, Artificial Sequence
  Description of Artificial Sequence: Synthetic peptide
AEEEIRTTNPVATEQYGSVSEDQQRGER

SEQ ID NO: 26473 - protein, 29 aa, Artificial Sequence
  Description of Artificial Sequence: Synthetic peptide
DEEEIRTTNPVATEQYGSVSTELQVGEDF

SEQ ID NO: 26474 - protein, 28 aa, Artificial Sequence
  Description of Artificial Sequence: Synthetic peptide
DEQEIRTTNPVATEQYGSVSMNDQIGNL

SEQ ID NO: 26475 - protein, 31 aa, Artificial Sequence
  Description of Artificial Sequence: Synthetic polypeptide
DEEEIRPTNPVATEQYGSVSITPNLDRGNPR

SEQ ID NO: 26476 - protein, 31 aa, Artificial Sequence
  Description of Artificial Sequence: Synthetic polypeptide
DEEEIRTTNPVATEQYGSVSTANEQNGDNTR

SEQ ID NO: 26477 - protein, 28 aa, Artificial Sequence
  Description of Artificial Sequence: Synthetic peptide
DEEEIRTTNPVATECYGSVSTNLETGEL

SEQ ID NO: 26478 - protein, 28 aa, Artificial Sequence
  Description of Artificial Sequence: Synthetic peptide
SEEEIRATNPVATEMYGGVSENLQRGNR

SEQ ID NO: 26479 - protein, 28 aa, Artificial Sequence
  Description of Artificial Sequence: Synthetic peptide
QEEEIATTNPVATEQYGSVSTNLQIGEL

SEQ ID NO: 26480 - protein, 29 aa, Artificial Sequence
  Description of Artificial Sequence: Synthetic peptide
DEEEIRTTNPVATEQWGSVSTNEQMIGNL

SEQ ID NO: 26481 - protein, 31 aa, Artificial Sequence
  Description of Artificial Sequence: Synthetic polypeptide
DEEEIRTTNPVATEQYGSVSDTENLQIGVNI

SEQ ID NO: 26482 - protein, 28 aa, Artificial Sequence
  Description of Artificial Sequence: Synthetic peptide
DENEIAQTNPVATEQYGDVSTNLQRGQR

SEQ ID NO: 26483 - protein, 31 aa, Artificial Sequence
  Description of Artificial Sequence: Synthetic polypeptide
DEEEIRTTNPVATEQYGSVSTNLQDGGEDDR

SEQ ID NO: 26484 - protein, 28 aa, Artificial Sequence
  Description of Artificial Sequence: Synthetic peptide
DEEEIRTTNPVCTEQYGVVSTNGQRGED

SEQ ID NO: 26485 - protein, 28 aa, Artificial Sequence
  Description of Artificial Sequence: Synthetic peptide
DENEIRTTNPVATELYGCTSENLQRGNR

SEQ ID NO: 26486 - protein, 30 aa, Artificial Sequence
  Description of Artificial Sequence: Synthetic polypeptide
DESEIRTTNPVATFQYGSVSATNWQRGENR

SEQ ID NO: 26487 - protein, 28 aa, Artificial Sequence
  Description of Artificial Sequence: Synthetic peptide
DEEEVRATNPVSYEQYGSVSNNLQRGNR

SEQ ID NO: 26488 - protein, 29 aa, Artificial Sequence
  Description of Artificial Sequence: Synthetic peptide
DEEEIRTTNPVATENYGSVSTNLQHGVPQ

SEQ ID NO: 26489 - protein, 28 aa, Artificial Sequence
  Description of Artificial Sequence: Synthetic peptide
QEEEIATTNPVATEQYGSVSTNWQPGND

SEQ ID NO: 26490 - protein, 29 aa, Artificial Sequence
  Description of Artificial Sequence: Synthetic peptide
DEQEIRCTNPVATEQYGSVSTNLQVEGNL

SEQ ID NO: 26491 - protein, 29 aa, Artificial Sequence
  Description of Artificial Sequence: Synthetic peptide
DEECIRTTNPVATEQYGSVSHNLDRGENP

SEQ ID NO: 26492 - protein, 31 aa, Artificial Sequence
  Description of Artificial Sequence: Synthetic polypeptide
DEEEIRTTNPVATEQYGSVSTMNEQDRGDNF

SEQ ID NO: 26493 - protein, 28 aa, Artificial Sequence
  Description of Artificial Sequence: Synthetic peptide
SEEEIRTTNPEATETYGSVSTNLQRGPI

SEQ ID NO: 26494 - protein, 30 aa, Artificial Sequence
  Description of Artificial Sequence: Synthetic polypeptide
DEEEIRTTNPVATEQYGSVSTGDLENGNDR

SEQ ID NO: 26495 - protein, 29 aa, Artificial Sequence
  Description of Artificial Sequence: Synthetic peptide
DEEEIATTNPVATECYGSVSTELQNGNDR

SEQ ID NO: 26496 - protein, 29 aa, Artificial Sequence
  Description of Artificial Sequence: Synthetic peptide
QEEEIRTTNPVATEQYGTVISTDLQRENR

SEQ ID NO: 26497 - protein, 28 aa, Artificial Sequence
  Description of Artificial Sequence: Synthetic peptide
DENEIATTNPFATEQYGSVSTNLERGER

SEQ ID NO: 26498 - protein, 29 aa, Artificial Sequence
  Description of Artificial Sequence: Synthetic peptide
DEEEIRTTNPVATEQYGSYSLENLQHGNA

SEQ ID NO: 26499 - protein, 28 aa, Artificial Sequence
  Description of Artificial Sequence: Synthetic peptide
DEEEIRTTNPVATEQYGSWSTNLYPGDF

SEQ ID NO: 26500 - protein, 30 aa, Artificial Sequence
  Description of Artificial Sequence: Synthetic polypeptide
DENEIRTTNPVATEQYGSVATELQIREGNR

SEQ ID NO: 26501 - protein, 28 aa, Artificial Sequence
  Description of Artificial Sequence: Synthetic peptide
DEQEIRTTNPVATEQYGSVSTDDQREDR

SEQ ID NO: 26502 - protein, 28 aa, Artificial Sequence
  Description of Artificial Sequence: Synthetic peptide
DEEEIRTTNPVATEQYGSVSTNEDTGEW

SEQ ID NO: 26503 - protein, 28 aa, Artificial Sequence
  Description of Artificial Sequence: Synthetic peptide
SEEEIRQTNPVATEQYGSVSTNLCDGNC

SEQ ID NO: 26504 - protein, 30 aa, Artificial Sequence
  Description of Artificial Sequence: Synthetic polypeptide
DEEEIRTTNPVATECYGSVSTENLEERGNA

SEQ ID NO: 26505 - protein, 29 aa, Artificial Sequence
  Description of Artificial Sequence: Synthetic peptide
DEEEIRTTNPVATECYGWVSTNLQRKGEV

SEQ ID NO: 26506 - protein, 28 aa, Artificial Sequence
  Description of Artificial Sequence: Synthetic peptide
DEEEIRTTNPVATELYGSVSTDDQTGNY

SEQ ID NO: 26507 - protein, 31 aa, Artificial Sequence
  Description of Artificial Sequence: Synthetic polypeptide
DEEEIRTTNPVATEQYGSVSETPLVQMGMNR

SEQ ID NO: 26508 - protein, 30 aa, Artificial Sequence
  Description of Artificial Sequence: Synthetic polypeptide
DEEEIRTTNPVATEIYGVVSTNLQVRGNDV

SEQ ID NO: 26509 - protein, 28 aa, Artificial Sequence
  Description of Artificial Sequence: Synthetic peptide
NEEVIRTTNPVATEQWGSVSTALQRGND

SEQ ID NO: 26510 - protein, 28 aa, Artificial Sequence
  Description of Artificial Sequence: Synthetic peptide
SEVEIRTTNPVATEMFGSVSTNLQRGDR

SEQ ID NO: 26511 - protein, 28 aa, Artificial Sequence
  Description of Artificial Sequence: Synthetic peptide
DEEEIRTTNPVASECYGSVSENLQNGNA

SEQ ID NO: 26512 - protein, 28 aa, Artificial Sequence
  Description of Artificial Sequence: Synthetic peptide
DEGEIRTTNPVATELYGSVSVNLQTGNF

SEQ ID NO: 26513 - protein, 28 aa, Artificial Sequence
  Description of Artificial Sequence: Synthetic peptide
DEEEIRTTNPVATEQYGSVSTDLEWGEV

SEQ ID NO: 26514 - protein, 29 aa, Artificial Sequence
  Description of Artificial Sequence: Synthetic peptide
DENEIRTTNPVATEQYGSMSTNLQDLGNF

SEQ ID NO: 26515 - protein, 31 aa, Artificial Sequence
  Description of Artificial Sequence: Synthetic polypeptide
DEEEIRTTNPVATEQYGSVSTTDLQRGENDV

SEQ ID NO: 26516 - protein, 28 aa, Artificial Sequence
  Description of Artificial Sequence: Synthetic peptide
YEEEVRTTNPMATEQYGSVSTNLQAGNV

SEQ ID NO: 26517 - protein, 28 aa, Artificial Sequence
  Description of Artificial Sequence: Synthetic peptide
DEEEIRSTNPVATEVYGTVSTELQRGNL

SEQ ID NO: 26518 - protein, 29 aa, Artificial Sequence
  Description of Artificial Sequence: Synthetic peptide
AEEEISTTNPVATEQYGSASAENLQRGNR

SEQ ID NO: 26519 - protein, 30 aa, Artificial Sequence
  Description of Artificial Sequence: Synthetic polypeptide
DEEEIRTTNPVATEQYGSVSTEPLQINGNY

SEQ ID NO: 26520 - protein, 29 aa, Artificial Sequence
  Description of Artificial Sequence: Synthetic peptide
DEEEIRTTNPVATEQYGEVSENLQSGDNI

SEQ ID NO: 26521 - protein, 28 aa, Artificial Sequence
  Description of Artificial Sequence: Synthetic peptide
KEEEIRTTNPVATECYGSVSTELQYGNM

SEQ ID NO: 26522 - protein, 28 aa, Artificial Sequence
  Description of Artificial Sequence: Synthetic peptide
DENEIATTNPVATEQYGSASTNLQNGNL

SEQ ID NO: 26523 - protein, 28 aa, Artificial Sequence
  Description of Artificial Sequence: Synthetic peptide
DEEEIRTTNPVATEQYGSVSENEQVGTA

SEQ ID NO: 26524 - protein, 30 aa, Artificial Sequence
  Description of Artificial Sequence: Synthetic polypeptide
DEEEIRTTNPVATEQYGSVSTDLQDRGEDN

SEQ ID NO: 26525 - protein, 28 aa, Artificial Sequence
  Description of Artificial Sequence: Synthetic peptide
DEEEIRTTNPCASEWYGCVSTNLERGNR

SEQ ID NO: 26526 - protein, 31 aa, Artificial Sequence
  Description of Artificial Sequence: Synthetic polypeptide
DEEEIRTTNPVATEQYGSVSTDLQEREGEDR

SEQ ID NO: 26527 - protein, 28 aa, Artificial Sequence
  Description of Artificial Sequence: Synthetic peptide
DEEEIRCTNPVATEQYGSVSNGLQSENR

SEQ ID NO: 26528 - protein, 28 aa, Artificial Sequence
  Description of Artificial Sequence: Synthetic peptide
DENEIRTTNPVATEQWGSVSTNLMQGNF

SEQ ID NO: 26529 - protein, 28 aa, Artificial Sequence
  Description of Artificial Sequence: Synthetic peptide
MEEEIRTTNPVATECYGSVSTNLQNGDD

SEQ ID NO: 26530 - protein, 29 aa, Artificial Sequence
  Description of Artificial Sequence: Synthetic peptide
DEEEIASTNPVATEQYGSVSTELQERGNF

SEQ ID NO: 26531 - protein, 29 aa, Artificial Sequence
  Description of Artificial Sequence: Synthetic peptide
DEEEIRTTNPCATELYGSVSTNLQHEGNM

SEQ ID NO: 26532 - protein, 29 aa, Artificial Sequence
  Description of Artificial Sequence: Synthetic peptide
GEEEIATTNPVATEQWGSVSTELQRAGNR

SEQ ID NO: 26533 - protein, 28 aa, Artificial Sequence
  Description of Artificial Sequence: Synthetic peptide
DEEEIATTNPVSTEQYGDVSTNPQRGER

SEQ ID NO: 26534 - protein, 28 aa, Artificial Sequence
  Description of Artificial Sequence: Synthetic peptide
TEEEVRTTNPVCYEQYGSVSTNLERGNR

SEQ ID NO: 26535 - protein, 28 aa, Artificial Sequence
  Description of Artificial Sequence: Synthetic peptide
DEDEIRTTNPVATEIYGSVSENLQRGDS

SEQ ID NO: 26536 - protein, 28 aa, Artificial Sequence
  Description of Artificial Sequence: Synthetic peptide
DEEEIRTTNPVATEQYGSVSTDLEWGEG

SEQ ID NO: 26537 - protein, 32 aa, Artificial Sequence
  Description of Artificial Sequence: Synthetic polypeptide
DEEEIRTTNPVATEQYGSVTSDDNLQRMGNYR

SEQ ID NO: 26538 - protein, 28 aa, Artificial Sequence
  Description of Artificial Sequence: Synthetic peptide
DEAEIVTTNPVATEQYGSVSMNLQVGNY

SEQ ID NO: 26539 - protein, 30 aa, Artificial Sequence
  Description of Artificial Sequence: Synthetic polypeptide
DEEEITTTNPVATEQYGSVSTELQRKGENM

SEQ ID NO: 26540 - protein, 28 aa, Artificial Sequence
  Description of Artificial Sequence: Synthetic peptide
AEEEIRTTNPVATEQYGSVSTNPIAGER

SEQ ID NO: 26541 - protein, 29 aa, Artificial Sequence
  Description of Artificial Sequence: Synthetic peptide
DEEEIRTTNPVCTEQYGVVSTNLQVGNDL

SEQ ID NO: 26542 - protein, 28 aa, Artificial Sequence
  Description of Artificial Sequence: Synthetic peptide
DEVEIRTTNPVATEQYGWVSTDLEMGNR

SEQ ID NO: 26543 - protein, 28 aa, Artificial Sequence
  Description of Artificial Sequence: Synthetic peptide
DEEEISTTNPVATEQWGSVSTNEMRGNA

SEQ ID NO: 26544 - protein, 28 aa, Artificial Sequence
  Description of Artificial Sequence: Synthetic peptide
DEQEIRTTNPVATEQYGSVSDNEQVGNE

SEQ ID NO: 26545 - protein, 28 aa, Artificial Sequence
  Description of Artificial Sequence: Synthetic peptide
VEQEIATTNPVATEIYGWVSTNLQRGNR

SEQ ID NO: 26546 - protein, 28 aa, Artificial Sequence
  Description of Artificial Sequence: Synthetic peptide
DENEIRTTNPVATEQYGSVSTNEMREDR

SEQ ID NO: 26547 - protein, 30 aa, Artificial Sequence
  Description of Artificial Sequence: Synthetic polypeptide
DEEEIRTTNPVATEQYGSVSTNPQENGNTG

SEQ ID NO: 26548 - protein, 31 aa, Artificial Sequence
  Description of Artificial Sequence: Synthetic polypeptide
DEEEIATTNPVATEQYGSVSATNLQERGNDL

SEQ ID NO: 26549 - protein, 29 aa, Artificial Sequence
  Description of Artificial Sequence: Synthetic peptide
DEEEVRCTNPVATEIYGSVATNLQREGNR

SEQ ID NO: 26550 - protein, 28 aa, Artificial Sequence
  Description of Artificial Sequence: Synthetic peptide
DEDEIVTTNPVSTEVYGTVSTNLQRGNR

SEQ ID NO: 26551 - protein, 28 aa, Artificial Sequence
  Description of Artificial Sequence: Synthetic peptide
DEEEICTTNPVSTEHYGSISDNLQRGNR

SEQ ID NO: 26552 - protein, 28 aa, Artificial Sequence
  Description of Artificial Sequence: Synthetic peptide
DEEEIATTNPTATEQYGSVSTNEQHGNA

SEQ ID NO: 26553 - protein, 28 aa, Artificial Sequence
  Description of Artificial Sequence: Synthetic peptide
DEEEIATTNPVATEQYGSVSTNDQHGEL

SEQ ID NO: 26554 - protein, 28 aa, Artificial Sequence
  Description of Artificial Sequence: Synthetic peptide
DEEEIRTTNPVATEQWGSVSTNEELGNF

SEQ ID NO: 26555 - protein, 30 aa, Artificial Sequence
  Description of Artificial Sequence: Synthetic polypeptide
DEEEIRTTNPVATEIYGCVAATNLQREGNR

SEQ ID NO: 26556 - protein, 29 aa, Artificial Sequence
  Description of Artificial Sequence: Synthetic peptide
DEREIRTTNPVATEAYGSVSTNLQRSMDR

SEQ ID NO: 26557 - protein, 28 aa, Artificial Sequence
  Description of Artificial Sequence: Synthetic peptide
AEQEIATTNPVATENYGWVSTNLQRGNR

SEQ ID NO: 26558 - protein, 29 aa, Artificial Sequence
  Description of Artificial Sequence: Synthetic peptide
DEEEIRTTNPVATEQWGSVSENLMMRGNF

SEQ ID NO: 26559 - protein, 28 aa, Artificial Sequence
  Description of Artificial Sequence: Synthetic peptide
DENEIRTTNPVATEQWGSVSENEQRGNF

SEQ ID NO: 26560 - protein, 31 aa, Artificial Sequence
  Description of Artificial Sequence: Synthetic polypeptide
DEEEIRTTNPVATEQYGVVSTNLERKGENDR

SEQ ID NO: 26561 - protein, 28 aa, Artificial Sequence
  Description of Artificial Sequence: Synthetic peptide
EEEEIRTTNPVATEQYGSASTNLQAMNN

SEQ ID NO: 26562 - protein, 28 aa, Artificial Sequence
  Description of Artificial Sequence: Synthetic peptide
DEQEIATTNPVATEQYGSVSTDLQHGNL

SEQ ID NO: 26563 - protein, 28 aa, Artificial Sequence
  Description of Artificial Sequence: Synthetic peptide
DENEIATTNPVATEQYGSVSTNLELGNH

SEQ ID NO: 26564 - protein, 30 aa, Artificial Sequence
  Description of Artificial Sequence: Synthetic polypeptide
DEEEIRTTNPTATELYGSVSTNGLQDGGNR

SEQ ID NO: 26565 - protein, 28 aa, Artificial Sequence
  Description of Artificial Sequence: Synthetic peptide
DEEEIRTTNPVATEQYGSVSTEDEPGNN

SEQ ID NO: 26566 - protein, 29 aa, Artificial Sequence
  Description of Artificial Sequence: Synthetic peptide
DEEEIRTTNPVATEQYGSCAENLQRGDDR

SEQ ID NO: 26567 - protein, 30 aa, Artificial Sequence
  Description of Artificial Sequence: Synthetic polypeptide
DEHEIRTTNPVATEQYGDVSCEMNLQRGNR

SEQ ID NO: 26568 - protein, 29 aa, Artificial Sequence
  Description of Artificial Sequence: Synthetic peptide
SEEEIRTTNPVSTEQYGSVSTANLQAGNV

SEQ ID NO: 26569 - protein, 31 aa, Artificial Sequence
  Description of Artificial Sequence: Synthetic polypeptide
DEEEIRTTNPVATEQYGSVSTMNGEQRGTTR

SEQ ID NO: 26570 - protein, 28 aa, Artificial Sequence
  Description of Artificial Sequence: Synthetic peptide
DEEEIAATNPVATEIYGDVSTNLQRENR

SEQ ID NO: 26571 - protein, 28 aa, Artificial Sequence
  Description of Artificial Sequence: Synthetic peptide
DEEEIRTTNPVATECYGSVSTELQYGEF

SEQ ID NO: 26572 - protein, 28 aa, Artificial Sequence
  Description of Artificial Sequence: Synthetic peptide
DEEEIRTTNPVATEQYGTVSTDWQSGNT

SEQ ID NO: 26573 - protein, 28 aa, Artificial Sequence
  Description of Artificial Sequence: Synthetic peptide
HELEIATTNPVATEQYGSASTNIQRGNR

SEQ ID NO: 26574 - protein, 28 aa, Artificial Sequence
  Description of Artificial Sequence: Synthetic peptide
DEGEIRTTNPVATECYGEVSCNLQRGER

SEQ ID NO: 26575 - protein, 30 aa, Artificial Sequence
  Description of Artificial Sequence: Synthetic polypeptide
DEEEIRTTNPVATEQYGSVSTANPQLGNTV

SEQ ID NO: 26576 - protein, 28 aa, Artificial Sequence
  Description of Artificial Sequence: Synthetic peptide
DEEEIRTTNPVATEQYGEVSTWLLMGNN

SEQ ID NO: 26577 - protein, 29 aa, Artificial Sequence
  Description of Artificial Sequence: Synthetic peptide
DEEEIRTTNPVATEQYGSVSENLQEHGEN

SEQ ID NO: 26578 - protein, 28 aa, Artificial Sequence
  Description of Artificial Sequence: Synthetic peptide
SEEEIRTTNPVATEQYGSVSMNQQGGNH

SEQ ID NO: 26579 - protein, 30 aa, Artificial Sequence
  Description of Artificial Sequence: Synthetic polypeptide
DEEEIRTTNPVATEQYGDVSMNLQQEGNDR

SEQ ID NO: 26580 - protein, 28 aa, Artificial Sequence
  Description of Artificial Sequence: Synthetic peptide
DEEEIRQTNPVSTEVYGEVSTNLQHGNR

SEQ ID NO: 26581 - protein, 28 aa, Artificial Sequence
  Description of Artificial Sequence: Synthetic peptide
DEEEIRTTNPIATFQYGSVSTDLERGNP

SEQ ID NO: 26582 - protein, 30 aa, Artificial Sequence
  Description of Artificial Sequence: Synthetic polypeptide
DEEEIATTNPVATEQYGSVSTEDLQLGNDR

SEQ ID NO: 26583 - protein, 28 aa, Artificial Sequence
  Description of Artificial Sequence: Synthetic peptide
DEEEIRTTNPVATEQYGSVSTDLDYGEA

SEQ ID NO: 26584 - protein, 28 aa, Artificial Sequence
  Description of Artificial Sequence: Synthetic peptide
KEEEIATTNPVATEQYGDVSTNLQNGER

SEQ ID NO: 26585 - protein, 28 aa, Artificial Sequence
  Description of Artificial Sequence: Synthetic peptide
DEEEIRTTNPVATEQYGDVSENEMRGDR

SEQ ID NO: 26586 - protein, 28 aa, Artificial Sequence
  Description of Artificial Sequence: Synthetic peptide
DEEEIATTNPTATEQYGSVSTAEQRGNF

SEQ ID NO: 26587 - protein, 28 aa, Artificial Sequence
  Description of Artificial Sequence: Synthetic peptide
DEEEIRTTNPEATEQYGSVSTCQQNGNC

SEQ ID NO: 26588 - protein, 30 aa, Artificial Sequence
  Description of Artificial Sequence: Synthetic polypeptide
DEEEIRTTNPVATEQYGSVSDTFNLQNGHT

SEQ ID NO: 26589 - protein, 28 aa, Artificial Sequence
  Description of Artificial Sequence: Synthetic peptide
DEEEIRATNPVATEQYGSVSADLQGGNG

SEQ ID NO: 26590 - protein, 28 aa, Artificial Sequence
  Description of Artificial Sequence: Synthetic peptide
DEEEIRTTNPVATECYGSVSTDLEHGNL

SEQ ID NO: 26591 - protein, 28 aa, Artificial Sequence
  Description of Artificial Sequence: Synthetic peptide
DEEEIRTTNPVATELYGVVSTNLQGGDT

SEQ ID NO: 26592 - protein, 28 aa, Artificial Sequence
  Description of Artificial Sequence: Synthetic peptide
DEEEIRTTNPVATEQYGSADNNEQVGNR

SEQ ID NO: 26593 - protein, 28 aa, Artificial Sequence
  Description of Artificial Sequence: Synthetic peptide
SEEEIRATNPTATEQFGSVSTNLQRGDR

SEQ ID NO: 26594 - protein, 32 aa, Artificial Sequence
  Description of Artificial Sequence: Synthetic polypeptide
DEEEIRTTNPVATEQYGVVSITDNLVQIRGNR

SEQ ID NO: 26595 - protein, 28 aa, Artificial Sequence
  Description of Artificial Sequence: Synthetic peptide
DEQEIASTNPVATEIYGVVSTNLQRGNR

SEQ ID NO: 26596 - protein, 28 aa, Artificial Sequence
  Description of Artificial Sequence: Synthetic peptide
DEEEIATTNPVATEQFGSVSTNEQRGTF

SEQ ID NO: 26597 - protein, 28 aa, Artificial Sequence
  Description of Artificial Sequence: Synthetic peptide
VEEEVRTTNPVATEQYGNVANNLQRGNR

SEQ ID NO: 26598 - protein, 28 aa, Artificial Sequence
  Description of Artificial Sequence: Synthetic peptide
DEGEIRTTNPVATEQYGSASTELTRGND

SEQ ID NO: 26599 - protein, 28 aa, Artificial Sequence
  Description of Artificial Sequence: Synthetic peptide
DEEEIRTTNPCATEQYGSVHTNKDSGNR

SEQ ID NO: 26600 - protein, 30 aa, Artificial Sequence
  Description of Artificial Sequence: Synthetic polypeptide
DEEEIRTTNPVATEQFGSVSTNLQIEGENH

SEQ ID NO: 26601 - protein, 28 aa, Artificial Sequence
  Description of Artificial Sequence: Synthetic peptide
DEQEIATTNPVATEQYGSVSTDLQGGNA

SEQ ID NO: 26602 - protein, 28 aa, Artificial Sequence
  Description of Artificial Sequence: Synthetic peptide
REEEIATTNPVATECYGGCSTNLQRGNR

SEQ ID NO: 26603 - protein, 28 aa, Artificial Sequence
  Description of Artificial Sequence: Synthetic peptide
DEEEIRTTNPVATFQYGSVTTGLLRGNE

SEQ ID NO: 26604 - protein, 28 aa, Artificial Sequence
  Description of Artificial Sequence: Synthetic peptide
DEEEIRTTNPVATEQYGSVSTEDERGEQ

SEQ ID NO: 26605 - protein, 28 aa, Artificial Sequence
  Description of Artificial Sequence: Synthetic peptide
DEEEIRSTNPVAYEQYGSVSTNLMPGTR

SEQ ID NO: 26606 - protein, 29 aa, Artificial Sequence
  Description of Artificial Sequence: Synthetic peptide
DEEEIRTTNPVATEQYGSVSTDLQDVGEN

SEQ ID NO: 26607 - protein, 30 aa, Artificial Sequence
  Description of Artificial Sequence: Synthetic polypeptide
DEEEIRTTNPVATEQYGSVSENLQDRDGDH

SEQ ID NO: 26608 - protein, 28 aa, Artificial Sequence
  Description of Artificial Sequence: Synthetic peptide
DEEEIRTTNPVATECYGDVSTPLDRENR

SEQ ID NO: 26609 - protein, 28 aa, Artificial Sequence
  Description of Artificial Sequence: Synthetic peptide
MEEEIRTTNPVATEQYGSMSTNPQNGNM

SEQ ID NO: 26610 - protein, 28 aa, Artificial Sequence
  Description of Artificial Sequence: Synthetic peptide
DEQEIRTTNPVASEIYGCVSTNLERGNR

SEQ ID NO: 26611 - protein, 28 aa, Artificial Sequence
  Description of Artificial Sequence: Synthetic peptide
DEEEIRTTNPVATELWGSVSTNLMQGNA

SEQ ID NO: 26612 - protein, 28 aa, Artificial Sequence
  Description of Artificial Sequence: Synthetic peptide
DEEEIRTTNPVATEQYGSVSTDLEVGEF

SEQ ID NO: 26613 - protein, 30 aa, Artificial Sequence
  Description of Artificial Sequence: Synthetic polypeptide
DEEELRTTNPVATEQYGSISETNLQNGVNR

SEQ ID NO: 26614 - protein, 28 aa, Artificial Sequence
  Description of Artificial Sequence: Synthetic peptide
DEEEIRTTNPVCSEQYGVVSTNLENGNR

SEQ ID NO: 26615 - protein, 28 aa, Artificial Sequence
  Description of Artificial Sequence: Synthetic peptide
DEEEIRTTNPVATEQYGSVDTNDNYGNQ

SEQ ID NO: 26616 - protein, 28 aa, Artificial Sequence
  Description of Artificial Sequence: Synthetic peptide
AEEEIRTTNPVATEQYGNVSENLQRGEA

SEQ ID NO: 26617 - protein, 28 aa, Artificial Sequence
  Description of Artificial Sequence: Synthetic peptide
DEEEIRTTNPVATECYGSMSTNLQLGEI

SEQ ID NO: 26618 - protein, 28 aa, Artificial Sequence
  Description of Artificial Sequence: Synthetic peptide
DEEEIRTTNPVATEQWGSVSTNEQTGTL

SEQ ID NO: 26619 - protein, 28 aa, Artificial Sequence
  Description of Artificial Sequence: Synthetic peptide
DENEIRTTNPVATEQYGSANENLQRENR

SEQ ID NO: 26620 - protein, 31 aa, Artificial Sequence
  Description of Artificial Sequence: Synthetic polypeptide
DEEEIRTTNPVATEQYGSYVSTINLDRDNPR

SEQ ID NO: 26621 - protein, 28 aa, Artificial Sequence
  Description of Artificial Sequence: Synthetic peptide
DEEEIRCTNPVASEIYGCVSTNLERGNR

SEQ ID NO: 26622 - protein, 28 aa, Artificial Sequence
  Description of Artificial Sequence: Synthetic peptide
DEEEIRTTNPVATEQYGSVSTADLRGEA

SEQ ID NO: 26623 - protein, 28 aa, Artificial Sequence
  Description of Artificial Sequence: Synthetic peptide
DEEEIRTTNPCATEVYGVVSTNWQRGNE

SEQ ID NO: 26624 - protein, 28 aa, Artificial Sequence
  Description of Artificial Sequence: Synthetic peptide
DEQEIATTNPVATECYGSVSTNLERGER

SEQ ID NO: 26625 - protein, 29 aa, Artificial Sequence
  Description of Artificial Sequence: Synthetic peptide
DEEEIRTTNPVATEVYGSVSTELQTEGNL

SEQ ID NO: 26626 - protein, 28 aa, Artificial Sequence
  Description of Artificial Sequence: Synthetic peptide
DEFEIRTTNPVATECYGSVSENLQSGNF

SEQ ID NO: 26627 - protein, 28 aa, Artificial Sequence
  Description of Artificial Sequence: Synthetic peptide
DENEIRTTNPVATEQYGSVSENEMRGNF

SEQ ID NO: 26628 - protein, 32 aa, Artificial Sequence
  Description of Artificial Sequence: Synthetic polypeptide
DEEEIRTTNPVATEQYGSVTDNTNLPQRGANR

SEQ ID NO: 26629 - protein, 29 aa, Artificial Sequence
  Description of Artificial Sequence: Synthetic peptide
DEEEIRTTNPVATEQYGAFVSENLQNGDR

SEQ ID NO: 26630 - protein, 28 aa, Artificial Sequence
  Description of Artificial Sequence: Synthetic peptide
DEEEIATTNPVATEQYGGVSTNGQAGNE

SEQ ID NO: 26631 - protein, 30 aa, Artificial Sequence
  Description of Artificial Sequence: Synthetic polypeptide
DEEEIAQTNPVATEQYGSVSTNLQRGDNDQ

SEQ ID NO: 26632 - protein, 30 aa, Artificial Sequence
  Description of Artificial Sequence: Synthetic polypeptide
DEEETRTTNPVATEQYGSVSTMNQQAGNYR

SEQ ID NO: 26633 - protein, 30 aa, Artificial Sequence
  Description of Artificial Sequence: Synthetic polypeptide
DEEEIRTTNPVATEIYGCVSATNLEREGNR

SEQ ID NO: 26634 - protein, 32 aa, Artificial Sequence
  Description of Artificial Sequence: Synthetic polypeptide
DEEEIRQTNPVATEQYGSVSATTNGLQRGNDR

SEQ ID NO: 26635 - protein, 31 aa, Artificial Sequence
  Description of Artificial Sequence: Synthetic polypeptide
DEEEIRTTNPVATEQYGSVSTMNLQDRGDTF

SEQ ID NO: 26636 - protein, 28 aa, Artificial Sequence
  Description of Artificial Sequence: Synthetic peptide
DEEEIATTNPVATEMFGSVSTNLQRGDF

SEQ ID NO: 26637 - protein, 30 aa, Artificial Sequence
  Description of Artificial Sequence: Synthetic polypeptide
DEEEIRCTNPCATEQYGSVSTMNLQELGNR

SEQ ID NO: 26638 - protein, 28 aa, Artificial Sequence
  Description of Artificial Sequence: Synthetic peptide
QEEEIATTNPVATEQYGDVSTCLQRENR

SEQ ID NO: 26639 - protein, 29 aa, Artificial Sequence
  Description of Artificial Sequence: Synthetic peptide
DEEEIRATNPVATECYGSVSTNLQDHGDR

SEQ ID NO: 26640 - protein, 29 aa, Artificial Sequence
  Description of Artificial Sequence: Synthetic peptide
DEHEIRTTNPVATEQYGDVSCENLQRGNS

SEQ ID NO: 26641 - protein, 28 aa, Artificial Sequence
  Description of Artificial Sequence: Synthetic peptide
GEEEIATTNPCASEQYGSVSENLQRGNR

SEQ ID NO: 26642 - protein, 28 aa, Artificial Sequence
  Description of Artificial Sequence: Synthetic peptide
DEEEIRTTNPVATEGYGDVSTMLQRGAL

SEQ ID NO: 26643 - protein, 30 aa, Artificial Sequence
  Description of Artificial Sequence: Synthetic polypeptide
DEEEIRTTNPVATEQYGSVSTNEQEIGNTN

SEQ ID NO: 26644 - protein, 28 aa, Artificial Sequence
  Description of Artificial Sequence: Synthetic peptide
DEEEIRTTNPVATEQYGSVYDNLQIDNY

SEQ ID NO: 26645 - protein, 31 aa, Artificial Sequence
  Description of Artificial Sequence: Synthetic polypeptide
DEEEIATTNPVATECYGSVSTNLQERNGNDR

SEQ ID NO: 26646 - protein, 28 aa, Artificial Sequence
  Description of Artificial Sequence: Synthetic peptide
DEEEIRTTNPVATEIYGSVSTELQHGEM

SEQ ID NO: 26647 - protein, 30 aa, Artificial Sequence
  Description of Artificial Sequence: Synthetic polypeptide
DEAEIATTNPVATEQYGYVSTNGLQDRGNR

SEQ ID NO: 26648 - protein, 30 aa, Artificial Sequence
  Description of Artificial Sequence: Synthetic polypeptide
DEEEIRTTNPVATECYGSVSTNLQIQKGNW

SEQ ID NO: 26649 - protein, 28 aa, Artificial Sequence
  Description of Artificial Sequence: Synthetic peptide
DEEEIRCTNPVATEQYGWVSTDLQHGNT

SEQ ID NO: 26650 - protein, 28 aa, Artificial Sequence
  Description of Artificial Sequence: Synthetic peptide
KEEEIRTTNPVATECYGSVFTNLQREER

SEQ ID NO: 26651 - protein, 30 aa, Artificial Sequence
  Description of Artificial Sequence: Synthetic polypeptide
DEEEIRTTNPVATEQYGSVSPTNLVDAENR

SEQ ID NO: 26652 - protein, 28 aa, Artificial Sequence
  Description of Artificial Sequence: Synthetic peptide
DEQEIRTTNPVATEQYGSVSTNEMIGNM

SEQ ID NO: 26653 - protein, 28 aa, Artificial Sequence
  Description of Artificial Sequence: Synthetic peptide
DEIEIRTTNPIATEQYGSVSTNPQLGNF

SEQ ID NO: 26654 - protein, 28 aa, Artificial Sequence
  Description of Artificial Sequence: Synthetic peptide
DEHEIRTTNPVATEQYGSVSEELQAGNS

SEQ ID NO: 26655 - protein, 28 aa, Artificial Sequence
  Description of Artificial Sequence: Synthetic peptide
DEQEIVATNPVATEHYGWVSTNLQRGNR

SEQ ID NO: 26656 - protein, 31 aa, Artificial Sequence
  Description of Artificial Sequence: Synthetic polypeptide
DEEEIRTTNPVATEQYGSVSLTDGLQLRGNF

SEQ ID NO: 26657 - protein, 28 aa, Artificial Sequence
  Description of Artificial Sequence: Synthetic peptide
DETEIVCTNPVATEIYGVVSTNLQRGNR

SEQ ID NO: 26658 - protein, 28 aa, Artificial Sequence
  Description of Artificial Sequence: Synthetic peptide
MENELRTTNPVATEQYGSVSTNLQLGNL

SEQ ID NO: 26659 - protein, 31 aa, Artificial Sequence
  Description of Artificial Sequence: Synthetic polypeptide
DEEEIRTTNPVAYEDYGQSVSTNLQPRGNFR

SEQ ID NO: 26660 - protein, 30 aa, Artificial Sequence
  Description of Artificial Sequence: Synthetic polypeptide
DEEEIRCTNPVATEQYGVVCSTNLQPKGNR

SEQ ID NO: 26661 - protein, 31 aa, Artificial Sequence
  Description of Artificial Sequence: Synthetic polypeptide
DEEEIRTTNPVATEQYGYSVSNTNLQDGGNT

SEQ ID NO: 26662 - protein, 31 aa, Artificial Sequence
  Description of Artificial Sequence: Synthetic polypeptide
DEEEIRTTNPVATEQYGSVSTNLVDNGINDR

SEQ ID NO: 26663 - protein, 28 aa, Artificial Sequence
  Description of Artificial Sequence: Synthetic peptide
DEEEIATTNPTATEQYGSVSTNPQNGNI

SEQ ID NO: 26664 - protein, 28 aa, Artificial Sequence
  Description of Artificial Sequence: Synthetic peptide
DEEEIRTTNPVATENYGSVSTDDTSGNR

SEQ ID NO: 26665 - protein, 30 aa, Artificial Sequence
  Description of Artificial Sequence: Synthetic polypeptide
DEEEIRTTNPVATEQYGSVSEELQIRSGND

SEQ ID NO: 26666 - protein, 29 aa, Artificial Sequence
  Description of Artificial Sequence: Synthetic peptide
DEEEIRTTNPVATEQYGSVSTNPQFADER

SEQ ID NO: 26667 - protein, 28 aa, Artificial Sequence
  Description of Artificial Sequence: Synthetic peptide
NEEEITATNPVSTEQYGSVATNLQRGNR

SEQ ID NO: 26668 - protein, 28 aa, Artificial Sequence
  Description of Artificial Sequence: Synthetic peptide
DEQEIRTTNPVATEQYGSVDTQLQAGND

SEQ ID NO: 26669 - protein, 31 aa, Artificial Sequence
  Description of Artificial Sequence: Synthetic polypeptide
DEEEIRTTNPVATEQYGSHVSTNLMNRGLNA

SEQ ID NO: 26670 - protein, 29 aa, Artificial Sequence
  Description of Artificial Sequence: Synthetic peptide
DEEEIRTTNPVATEQYGSVAENIQLGNDR

SEQ ID NO: 26671 - protein, 30 aa, Artificial Sequence
  Description of Artificial Sequence: Synthetic polypeptide
DEEEIRTTNPVATEQYGSVSQTGDIRGDNR

SEQ ID NO: 26672 - protein, 29 aa, Artificial Sequence
  Description of Artificial Sequence: Synthetic peptide
DEECIRTTNPVATEQYGSYVSENDFRGNR

SEQ ID NO: 26673 - protein, 29 aa, Artificial Sequence
  Description of Artificial Sequence: Synthetic peptide
DEQEIRTTNPVATEQYGVVSTNLQDHGNA

SEQ ID NO: 26674 - protein, 28 aa, Artificial Sequence
  Description of Artificial Sequence: Synthetic peptide
DEEEIASTNPVATEQYGSVSTNLNIGNG

SEQ ID NO: 26675 - protein, 28 aa, Artificial Sequence
  Description of Artificial Sequence: Synthetic peptide
DEQEIRTTNPVATEQYGSVETPDQRGER

SEQ ID NO: 26676 - protein, 29 aa, Artificial Sequence
  Description of Artificial Sequence: Synthetic peptide
DEQEIRTTNPVATEIYGCVSTNLERNGNR

SEQ ID NO: 26677 - protein, 29 aa, Artificial Sequence
  Description of Artificial Sequence: Synthetic peptide
DEEEIRTTNPVATEQYGCVSMNLQRLTER

SEQ ID NO: 26678 - protein, 28 aa, Artificial Sequence
  Description of Artificial Sequence: Synthetic peptide
MEEEIRATNPVATEQYGTVSTNLQQGNS

SEQ ID NO: 26679 - protein, 28 aa, Artificial Sequence
  Description of Artificial Sequence: Synthetic peptide
DEVEIRTTNPVATEVYGSVSTALQTGNG

SEQ ID NO: 26680 - protein, 28 aa, Artificial Sequence
  Description of Artificial Sequence: Synthetic peptide
AESEIRTTNPVATEQYGSVTTNLQRQQR

SEQ ID NO: 26681 - protein, 28 aa, Artificial Sequence
  Description of Artificial Sequence: Synthetic peptide
DENEIRTTNPVATEQYGSVSTEDERGNT

SEQ ID NO: 26682 - protein, 28 aa, Artificial Sequence
  Description of Artificial Sequence: Synthetic peptide
QEEEIATTNPVATEQYGSASTNLQHGNN

SEQ ID NO: 26683 - protein, 28 aa, Artificial Sequence
  Description of Artificial Sequence: Synthetic peptide
DEQEIRTTNPVATEQWGSVSENEQRGNF

SEQ ID NO: 26684 - protein, 29 aa, Artificial Sequence
  Description of Artificial Sequence: Synthetic peptide
QEEEIRTTNPVATEQWGSVSTNLDRGVND

SEQ ID NO: 26685 - protein, 28 aa, Artificial Sequence
  Description of Artificial Sequence: Synthetic peptide
DEEEIRTTNPVATEQYGDVSEDLQNGNV

SEQ ID NO: 26686 - protein, 29 aa, Artificial Sequence
  Description of Artificial Sequence: Synthetic peptide
DEEEIRTTNPCATEQYGSVSMNWQRGNDI

SEQ ID NO: 26687 - protein, 28 aa, Artificial Sequence
  Description of Artificial Sequence: Synthetic peptide
DEEEIRTTNPVATEMYGVVSTNWQFGNF

SEQ ID NO: 26688 - protein, 28 aa, Artificial Sequence
  Description of Artificial Sequence: Synthetic peptide
DEEEIRTTNPVATEQFGSVSDNLQIFNQ

SEQ ID NO: 26689 - protein, 28 aa, Artificial Sequence
  Description of Artificial Sequence: Synthetic peptide
DEVEIRTTNPVCTEHYGEVSTNLQRGNI

SEQ ID NO: 26690 - protein, 30 aa, Artificial Sequence
  Description of Artificial Sequence: Synthetic polypeptide
DEEEIRTTNPVATEQYGSVSTDLQEVEGER

SEQ ID NO: 26691 - protein, 28 aa, Artificial Sequence
  Description of Artificial Sequence: Synthetic peptide
DEEEIRTTNPVATCQYGTVSDALQRGNL

SEQ ID NO: 26692 - protein, 28 aa, Artificial Sequence
  Description of Artificial Sequence: Synthetic peptide
DEEEIRTTNPVATEQWGSVSTNEMIGDR

SEQ ID NO: 26693 - protein, 30 aa, Artificial Sequence
  Description of Artificial Sequence: Synthetic polypeptide
DEEEIRTTNPVATEQYGNVSNELVQRGANR

SEQ ID NO: 26694 - protein, 30 aa, Artificial Sequence
  Description of Artificial Sequence: Synthetic polypeptide
DEEEIRTTNPVATEIYGSVSTMNEQVGPNR

SEQ ID NO: 26695 - protein, 30 aa, Artificial Sequence
  Description of Artificial Sequence: Synthetic polypeptide
DEEEIRTTNPVATEQYGWVSSENLQLGNNR

SEQ ID NO: 26696 - protein, 28 aa, Artificial Sequence
  Description of Artificial Sequence: Synthetic peptide
DENEIRTTNPVSTEQYGSVSENLQIGNA

SEQ ID NO: 26697 - protein, 28 aa, Artificial Sequence
  Description of Artificial Sequence: Synthetic peptide
DENEIRTTNPVATEQWGSVSENLMRGNF

SEQ ID NO: 26698 - protein, 29 aa, Artificial Sequence
  Description of Artificial Sequence: Synthetic peptide
DEEEIRTTNPVATEQYGLVSTNLQSQGQA

SEQ ID NO: 26699 - protein, 28 aa, Artificial Sequence
  Description of Artificial Sequence: Synthetic peptide
DEEEIRTTNPAATEQYGSVSENEQHGNQ

SEQ ID NO: 26700 - protein, 32 aa, Artificial Sequence
  Description of Artificial Sequence: Synthetic polypeptide
DEEEIRTTNPVATEQYGESVSTINLQRGINPV

SEQ ID NO: 26701 - protein, 28 aa, Artificial Sequence
  Description of Artificial Sequence: Synthetic peptide
DEQEIRCTNPVATEIYGSVATNLERGNR

SEQ ID NO: 26702 - protein, 29 aa, Artificial Sequence
  Description of Artificial Sequence: Synthetic peptide
DENEIRTTNPVATEQYGSVSTNEQMQGNM

SEQ ID NO: 26703 - protein, 29 aa, Artificial Sequence
  Description of Artificial Sequence: Synthetic peptide
NEEEIWTTNPVATEQYGSVSTNNIQVGNR

SEQ ID NO: 26704 - protein, 29 aa, Artificial Sequence
  Description of Artificial Sequence: Synthetic peptide
DEEEIRTTNPVATELYGSVSTNEQNIGNA

SEQ ID NO: 26705 - protein, 30 aa, Artificial Sequence
  Description of Artificial Sequence: Synthetic polypeptide
DEEEIRTTNPVATEQYGSVSCTMELQYGNA

SEQ ID NO: 26706 - protein, 29 aa, Artificial Sequence
  Description of Artificial Sequence: Synthetic peptide
DEGEIRTTNPVATEQYGCVSTNLQQGLNN

SEQ ID NO: 26707 - protein, 28 aa, Artificial Sequence
  Description of Artificial Sequence: Synthetic peptide
SEEEIATTNPVATEQYGEVSTNLQLGDR

SEQ ID NO: 26708 - protein, 31 aa, Artificial Sequence
  Description of Artificial Sequence: Synthetic polypeptide
DEQEIRTTNPVATEQYGSVSETNPLQQGNDR

SEQ ID NO: 26709 - protein, 28 aa, Artificial Sequence
  Description of Artificial Sequence: Synthetic peptide
DEEEIRCTNPVACEWYGHVSTNLDRGNR

SEQ ID NO: 26710 - protein, 28 aa, Artificial Sequence
  Description of Artificial Sequence: Synthetic peptide
MEEEIRTTNPVATECYGAVSTNLQHGNE

SEQ ID NO: 26711 - protein, 28 aa, Artificial Sequence
  Description of Artificial Sequence: Synthetic peptide
DEQEIATTNPVATEQYGSVSTNLQHGEL

SEQ ID NO: 26712 - protein, 29 aa, Artificial Sequence
  Description of Artificial Sequence: Synthetic peptide
DEEEIRTTNPVATELWGYVSTNLPQNGNR

SEQ ID NO: 26713 - protein, 28 aa, Artificial Sequence
  Description of Artificial Sequence: Synthetic peptide
DEEEIRTTNPVATEQYGDVSENLQNGEL

SEQ ID NO: 26714 - protein, 28 aa, Artificial Sequence
  Description of Artificial Sequence: Synthetic peptide
SEEEIRTVNPVATEVYGCVSTNLERGNR

SEQ ID NO: 26715 - protein, 28 aa, Artificial Sequence
  Description of Artificial Sequence: Synthetic peptide
DEEEIRSTNPVSTEQYGSVSTELERGNF

SEQ ID NO: 26716 - protein, 28 aa, Artificial Sequence
  Description of Artificial Sequence: Synthetic peptide
DEGEIRTTNPVATEQYGSVSNNLNVGND

SEQ ID NO: 26717 - protein, 28 aa, Artificial Sequence
  Description of Artificial Sequence: Synthetic peptide
DEQEIRTTNPVATECYGSVSTDLQHGNL

SEQ ID NO: 26718 - protein, 31 aa, Artificial Sequence
  Description of Artificial Sequence: Synthetic polypeptide
DEEEIRTTNPVATEQYGSVQLANSLQRGINR

SEQ ID NO: 26719 - protein, 31 aa, Artificial Sequence
  Description of Artificial Sequence: Synthetic polypeptide
DEEEIRTTNPVATEQYGSVSETNLQDDGENS

SEQ ID NO: 26720 - protein, 31 aa, Artificial Sequence
  Description of Artificial Sequence: Synthetic polypeptide
DEEEIRTTNPVATEQYGSVSTMNLQENEGNG

SEQ ID NO: 26721 - protein, 28 aa, Artificial Sequence
  Description of Artificial Sequence: Synthetic peptide
DEQEIRCTNPVATEQYGSVSEQLQGGNR

SEQ ID NO: 26722 - protein, 28 aa, Artificial Sequence
  Description of Artificial Sequence: Synthetic peptide
SEEEIRATNPVATELYGSVSTNEQRGNF

SEQ ID NO: 26723 - protein, 28 aa, Artificial Sequence
  Description of Artificial Sequence: Synthetic peptide
DEEEIRTTNPVATLQYGSVSTGLDPGLR

SEQ ID NO: 26724 - protein, 28 aa, Artificial Sequence
  Description of Artificial Sequence: Synthetic peptide
SEEEIRTTNPVATEQFGSVSTNLQNGDI

SEQ ID NO: 26725 - protein, 30 aa, Artificial Sequence
  Description of Artificial Sequence: Synthetic polypeptide
DEEEIRTTNPVATEQYGSVSTDPDQRDGER

SEQ ID NO: 26726 - protein, 28 aa, Artificial Sequence
  Description of Artificial Sequence: Synthetic peptide
MEEEIRTTNPVATEQYGSVSTDLQNGTL

SEQ ID NO: 26727 - protein, 30 aa, Artificial Sequence
  Description of Artificial Sequence: Synthetic polypeptide
DEEEIVTTNPVATEQYGSVSTNGQDQGVNR

SEQ ID NO: 26728 - protein, 32 aa, Artificial Sequence
  Description of Artificial Sequence: Synthetic polypeptide
DEEEIRTTNPVATEQYGSVTSDTNLVQRGDNQ

SEQ ID NO: 26729 - protein, 28 aa, Artificial Sequence
  Description of Artificial Sequence: Synthetic peptide
DEEEIRTTNPVASEQYGTVATNLQMGER

SEQ ID NO: 26730 - protein, 28 aa, Artificial Sequence
  Description of Artificial Sequence: Synthetic peptide
DDNEIRTTNPVATEQYGSVSTNLQHGEM

SEQ ID NO: 26731 - protein, 28 aa, Artificial Sequence
  Description of Artificial Sequence: Synthetic peptide
DEEEIRTTNPVATEMYGSVNENLQQGDR

SEQ ID NO: 26732 - protein, 28 aa, Artificial Sequence
  Description of Artificial Sequence: Synthetic peptide
MENEIRTTNPVATEQYGSVSTDLQNGNM

SEQ ID NO: 26733 - protein, 29 aa, Artificial Sequence
  Description of Artificial Sequence: Synthetic peptide
DEEEIRTTNPVATECYGVVSTNLQQGNDN

SEQ ID NO: 26734 - protein, 29 aa, Artificial Sequence
  Description of Artificial Sequence: Synthetic peptide
SENEIRCTNPVATEQYGSVSTNLQRAGNF

SEQ ID NO: 26735 - protein, 28 aa, Artificial Sequence
  Description of Artificial Sequence: Synthetic peptide
SEEEIRTTNPVATEQWGSVSTNEQQGTR

SEQ ID NO: 26736 - protein, 28 aa, Artificial Sequence
  Description of Artificial Sequence: Synthetic peptide
MEQEIRTTNPVATEQYGTVSTNLQAGNQ

SEQ ID NO: 26737 - protein, 31 aa, Artificial Sequence
  Description of Artificial Sequence: Synthetic polypeptide
DEEEIRTTNPVATEQYGSVSDNLQVRGIEER

SEQ ID NO: 26738 - protein, 30 aa, Artificial Sequence
  Description of Artificial Sequence: Synthetic polypeptide
DEEEIRTTNPVATEQYGSVSEILQNRAGNA

SEQ ID NO: 26739 - protein, 28 aa, Artificial Sequence
  Description of Artificial Sequence: Synthetic peptide
DEEEIRTTNPVATECYGSVSENLMIGNW

SEQ ID NO: 26740 - protein, 30 aa, Artificial Sequence
  Description of Artificial Sequence: Synthetic polypeptide
DEEEIRTTNPVATEQYGSVSTNPLDERGES

SEQ ID NO: 26741 - protein, 30 aa, Artificial Sequence
  Description of Artificial Sequence: Synthetic polypeptide
DEEEIRTTNPVATEQYGDVISTNLQSGPNF

SEQ ID NO: 26742 - protein, 28 aa, Artificial Sequence
  Description of Artificial Sequence: Synthetic peptide
DEEEIATTNPVATECYGSVSTELQRGEQ

SEQ ID NO: 26743 - protein, 31 aa, Artificial Sequence
  Description of Artificial Sequence: Synthetic polypeptide
DEEEIRTTNPDATECYGSVSTNLQDREGENR

SEQ ID NO: 26744 - protein, 28 aa, Artificial Sequence
  Description of Artificial Sequence: Synthetic peptide
DEEEIRTTNPVATELYGVVSTEWQRGNT

SEQ ID NO: 26745 - protein, 28 aa, Artificial Sequence
  Description of Artificial Sequence: Synthetic peptide
GEEEIRTTNPVATEPYGSVGMNLQRLNR

SEQ ID NO: 26746 - protein, 28 aa, Artificial Sequence
  Description of Artificial Sequence: Synthetic peptide
DEGEIRTTNPVATEQYGWVGTNLQHGNA

SEQ ID NO: 26747 - protein, 28 aa, Artificial Sequence
  Description of Artificial Sequence: Synthetic peptide
DEEEIKTTNPVATEQYGVVPEDLQRGNR

SEQ ID NO: 26748 - protein, 28 aa, Artificial Sequence
  Description of Artificial Sequence: Synthetic peptide
CEEEIRATNPVATEQYGSVSTNPLQGMR

SEQ ID NO: 26749 - protein, 28 aa, Artificial Sequence
  Description of Artificial Sequence: Synthetic peptide
DAEEIRPTNPVAGEQYGSVSENLQDGNR

SEQ ID NO: 26750 - protein, 31 aa, Artificial Sequence
  Description of Artificial Sequence: Synthetic polypeptide
DEEEIRTTNPVATEQYGSVSTEGLDRKGVNR

SEQ ID NO: 26751 - protein, 28 aa, Artificial Sequence
  Description of Artificial Sequence: Synthetic peptide
DDSEIRTTNPVATEQYGSVATNLQGGNA

SEQ ID NO: 26752 - protein, 29 aa, Artificial Sequence
  Description of Artificial Sequence: Synthetic peptide
DEEEIRTTNPVATEQWGSVSENLMMRGNA

SEQ ID NO: 26753 - protein, 28 aa, Artificial Sequence
  Description of Artificial Sequence: Synthetic peptide
SEEEIRTTNPTATEQYGSVSTNPQNGTR

SEQ ID NO: 26754 - protein, 29 aa, Artificial Sequence
  Description of Artificial Sequence: Synthetic peptide
DEEEIRTTNPTATEQFGSVSTGNWQRGTR

SEQ ID NO: 26755 - protein, 28 aa, Artificial Sequence
  Description of Artificial Sequence: Synthetic peptide
DENEIRTTNPVATECYGSVSTNLQHGEL

SEQ ID NO: 26756 - protein, 30 aa, Artificial Sequence
  Description of Artificial Sequence: Synthetic polypeptide
DEEEIRTTNPVATEQYGSVSTPLQEKGNDY

SEQ ID NO: 26757 - protein, 28 aa, Artificial Sequence
  Description of Artificial Sequence: Synthetic peptide
DETELATTNPVATENYGSVSTILQRGNR

SEQ ID NO: 26758 - protein, 28 aa, Artificial Sequence
  Description of Artificial Sequence: Synthetic peptide
SEEEIATTNPVATEQFGGVSENLQRGNR

SEQ ID NO: 26759 - protein, 28 aa, Artificial Sequence
  Description of Artificial Sequence: Synthetic peptide
DEEEIRTTNPDATEQYGSVSTPLLDGNN

SEQ ID NO: 26760 - protein, 30 aa, Artificial Sequence
  Description of Artificial Sequence: Synthetic polypeptide
DEEEIRPTNPVATEQYGVVSTPNPLQRGER

SEQ ID NO: 26761 - protein, 29 aa, Artificial Sequence
  Description of Artificial Sequence: Synthetic peptide
DEEEIRTTNPVATEQYGSVSTELQEQGDV

SEQ ID NO: 26762 - protein, 29 aa, Artificial Sequence
  Description of Artificial Sequence: Synthetic peptide
DEEEIRTTNPVCCEQYGSVPTELQRNGNR

SEQ ID NO: 26763 - protein, 31 aa, Artificial Sequence
  Description of Artificial Sequence: Synthetic polypeptide
DEVEIRTTNPVATEQYGSVSITNLQDHGNPR

SEQ ID NO: 26764 - protein, 28 aa, Artificial Sequence
  Description of Artificial Sequence: Synthetic peptide
DENEIKTTNPVATEQYGSVSTNEQLGTR

SEQ ID NO: 26765 - protein, 28 aa, Artificial Sequence
  Description of Artificial Sequence: Synthetic peptide
DEEEICTTNPVATEQYGSAPTVLQGGNR

SEQ ID NO: 26766 - protein, 30 aa, Artificial Sequence
  Description of Artificial Sequence: Synthetic polypeptide
SEEEIRTTNPVATEQYGSVSTNEQDRGDTR

SEQ ID NO: 26767 - protein, 28 aa, Artificial Sequence
  Description of Artificial Sequence: Synthetic peptide
DEEEIRTTNPTATEQYGSVSTDEQVGNY

SEQ ID NO: 26768 - protein, 30 aa, Artificial Sequence
  Description of Artificial Sequence: Synthetic polypeptide
DEQEIRTTNPVATEQYGSASCTNEQQRGNR

SEQ ID NO: 26769 - protein, 31 aa, Artificial Sequence
  Description of Artificial Sequence: Synthetic polypeptide
DENEIRTTNPVATEQYGVVSTENLVQVRGNR

SEQ ID NO: 26770 - protein, 28 aa, Artificial Sequence
  Description of Artificial Sequence: Synthetic peptide
DEEEVRTTNPIATEPYGSVATNLERGNR

SEQ ID NO: 26771 - protein, 28 aa, Artificial Sequence
  Description of Artificial Sequence: Synthetic peptide
DEEEIYTTNPVATEQYGSVSSNLQNGDS

SEQ ID NO: 26772 - protein, 31 aa, Artificial Sequence
  Description of Artificial Sequence: Synthetic polypeptide
DEEEIRTTNPVATEQYGSVSTDLQDRKGEDR

SEQ ID NO: 26773 - protein, 30 aa, Artificial Sequence
  Description of Artificial Sequence: Synthetic polypeptide
DEEEIRTTNPVATEQYGVVDTNQQERNGNR

SEQ ID NO: 26774 - protein, 30 aa, Artificial Sequence
  Description of Artificial Sequence: Synthetic polypeptide
DEEEIRTTNPVATEQYGVVSDMNDQRGNDR

SEQ ID NO: 26775 - protein, 28 aa, Artificial Sequence
  Description of Artificial Sequence: Synthetic peptide
DENEIVTTNPVATECYGSVSTNLQLGNL

SEQ ID NO: 26776 - protein, 28 aa, Artificial Sequence
  Description of Artificial Sequence: Synthetic peptide
DEEEIRTTNPVATEQYGSVSTDLEYGEI

SEQ ID NO: 26777 - protein, 30 aa, Artificial Sequence
  Description of Artificial Sequence: Synthetic polypeptide
DEEEIRTTNPTATELYGSVSAENLQREGNR

SEQ ID NO: 26778 - protein, 32 aa, Artificial Sequence
  Description of Artificial Sequence: Synthetic polypeptide
DEEEIATTNPVATEQYGSVDSTTNGLQRGENR

SEQ ID NO: 26779 - protein, 28 aa, Artificial Sequence
  Description of Artificial Sequence: Synthetic peptide
DEDEIRTTNPVATELYGSVSDNLQGGNV

SEQ ID NO: 26780 - protein, 28 aa, Artificial Sequence
  Description of Artificial Sequence: Synthetic peptide
DEGEIRTTNPVATEQYGEVSENLQRGDG

SEQ ID NO: 26781 - protein, 28 aa, Artificial Sequence
  Description of Artificial Sequence: Synthetic peptide
DENEITTTNPVATEQYGSVSTLIQRGNS

SEQ ID NO: 26782 - protein, 28 aa, Artificial Sequence
  Description of Artificial Sequence: Synthetic peptide
DEECIRCTNPVATEQYGSVSWNFQRGNL

SEQ ID NO: 26783 - protein, 30 aa, Artificial Sequence
  Description of Artificial Sequence: Synthetic polypeptide
DEEEIRTTNPVATEQYGSVSATTNLEVGNM

SEQ ID NO: 26784 - protein, 28 aa, Artificial Sequence
  Description of Artificial Sequence: Synthetic peptide
DETEIRTTNPVATEQYGVVSTNWQHGND

SEQ ID NO: 26785 - protein, 30 aa, Artificial Sequence
  Description of Artificial Sequence: Synthetic polypeptide
DENEIRTTNPVATECYGSVSATNLQDRGER

SEQ ID NO: 26786 - protein, 30 aa, Artificial Sequence
  Description of Artificial Sequence: Synthetic polypeptide
DEEEIRTTNPVATEQYGSVSTDLQEYGNDD

SEQ ID NO: 26787 - protein, 30 aa, Artificial Sequence
  Description of Artificial Sequence: Synthetic polypeptide
DEEEIRTTNPVATEQYGSVSTNDVERKGER

SEQ ID NO: 26788 - protein, 29 aa, Artificial Sequence
  Description of Artificial Sequence: Synthetic peptide
SEEEIRTTNPTATEQYGSVSEMNLQQGNR

SEQ ID NO: 26789 - protein, 28 aa, Artificial Sequence
  Description of Artificial Sequence: Synthetic peptide
DEEEIRTTNPTATEQYGSVSTNWQFGTI

SEQ ID NO: 26790 - protein, 29 aa, Artificial Sequence
  Description of Artificial Sequence: Synthetic peptide
DEEEITTTNPVATEQYGSVSTELEPGNAR

SEQ ID NO: 26791 - protein, 29 aa, Artificial Sequence
  Description of Artificial Sequence: Synthetic peptide
DEEEIRTTNPCATEQYGSASTALERGNDR

SEQ ID NO: 26792 - protein, 30 aa, Artificial Sequence
  Description of Artificial Sequence: Synthetic polypeptide
DEEEIRTTNPVATEQYGSVSENLQERGDDW

SEQ ID NO: 26793 - protein, 28 aa, Artificial Sequence
  Description of Artificial Sequence: Synthetic peptide
DEQEIATTNPVATEIYGWVSTNLQRGNQ

SEQ ID NO: 26794 - protein, 30 aa, Artificial Sequence
  Description of Artificial Sequence: Synthetic polypeptide
DEQEIRTTNPVATEQYGSVSETELQERGER

SEQ ID NO: 26795 - protein, 28 aa, Artificial Sequence
  Description of Artificial Sequence: Synthetic peptide
DEEEIRTTNPVASEIYGAVSTNLERGLR

SEQ ID NO: 26796 - protein, 30 aa, Artificial Sequence
  Description of Artificial Sequence: Synthetic polypeptide
DEEEIVTTNPVATEQYGSVSTNLVQHGVNI

SEQ ID NO: 26797 - protein, 29 aa, Artificial Sequence
  Description of Artificial Sequence: Synthetic peptide
DEEEIRQTNPVATEQYGSVPENLVQRENR

SEQ ID NO: 26798 - protein, 28 aa, Artificial Sequence
  Description of Artificial Sequence: Synthetic peptide
DEEEIRTTNPVATEQYGSVSTDDEYGNF

SEQ ID NO: 26799 - protein, 29 aa, Artificial Sequence
  Description of Artificial Sequence: Synthetic peptide
DEEEIRTTNPVATEQYGSVDTMDLQYGNQ

SEQ ID NO: 26800 - protein, 29 aa, Artificial Sequence
  Description of Artificial Sequence: Synthetic peptide
DENEIRTTNPVATEQYGSVSENLQIEGNE

SEQ ID NO: 26801 - protein, 28 aa, Artificial Sequence
  Description of Artificial Sequence: Synthetic peptide
DEEEIRTTNPVATEQYGSVSSNDEYGNV

SEQ ID NO: 26802 - protein, 28 aa, Artificial Sequence
  Description of Artificial Sequence: Synthetic peptide
VEEEIRTTNPVATEQYGEVSTHLQRDNN

SEQ ID NO: 26803 - protein, 30 aa, Artificial Sequence
  Description of Artificial Sequence: Synthetic polypeptide
DEEEIRTTNPVATEQYGEVCSTNLQRLNDD

SEQ ID NO: 26804 - protein, 28 aa, Artificial Sequence
  Description of Artificial Sequence: Synthetic peptide
DEVEIYTTNPVATEQYGSVSENSQRGNM

SEQ ID NO: 26805 - protein, 28 aa, Artificial Sequence
  Description of Artificial Sequence: Synthetic peptide
DEEEIRTTNPVATELWGSVSTNLMVGDR

SEQ ID NO: 26806 - protein, 28 aa, Artificial Sequence
  Description of Artificial Sequence: Synthetic peptide
AEQEIVTTNPVATEQYGWVSDNLQRGNR

SEQ ID NO: 26807 - protein, 31 aa, Artificial Sequence
  Description of Artificial Sequence: Synthetic polypeptide
DEEEIRTTNPVATEQYGSVETNPLQRGDEPR

SEQ ID NO: 26808 - protein, 29 aa, Artificial Sequence
  Description of Artificial Sequence: Synthetic peptide
DEEEIRATNPVATEQYGSVSIQNLEMGNR

SEQ ID NO: 26809 - protein, 28 aa, Artificial Sequence
  Description of Artificial Sequence: Synthetic peptide
DEEEIRTTNPVATEQYGSASTNLQNEEM

SEQ ID NO: 26810 - protein, 29 aa, Artificial Sequence
  Description of Artificial Sequence: Synthetic peptide
DEEEIRATNPVATELYGAVSMNLQRNGNR

SEQ ID NO: 26811 - protein, 28 aa, Artificial Sequence
  Description of Artificial Sequence: Synthetic peptide
DEEEIRTTNPVACEQYGSVRTDLQDGER

SEQ ID NO: 26812 - protein, 31 aa, Artificial Sequence
  Description of Artificial Sequence: Synthetic polypeptide
DEEEIRQTNPVATEQYGSVSTNLQDNEGNDR

SEQ ID NO: 26813 - protein, 28 aa, Artificial Sequence
  Description of Artificial Sequence: Synthetic peptide
DEEEIRTTNPVATEFYGSVSTDIQHGNQ

SEQ ID NO: 26814 - protein, 28 aa, Artificial Sequence
  Description of Artificial Sequence: Synthetic peptide
REQEIRTTNPVATEPYGVVSENLQRGNR

SEQ ID NO: 26815 - protein, 28 aa, Artificial Sequence
  Description of Artificial Sequence: Synthetic peptide
DDEEIRATNPVATEQYGVVSTNDQLGNR

SEQ ID NO: 26816 - protein, 28 aa, Artificial Sequence
  Description of Artificial Sequence: Synthetic peptide
DEEEIRTTNPVATEQYGSVSTEEEIGNY

SEQ ID NO: 26817 - protein, 28 aa, Artificial Sequence
  Description of Artificial Sequence: Synthetic peptide
DEEEIRATNPVATEQYGVVSTALERGNW

SEQ ID NO: 26818 - protein, 28 aa, Artificial Sequence
  Description of Artificial Sequence: Synthetic peptide
DEEEIATTNPTATEQYGSVSTNPQHGNL

SEQ ID NO: 26819 - protein, 29 aa, Artificial Sequence
  Description of Artificial Sequence: Synthetic peptide
DETEIRTTNPVATEQYGSVSTPPQARGNS

SEQ ID NO: 26820 - protein, 31 aa, Artificial Sequence
  Description of Artificial Sequence: Synthetic polypeptide
DEEEIRTTNPVATEMYGSVSTNLQELEGNDR

SEQ ID NO: 26821 - protein, 28 aa, Artificial Sequence
  Description of Artificial Sequence: Synthetic peptide
DEEEIRTTNPVATEQYGSYSTILMQGDR

SEQ ID NO: 26822 - protein, 31 aa, Artificial Sequence
  Description of Artificial Sequence: Synthetic polypeptide
DEEEIRTTNPVATEQYGSVSVENELQRGINH

SEQ ID NO: 26823 - protein, 28 aa, Artificial Sequence
  Description of Artificial Sequence: Synthetic peptide
DEEEIRTTNPVATEQYGFVSTNLMRLTQ

SEQ ID NO: 26824 - protein, 28 aa, Artificial Sequence
  Description of Artificial Sequence: Synthetic peptide
MEQEIRTTNPVATECYGSVSTNLQNGNM

SEQ ID NO: 26825 - protein, 28 aa, Artificial Sequence
  Description of Artificial Sequence: Synthetic peptide
DEEEIRTTNPVATECYGSVSTDLQVGEW

SEQ ID NO: 26826 - protein, 32 aa, Artificial Sequence
  Description of Artificial Sequence: Synthetic polypeptide
DEEEIRTTNPVATEQYGSVDSTENDQEREGNR

SEQ ID NO: 26827 - protein, 28 aa, Artificial Sequence
  Description of Artificial Sequence: Synthetic peptide
REEEIRTTNPVATEQYGSVATNLEMGNH

SEQ ID NO: 26828 - protein, 30 aa, Artificial Sequence
  Description of Artificial Sequence: Synthetic polypeptide
QEEEIRTTNPVATEQYGSVSTELQVVEGNR

SEQ ID NO: 26829 - protein, 31 aa, Artificial Sequence
  Description of Artificial Sequence: Synthetic polypeptide
DEEEIRTTNPVATEQYGSVSEDTNLYRGNPI

SEQ ID NO: 26830 - protein, 28 aa, Artificial Sequence
  Description of Artificial Sequence: Synthetic peptide
DECEIEPTNPVATEQYGSVSTNLQRGGG

SEQ ID NO: 26831 - protein, 29 aa, Artificial Sequence
  Description of Artificial Sequence: Synthetic peptide
DEEEIRTTNPVSTEQYGTVSTNLQQNGNH

SEQ ID NO: 26832 - protein, 28 aa, Artificial Sequence
  Description of Artificial Sequence: Synthetic peptide
DEQEITTTNPVATEQYGSVSTELQDGNE

SEQ ID NO: 26833 - protein, 29 aa, Artificial Sequence
  Description of Artificial Sequence: Synthetic peptide
SEEEIRTTNPVATEQYGSVSTNPQRGTDA

SEQ ID NO: 26834 - protein, 28 aa, Artificial Sequence
  Description of Artificial Sequence: Synthetic peptide
MEEEIRCTNPVACEQYGSVSTNLQNGNM

SEQ ID NO: 26835 - protein, 28 aa, Artificial Sequence
  Description of Artificial Sequence: Synthetic peptide
DEQEIAATNPVATENYGTVSTNLQRGNR

SEQ ID NO: 26836 - protein, 30 aa, Artificial Sequence
  Description of Artificial Sequence: Synthetic polypeptide
DEEEIATTNPVATEQYGDVSTNLQCHEGNR

SEQ ID NO: 26837 - protein, 31 aa, Artificial Sequence
  Description of Artificial Sequence: Synthetic polypeptide
DEEEIRTTNPVATEQYGSVSTGELQITDGNR

SEQ ID NO: 26838 - protein, 31 aa, Artificial Sequence
  Description of Artificial Sequence: Synthetic polypeptide
AEEEIRTTNPVATEQYGSVSATTNLQLRGND

SEQ ID NO: 26839 - protein, 28 aa, Artificial Sequence
  Description of Artificial Sequence: Synthetic peptide
DEEEIRCTNPTATEQYGCVSTDLQRGNT

SEQ ID NO: 26840 - protein, 28 aa, Artificial Sequence
  Description of Artificial Sequence: Synthetic peptide
DEEEIRTTNPVATEQYGSVDTPLDIGNT

SEQ ID NO: 26841 - protein, 28 aa, Artificial Sequence
  Description of Artificial Sequence: Synthetic peptide
DEEEIRTTNPVATEQYGFVSTGLQHGME

SEQ ID NO: 26842 - protein, 28 aa, Artificial Sequence
  Description of Artificial Sequence: Synthetic peptide
DEEEIRTTNPVCTEHFGSVSTNPQVGNR

SEQ ID NO: 26843 - protein, 31 aa, Artificial Sequence
  Description of Artificial Sequence: Synthetic polypeptide
DEAEIATTNPVATEQYGSVSETGNLQIRGNR

SEQ ID NO: 26844 - protein, 32 aa, Artificial Sequence
  Description of Artificial Sequence: Synthetic polypeptide
DEEEIRTTNPVATEQYGSVSETNLEEREGENR

SEQ ID NO: 26845 - protein, 28 aa, Artificial Sequence
  Description of Artificial Sequence: Synthetic peptide
DENEIRATNPVATEMYGSVSTNLQIGTR

SEQ ID NO: 26846 - protein, 28 aa, Artificial Sequence
  Description of Artificial Sequence: Synthetic peptide
DEEEIRTTNPVASEQYGAVANNLERGNR

SEQ ID NO: 26847 - protein, 30 aa, Artificial Sequence
  Description of Artificial Sequence: Synthetic polypeptide
DEEEIRTTNPVATEQWGSVSENLQQKGNDR

SEQ ID NO: 26848 - protein, 30 aa, Artificial Sequence
  Description of Artificial Sequence: Synthetic polypeptide
DEEEIATTNPVATEQYGGVSTNLQRGDTDR

SEQ ID NO: 26849 - protein, 28 aa, Artificial Sequence
  Description of Artificial Sequence: Synthetic peptide
DEQEIRTTNPVASEVYGTVSTNLQRGND

SEQ ID NO: 26850 - protein, 28 aa, Artificial Sequence
  Description of Artificial Sequence: Synthetic peptide
DEEEIRTTNPVATELYGSVSTDGQRGTF

SEQ ID NO: 26851 - protein, 30 aa, Artificial Sequence
  Description of Artificial Sequence: Synthetic polypeptide
DEQEIRTTNPVATEQYGSVSTANLQATGNW

SEQ ID NO: 26852 - protein, 28 aa, Artificial Sequence
  Description of Artificial Sequence: Synthetic peptide
DEEEIRTTNPVATEQWGSVSDNLMQGNS

SEQ ID NO: 26853 - protein, 28 aa, Artificial Sequence
  Description of Artificial Sequence: Synthetic peptide
AENEIRTTNPCATEQYGSVSDNLQVGNR

SEQ ID NO: 26854 - protein, 28 aa, Artificial Sequence
  Description of Artificial Sequence: Synthetic peptide
REEEISGTNPVATEQYGIVATNLQRGNR

SEQ ID NO: 26855 - protein, 28 aa, Artificial Sequence
  Description of Artificial Sequence: Synthetic peptide
VEEEIRTTNPVATEQYGWCSTNLQRGEA

SEQ ID NO: 26856 - protein, 30 aa, Artificial Sequence
  Description of Artificial Sequence: Synthetic polypeptide
DEEEIRTTNPVATEQYGSVDENGPLERGNR

SEQ ID NO: 26857 - protein, 28 aa, Artificial Sequence
  Description of Artificial Sequence: Synthetic peptide
DTEEIRTTNPVAMEQWGSVSTPDQRGNR

SEQ ID NO: 26858 - protein, 28 aa, Artificial Sequence
  Description of Artificial Sequence: Synthetic peptide
DEQEIAATNPVATEIYGVVSTNLQRGNR

SEQ ID NO: 26859 - protein, 28 aa, Artificial Sequence
  Description of Artificial Sequence: Synthetic peptide
DEEEIATTNPVATEQYGSVDTNWQTGNQ

SEQ ID NO: 26860 - protein, 28 aa, Artificial Sequence
  Description of Artificial Sequence: Synthetic peptide
DEEEIRTTNPVSTEQWGSVSENLMRGNM

SEQ ID NO: 26861 - protein, 28 aa, Artificial Sequence
  Description of Artificial Sequence: Synthetic peptide
DEEEIRTTNPVATEQWGSVSTNEMQGNW

SEQ ID NO: 26862 - protein, 28 aa, Artificial Sequence
  Description of Artificial Sequence: Synthetic peptide
HEEEIRTTNPVATEQYGCVSTNGQHGDR

SEQ ID NO: 26863 - protein, 30 aa, Artificial Sequence
  Description of Artificial Sequence: Synthetic polypeptide
DEEEIRTTNPCCTEQYGSVSTMNLQVGNDR

SEQ ID NO: 26864 - protein, 28 aa, Artificial Sequence
  Description of Artificial Sequence: Synthetic peptide
DEQEIRTTNPVATEQWGSVSTNEQQGNA

SEQ ID NO: 26865 - protein, 28 aa, Artificial Sequence
  Description of Artificial Sequence: Synthetic peptide
DENEIRTTNPVATECYGSVSTDLQYGNV

SEQ ID NO: 26866 - protein, 28 aa, Artificial Sequence
  Description of Artificial Sequence: Synthetic peptide
DENEIRTVNPVCTEQYGSVSTNLQGGNA

SEQ ID NO: 26867 - protein, 28 aa, Artificial Sequence
  Description of Artificial Sequence: Synthetic peptide
DEEEIRTTNPVATECYGDASTDLQHGNR

SEQ ID NO: 26868 - protein, 28 aa, Artificial Sequence
  Description of Artificial Sequence: Synthetic peptide
DEEEIIATNPVATECYGSVSTNLQSGNG

SEQ ID NO: 26869 - protein, 29 aa, Artificial Sequence
  Description of Artificial Sequence: Synthetic peptide
MEEEIRTTNPVATEQYGSVSTDLQNGNDM

SEQ ID NO: 26870 - protein, 31 aa, Artificial Sequence
  Description of Artificial Sequence: Synthetic polypeptide
DEEEIRTTNPVATEQYGDVSQTTLQRMGENR

SEQ ID NO: 26871 - protein, 30 aa, Artificial Sequence
  Description of Artificial Sequence: Synthetic polypeptide
DEEEIRTTNPVATEQYGSVSITPPEQRGNF

SEQ ID NO: 26872 - protein, 30 aa, Artificial Sequence
  Description of Artificial Sequence: Synthetic polypeptide
DEEEIRTTNPVATEQYGSVSTEPLQVDGNQ

SEQ ID NO: 26873 - protein, 28 aa, Artificial Sequence
  Description of Artificial Sequence: Synthetic peptide
DEEEIRTTNPVATELYGSVSMNWQSGNY

SEQ ID NO: 26874 - protein, 30 aa, Artificial Sequence
  Description of Artificial Sequence: Synthetic polypeptide
DEEEIATTNPVATEQYGSVSTMNEQNEGNR

SEQ ID NO: 26875 - protein, 30 aa, Artificial Sequence
  Description of Artificial Sequence: Synthetic polypeptide
DEEEIRTTNPVATEQYGDVSTMDLQQRGNV

SEQ ID NO: 26876 - protein, 28 aa, Artificial Sequence
  Description of Artificial Sequence: Synthetic peptide
DEEEIRTTNPVATEQYGDASEDLQNGNR

SEQ ID NO: 26877 - protein, 30 aa, Artificial Sequence
  Description of Artificial Sequence: Synthetic polypeptide
DEEEIRTTNPVATEQYGVVSTNLQEFNGER

SEQ ID NO: 26878 - protein, 28 aa, Artificial Sequence
  Description of Artificial Sequence: Synthetic peptide
AEEEIRQTNPVATEQYGSVSTNPQHGER

SEQ ID NO: 26879 - protein, 31 aa, Artificial Sequence
  Description of Artificial Sequence: Synthetic polypeptide
DEEEIRTTNPVATEQYGSVSTNLQDRKGEDN

SEQ ID NO: 26880 - protein, 28 aa, Artificial Sequence
  Description of Artificial Sequence: Synthetic peptide
DEEEIRTTNPVATEQWGSVDTNLMRGTA

SEQ ID NO: 26881 - protein, 28 aa, Artificial Sequence
  Description of Artificial Sequence: Synthetic peptide
MEEEIRTTNPVATEVYGSVSTDLQNGNY

SEQ ID NO: 26882 - protein, 30 aa, Artificial Sequence
  Description of Artificial Sequence: Synthetic polypeptide
DTEEIRTTNPVATEQYGMSVSTNLQETGVR

SEQ ID NO: 26883 - protein, 28 aa, Artificial Sequence
  Description of Artificial Sequence: Synthetic peptide
SEEEIRTTNPVATECYGSVSTNLQFGTQ

SEQ ID NO: 26884 - protein, 28 aa, Artificial Sequence
  Description of Artificial Sequence: Synthetic peptide
DEEEIRTTNPVATEQYGSVSTDDQLGEE

SEQ ID NO: 26885 - protein, 29 aa, Artificial Sequence
  Description of Artificial Sequence: Synthetic peptide
DEHEIRCTNPVATEQYGDVSTNLQEAGNR

SEQ ID NO: 26886 - protein, 28 aa, Artificial Sequence
  Description of Artificial Sequence: Synthetic peptide
MENEIRTTNPVATEQYGSVSTDLQIGNQ

SEQ ID NO: 26887 - protein, 28 aa, Artificial Sequence
  Description of Artificial Sequence: Synthetic peptide
DEEEIRTTNPVATEQYGSVSTPLGDGDA

SEQ ID NO: 26888 - protein, 29 aa, Artificial Sequence
  Description of Artificial Sequence: Synthetic peptide
DENEIRTTNPVATEQYGSHVSTILQRENM

SEQ ID NO: 26889 - protein, 28 aa, Artificial Sequence
  Description of Artificial Sequence: Synthetic peptide
CETEISTTNPVATEQYGDVSANLQRGNR

SEQ ID NO: 26890 - protein, 29 aa, Artificial Sequence
  Description of Artificial Sequence: Synthetic peptide
DEEMIRTTNPVATEQYGSVSTNPGDPGNR

SEQ ID NO: 26891 - protein, 32 aa, Artificial Sequence
  Description of Artificial Sequence: Synthetic polypeptide
DEEEIRTTNPVATEQYGSVSCTMNLQQRGNDA

SEQ ID NO: 26892 - protein, 31 aa, Artificial Sequence
  Description of Artificial Sequence: Synthetic polypeptide
DEEEIRTTNPVATEQYGSVSDTEELQAEGNR

SEQ ID NO: 26893 - protein, 28 aa, Artificial Sequence
  Description of Artificial Sequence: Synthetic peptide
DEEEIRTTNPVATEQYGSVSTGDQTGEM

SEQ ID NO: 26894 - protein, 29 aa, Artificial Sequence
  Description of Artificial Sequence: Synthetic peptide
DENEIRTTNPVATEQWGSVSTNLQMVGNF

SEQ ID NO: 26895 - protein, 28 aa, Artificial Sequence
  Description of Artificial Sequence: Synthetic peptide
DAEEIRTTNPVATEQWGSVSTNEQPGND

SEQ ID NO: 26896 - protein, 28 aa, Artificial Sequence
  Description of Artificial Sequence: Synthetic peptide
DEEEIRTTNPVATECYGSVSTDLQLGED

SEQ ID NO: 26897 - protein, 31 aa, Artificial Sequence
  Description of Artificial Sequence: Synthetic polypeptide
DEEEIRTTNPVATELYGSVSNTVNLDRGNLR

SEQ ID NO: 26898 - protein, 29 aa, Artificial Sequence
  Description of Artificial Sequence: Synthetic peptide
DEEEIRTTNPVATEQYGSVSTEDVQSGER

SEQ ID NO: 26899 - protein, 30 aa, Artificial Sequence
  Description of Artificial Sequence: Synthetic polypeptide
DEEEIRTTNPVATEQYGSVSTNEQLNGDNF

SEQ ID NO: 26900 - protein, 29 aa, Artificial Sequence
  Description of Artificial Sequence: Synthetic peptide
DEEEIRTVNPVATEMWGSVSTNWQRNGNR

SEQ ID NO: 26901 - protein, 28 aa, Artificial Sequence
  Description of Artificial Sequence: Synthetic peptide
DEGEIATTNPVCTEQFGSVSTNPQRGNR

SEQ ID NO: 26902 - protein, 28 aa, Artificial Sequence
  Description of Artificial Sequence: Synthetic peptide
DEEEITTTNPVATEMYGDVSTNLQQGNT

SEQ ID NO: 26903 - protein, 32 aa, Artificial Sequence
  Description of Artificial Sequence: Synthetic polypeptide
DEEEIRTTNPVATEQYGSVSTMNLPQLRGDNG

SEQ ID NO: 26904 - protein, 28 aa, Artificial Sequence
  Description of Artificial Sequence: Synthetic peptide
DEHEIRTTNPVATEQYGSVSEGEQRGNI

SEQ ID NO: 26905 - protein, 28 aa, Artificial Sequence
  Description of Artificial Sequence: Synthetic peptide
DEEEIRTTNPVATEQYGSVSENLQHEEN

SEQ ID NO: 26906 - protein, 29 aa, Artificial Sequence
  Description of Artificial Sequence: Synthetic peptide
DEQEITTTNPVATEQYGSVSTNLQIGNDM

SEQ ID NO: 26907 - protein, 30 aa, Artificial Sequence
  Description of Artificial Sequence: Synthetic polypeptide
DEQEIRTTNPVATECYGSVSTNLQEHGNDR

SEQ ID NO: 26908 - protein, 28 aa, Artificial Sequence
  Description of Artificial Sequence: Synthetic peptide
DEEEIRTTNPVATELYGSVSENEQQGTR

SEQ ID NO: 26909 - protein, 31 aa, Artificial Sequence
  Description of Artificial Sequence: Synthetic polypeptide
SEEEIRTTNPVATEQFGSVSTNLQEREGPNR

SEQ ID NO: 26910 - protein, 28 aa, Artificial Sequence
  Description of Artificial Sequence: Synthetic peptide
DEEEIRATNPVATECYGSVSTELQRGEQ

SEQ ID NO: 26911 - protein, 31 aa, Artificial Sequence
  Description of Artificial Sequence: Synthetic polypeptide
DEEEIRTTNPVATEQYGSVSTNLELRNGNDT

SEQ ID NO: 26912 - protein, 28 aa, Artificial Sequence
  Description of Artificial Sequence: Synthetic peptide
SEEEIRTTNPAATEMYGSVSTNLQQGNL

SEQ ID NO: 26913 - protein, 28 aa, Artificial Sequence
  Description of Artificial Sequence: Synthetic peptide
KEEEIAATNPVATEQYGSVSTDLQRGNA

SEQ ID NO: 26914 - protein, 29 aa, Artificial Sequence
  Description of Artificial Sequence: Synthetic peptide
SEVEIRTTNPVATEQFGSVSTNEQREGNR

SEQ ID NO: 26915 - protein, 28 aa, Artificial Sequence
  Description of Artificial Sequence: Synthetic peptide
DEQEIRTTNPVATEQYGSVSTDLERGEM

SEQ ID NO: 26916 - protein, 28 aa, Artificial Sequence
  Description of Artificial Sequence: Synthetic peptide
DEEEIRTTNPVATQCYGSVSHNLDPGNR

SEQ ID NO: 26917 - protein, 30 aa, Artificial Sequence
  Description of Artificial Sequence: Synthetic polypeptide
DENEIRTTNPVATEQYGSVSTNLQDVVGER

SEQ ID NO: 26918 - protein, 28 aa, Artificial Sequence
  Description of Artificial Sequence: Synthetic peptide
DEEEIRTTNPVATEQYGDYSENLQREDR

SEQ ID NO: 26919 - protein, 28 aa, Artificial Sequence
  Description of Artificial Sequence: Synthetic peptide
DEEEIRTTNPTATEPYGSVGMNLQRGTR

SEQ ID NO: 26920 - protein, 28 aa, Artificial Sequence
  Description of Artificial Sequence: Synthetic peptide
DEEEIATTNPVATEQYGSVSTDLQHGEQ

SEQ ID NO: 26921 - protein, 30 aa, Artificial Sequence
  Description of Artificial Sequence: Synthetic polypeptide
DEEEIRQTNPVATEQYGSVSITNQQPGNDR

SEQ ID NO: 26922 - protein, 32 aa, Artificial Sequence
  Description of Artificial Sequence: Synthetic polypeptide
IEEEIRTTNPVATEQYGSVNSDTNLQREGNER

SEQ ID NO: 26923 - protein, 28 aa, Artificial Sequence
  Description of Artificial Sequence: Synthetic peptide
DEHEIRTTNPVATEPYGWASTNLQRGNQ

SEQ ID NO: 26924 - protein, 28 aa, Artificial Sequence
  Description of Artificial Sequence: Synthetic peptide
DEQEIRTTNPVATEQYGSVSTNEMQGNF

SEQ ID NO: 26925 - protein, 29 aa, Artificial Sequence
  Description of Artificial Sequence: Synthetic peptide
DEEEIRTTNPVATEQYGSVSTNLEVEGEM

SEQ ID NO: 26926 - protein, 28 aa, Artificial Sequence
  Description of Artificial Sequence: Synthetic peptide
DEEEIRTTNPTATEQYGSVSTNGETGNF

SEQ ID NO: 26927 - protein, 28 aa, Artificial Sequence
  Description of Artificial Sequence: Synthetic peptide
DEEEIRTTNPVATECYGSVSTDLQLGEI

SEQ ID NO: 26928 - protein, 28 aa, Artificial Sequence
  Description of Artificial Sequence: Synthetic peptide
DEQEIRTTNPVATEQWGSVSTAEQRGNF

SEQ ID NO: 26929 - protein, 28 aa, Artificial Sequence
  Description of Artificial Sequence: Synthetic peptide
MEEEIRTTNPVATECYGSVATNLQSGNM

SEQ ID NO: 26930 - protein, 29 aa, Artificial Sequence
  Description of Artificial Sequence: Synthetic peptide
DEQEVRTTNPVATEQYGSVAMNLQRNGNR

SEQ ID NO: 26931 - protein, 30 aa, Artificial Sequence
  Description of Artificial Sequence: Synthetic polypeptide
DEEEIRTTNPVATEQYGSVSTNDEREDDNR

SEQ ID NO: 26932 - protein, 30 aa, Artificial Sequence
  Description of Artificial Sequence: Synthetic polypeptide
MEEEIRTTNPVATEQYGSVSTDLQENEGNR

SEQ ID NO: 26933 - protein, 29 aa, Artificial Sequence
  Description of Artificial Sequence: Synthetic peptide
DEEEIRTTNPVATEQYGVVSETDLERGNN

SEQ ID NO: 26934 - protein, 28 aa, Artificial Sequence
  Description of Artificial Sequence: Synthetic peptide
DEEEIRTTNPVATAPYGSVSSALQRGMR

SEQ ID NO: 26935 - protein, 28 aa, Artificial Sequence
  Description of Artificial Sequence: Synthetic peptide
DEEEIRTTNPVATEQYGSVSTDDEDGNG

SEQ ID NO: 26936 - protein, 28 aa, Artificial Sequence
  Description of Artificial Sequence: Synthetic peptide
DEEEIRTTNPVATEQYGDVSENEQHGNL

SEQ ID NO: 26937 - protein, 29 aa, Artificial Sequence
  Description of Artificial Sequence: Synthetic peptide
DEEEIRTTNPVATECYGSVSNNLQVGDNI

SEQ ID NO: 26938 - protein, 28 aa, Artificial Sequence
  Description of Artificial Sequence: Synthetic peptide
DEEEITTTNPVATEQYGSVSTDLQPGEV

SEQ ID NO: 26939 - protein, 28 aa, Artificial Sequence
  Description of Artificial Sequence: Synthetic peptide
DEECIRTTNPVATQQYGSVSTNDQPGER

SEQ ID NO: 26940 - protein, 30 aa, Artificial Sequence
  Description of Artificial Sequence: Synthetic polypeptide
VEEEIRTTNPVATEQYGSVGTMDLQQRGNR

SEQ ID NO: 26941 - protein, 29 aa, Artificial Sequence
  Description of Artificial Sequence: Synthetic peptide
DESEIRGTNPVATEQYGNVSENLQTRGNR

SEQ ID NO: 26942 - protein, 31 aa, Artificial Sequence
  Description of Artificial Sequence: Synthetic polypeptide
DEEEIRTTNPVATEQYGSVSITMNDQEKGNR

SEQ ID NO: 26943 - protein, 28 aa, Artificial Sequence
  Description of Artificial Sequence: Synthetic peptide
DEEEIRTTNPVATEMYGSVSTPLGPGNE

SEQ ID NO: 26944 - protein, 28 aa, Artificial Sequence
  Description of Artificial Sequence: Synthetic peptide
DEEEIRTTNPVATEQYGSVMDNLDAGER

SEQ ID NO: 26945 - protein, 28 aa, Artificial Sequence
  Description of Artificial Sequence: Synthetic peptide
DEEEIRTTNPVATEQWGIVSENEQRGNA

SEQ ID NO: 26946 - protein, 28 aa, Artificial Sequence
  Description of Artificial Sequence: Synthetic peptide
SEEEIWTTNPVAHEQYGSVCTNLQRPNR

SEQ ID NO: 26947 - protein, 28 aa, Artificial Sequence
  Description of Artificial Sequence: Synthetic peptide
DEEEIRTTNPDATEQYGSVSTNPQTGES

SEQ ID NO: 26948 - protein, 28 aa, Artificial Sequence
  Description of Artificial Sequence: Synthetic peptide
DEEEIRTTNPVATEQYGSVSTHLQHYPG

SEQ ID NO: 26949 - protein, 28 aa, Artificial Sequence
  Description of Artificial Sequence: Synthetic peptide
DEQEITTTNPVATEQYGSVSTALQVGNM

SEQ ID NO: 26950 - protein, 28 aa, Artificial Sequence
  Description of Artificial Sequence: Synthetic peptide
DEEEIRTTNPVATECYGVVSTDLQIGER

SEQ ID NO: 26951 - protein, 30 aa, Artificial Sequence
  Description of Artificial Sequence: Synthetic polypeptide
DEEEIRTTNPVATEQYGSVDSTNPVQQGER

SEQ ID NO: 26952 - protein, 28 aa, Artificial Sequence
  Description of Artificial Sequence: Synthetic peptide
DEEEIRTTNPVATECYGSVSTNLEVGEQ

SEQ ID NO: 26953 - protein, 31 aa, Artificial Sequence
  Description of Artificial Sequence: Synthetic polypeptide
DEEEIRTTNPVATEGYGSVSTNLQLRKGEDR

SEQ ID NO: 26954 - protein, 28 aa, Artificial Sequence
  Description of Artificial Sequence: Synthetic peptide
DEEEIATTNPVATEQYGSVSTELELGNH

SEQ ID NO: 26955 - protein, 28 aa, Artificial Sequence
  Description of Artificial Sequence: Synthetic peptide
DENEIRCTNPVATECYGSVSTNEQRGTR

SEQ ID NO: 26956 - protein, 29 aa, Artificial Sequence
  Description of Artificial Sequence: Synthetic peptide
DEEEIRTTNPVATEQYGSVSENEMMRGNA

SEQ ID NO: 26957 - protein, 28 aa, Artificial Sequence
  Description of Artificial Sequence: Synthetic peptide
DEEEIRTTNPAATEQFGSVSTNEQRGTQ

SEQ ID NO: 26958 - protein, 30 aa, Artificial Sequence
  Description of Artificial Sequence: Synthetic polypeptide
DEEEIRTTNPVATEQYGSVSTELQNEGEDR

SEQ ID NO: 26959 - protein, 28 aa, Artificial Sequence
  Description of Artificial Sequence: Synthetic peptide
DEEEIATTNPVATEQYGSVSTNQELGND

SEQ ID NO: 26960 - protein, 29 aa, Artificial Sequence
  Description of Artificial Sequence: Synthetic peptide
DENEIATTNPFATEQYGQVSTNLVQRGNR

SEQ ID NO: 26961 - protein, 28 aa, Artificial Sequence
  Description of Artificial Sequence: Synthetic peptide
DEEEIATTNPEATEQYGSVSTNSQNGNE

SEQ ID NO: 26962 - protein, 29 aa, Artificial Sequence
  Description of Artificial Sequence: Synthetic peptide
QEEEIRTTNPVATECYGSVSATDLQDGNR

SEQ ID NO: 26963 - protein, 28 aa, Artificial Sequence
  Description of Artificial Sequence: Synthetic peptide
DEEEIRTTNPVATECYGSVSTDLQYGEV

SEQ ID NO: 26964 - protein, 28 aa, Artificial Sequence
  Description of Artificial Sequence: Synthetic peptide
DEQEIRTTNPVATEQYGSVSTNEMVGNA

SEQ ID NO: 26965 - protein, 28 aa, Artificial Sequence
  Description of Artificial Sequence: Synthetic peptide
DEQEIRTTNPVATEQYGSVSTPLDEGNA

SEQ ID NO: 26966 - protein, 29 aa, Artificial Sequence
  Description of Artificial Sequence: Synthetic peptide
DENEIRTTNPVATEQYGSVSTELQETGNQ

SEQ ID NO: 26967 - protein, 31 aa, Artificial Sequence
  Description of Artificial Sequence: Synthetic polypeptide
DENEIRTTNPVATEQYGDVCSTCNLQRGNDR

SEQ ID NO: 26968 - protein, 30 aa, Artificial Sequence
  Description of Artificial Sequence: Synthetic polypeptide
DEQEIRTTNPVATEQYGSVSTDVQRGENWR

SEQ ID NO: 26969 - protein, 28 aa, Artificial Sequence
  Description of Artificial Sequence: Synthetic peptide
DEEEIRTTNPVATECYGSTSTNDQIGNL

SEQ ID NO: 26970 - protein, 28 aa, Artificial Sequence
  Description of Artificial Sequence: Synthetic peptide
SEEEIRTTNPVATEQYGSVSENGQGGNY

SEQ ID NO: 26971 - protein, 28 aa, Artificial Sequence
  Description of Artificial Sequence: Synthetic peptide
DENEIATTNPVATEIYGSVSTNLQPGNN

SEQ ID NO: 26972 - protein, 28 aa, Artificial Sequence
  Description of Artificial Sequence: Synthetic peptide
DEEEIRTTNPVATEMYGVVSTALQIGNL

SEQ ID NO: 26973 - protein, 28 aa, Artificial Sequence
  Description of Artificial Sequence: Synthetic peptide
DENEIRTTNPVATECYGSVSTDLQVGNI

SEQ ID NO: 26974 - protein, 28 aa, Artificial Sequence
  Description of Artificial Sequence: Synthetic peptide
DENEIRTTNPVATEQWGSYSTNLMQGNR

SEQ ID NO: 26975 - protein, 28 aa, Artificial Sequence
  Description of Artificial Sequence: Synthetic peptide
DEEEIRTTNPDATEQYGSVSTGLDPGNP

SEQ ID NO: 26976 - protein, 28 aa, Artificial Sequence
  Description of Artificial Sequence: Synthetic peptide
DENEIRCTNPVATEQWGSVSTNLQRGDI

SEQ ID NO: 26977 - protein, 28 aa, Artificial Sequence
  Description of Artificial Sequence: Synthetic peptide
DEEEIRTTNPVATEVYGWASTNLMHGNR

SEQ ID NO: 26978 - protein, 29 aa, Artificial Sequence
  Description of Artificial Sequence: Synthetic peptide
DESEIRTTNPVATELYGSVSITNLERGNM

SEQ ID NO: 26979 - protein, 30 aa, Artificial Sequence
  Description of Artificial Sequence: Synthetic polypeptide
DEEEIRTTNPVATEQYGSVSTNEQELGNTG

SEQ ID NO: 26980 - protein, 28 aa, Artificial Sequence
  Description of Artificial Sequence: Synthetic peptide
DENEIRTTNPVATEQYGSVSENEMQGNR

SEQ ID NO: 26981 - protein, 28 aa, Artificial Sequence
  Description of Artificial Sequence: Synthetic peptide
DEEEIRTTNPVATEQYGSVDTNSDLGNF

SEQ ID NO: 26982 - protein, 28 aa, Artificial Sequence
  Description of Artificial Sequence: Synthetic peptide
DEVEIATTNPVATELYGGVSTNEQRGNR

SEQ ID NO: 26983 - protein, 28 aa, Artificial Sequence
  Description of Artificial Sequence: Synthetic peptide
DEEEIRTTNPVATEQWGSYSEILQRENR

SEQ ID NO: 26984 - protein, 28 aa, Artificial Sequence
  Description of Artificial Sequence: Synthetic peptide
DETELRTTNPVATEQYGDVGTNLQRGNQ

SEQ ID NO: 26985 - protein, 31 aa, Artificial Sequence
  Description of Artificial Sequence: Synthetic polypeptide
DEEEIRTTNPVATECYGSVSATNLQDRNGNM

SEQ ID NO: 26986 - protein, 28 aa, Artificial Sequence
  Description of Artificial Sequence: Synthetic peptide
SEEEIRATNPVATEQYGSVSENLQIGNQ

SEQ ID NO: 26987 - protein, 28 aa, Artificial Sequence
  Description of Artificial Sequence: Synthetic peptide
MEEEIRTTNPVATEMYGWVSTNLQTGNN

SEQ ID NO: 26988 - protein, 28 aa, Artificial Sequence
  Description of Artificial Sequence: Synthetic peptide
DENEIRTTNPVATEQYGVVSTNLQYGEF

SEQ ID NO: 26989 - protein, 29 aa, Artificial Sequence
  Description of Artificial Sequence: Synthetic peptide
DEEEIRTTNPVCTEQYGSVSTNLVEQGNP

SEQ ID NO: 26990 - protein, 28 aa, Artificial Sequence
  Description of Artificial Sequence: Synthetic peptide
DEQEIRTTNPVATEQYGSVETNDERGNF

SEQ ID NO: 26991 - protein, 31 aa, Artificial Sequence
  Description of Artificial Sequence: Synthetic polypeptide
DEEEIRTTNPVATEQYGSVSTNLQDAEGNDS

SEQ ID NO: 26992 - protein, 28 aa, Artificial Sequence
  Description of Artificial Sequence: Synthetic peptide
FEEEIRTTNPVATEQYGGVGTNLQQGND

SEQ ID NO: 26993 - protein, 28 aa, Artificial Sequence
  Description of Artificial Sequence: Synthetic peptide
DEEEIRTTNPVATEMYGSVSTNGQHDNM

SEQ ID NO: 26994 - protein, 28 aa, Artificial Sequence
  Description of Artificial Sequence: Synthetic peptide
DEQEIATTNPVATEQYGSVSTNLERGEL

SEQ ID NO: 26995 - protein, 28 aa, Artificial Sequence
  Description of Artificial Sequence: Synthetic peptide
DEEEIRTTNPTATETFGSVSTNLQHGNG

SEQ ID NO: 26996 - protein, 28 aa, Artificial Sequence
  Description of Artificial Sequence: Synthetic peptide
DEEEIRTTNPVCTEQYGSVSNNQQRGDQ

SEQ ID NO: 26997 - protein, 31 aa, Artificial Sequence
  Description of Artificial Sequence: Synthetic polypeptide
DEEEIRTTNPVATEQYGSVSTNLQDREGEDF

SEQ ID NO: 26998 - protein, 31 aa, Artificial Sequence
  Description of Artificial Sequence: Synthetic polypeptide
DEVEIRTTNPVATEQYGSVSTMNLQRGDNDQ

SEQ ID NO: 26999 - protein, 30 aa, Artificial Sequence
  Description of Artificial Sequence: Synthetic polypeptide
DENEIRTTNPVATEQYGSVSTDLQREGNDM

SEQ ID NO: 27000 - protein, 28 aa, Artificial Sequence
  Description of Artificial Sequence: Synthetic peptide
DEVEIATTNPTATEQYGSVSTNEQIGNR

SEQ ID NO: 27001 - protein, 32 aa, Artificial Sequence
  Description of Artificial Sequence: Synthetic polypeptide
DEEEIRTTNPVATEQYGSVSATDNGLEIRGNR

SEQ ID NO: 27002 - protein, 28 aa, Artificial Sequence
  Description of Artificial Sequence: Synthetic peptide
QEEEIRTTNPVATEQYGSVSEVLQGGNN

SEQ ID NO: 27003 - protein, 28 aa, Artificial Sequence
  Description of Artificial Sequence: Synthetic peptide
DEEEIRTTNPVATEQYGDVSENLMRGQQ

SEQ ID NO: 27004 - protein, 30 aa, Artificial Sequence
  Description of Artificial Sequence: Synthetic polypeptide
DEEEIRTTNPVATEPYGSVCFTNLTRGGNR

SEQ ID NO: 27005 - protein, 29 aa, Artificial Sequence
  Description of Artificial Sequence: Synthetic peptide
SEEEIRTTNPVATECYGSVSTNEQRGNLQ

SEQ ID NO: 27006 - protein, 28 aa, Artificial Sequence
  Description of Artificial Sequence: Synthetic peptide
DEEEIRTTNPVCTEQYGSVSTELEVGNY

SEQ ID NO: 27007 - protein, 31 aa, Artificial Sequence
  Description of Artificial Sequence: Synthetic polypeptide
DEEEIRTTNPVATEQYGSVSETNPLQENGNW

SEQ ID NO: 27008 - protein, 31 aa, Artificial Sequence
  Description of Artificial Sequence: Synthetic polypeptide
DEMEIRTTNPVATEQYGSVSCDNLQQRGNDR

SEQ ID NO: 27009 - protein, 31 aa, Artificial Sequence
  Description of Artificial Sequence: Synthetic polypeptide
DEEEIRTTNPVATEQYGSVSTNLQDVEGNDT

SEQ ID NO: 27010 - protein, 28 aa, Artificial Sequence
  Description of Artificial Sequence: Synthetic peptide
DEEEIRTTNPVATEQYGSVSTEDEVGNW

SEQ ID NO: 27011 - protein, 28 aa, Artificial Sequence
  Description of Artificial Sequence: Synthetic peptide
DENEIRTTNPVATECYGSVSDNLERGMR

SEQ ID NO: 27012 - protein, 28 aa, Artificial Sequence
  Description of Artificial Sequence: Synthetic peptide
DEEEIATTNPTATEQYGSVSTNPQNGNV

SEQ ID NO: 27013 - protein, 31 aa, Artificial Sequence
  Description of Artificial Sequence: Synthetic polypeptide
MEEEIRTTNPVATEQYGSVSTNLQESEGNDR

SEQ ID NO: 27014 - protein, 30 aa, Artificial Sequence
  Description of Artificial Sequence: Synthetic polypeptide
DEEEIRTTNPVGTEQYGSVSDNLQQRGNGF

SEQ ID NO: 27015 - protein, 28 aa, Artificial Sequence
  Description of Artificial Sequence: Synthetic peptide
QEEEIRTTNPVATEVYGSASTNLQHGGR

SEQ ID NO: 27016 - protein, 28 aa, Artificial Sequence
  Description of Artificial Sequence: Synthetic peptide
DEEEIRTTNPDATEQYGSVSTEPQFGER

SEQ ID NO: 27017 - protein, 31 aa, Artificial Sequence
  Description of Artificial Sequence: Synthetic polypeptide
DEEEIRTTNPVATEQYGSVSTMNEQDLEGNR

SEQ ID NO: 27018 - protein, 30 aa, Artificial Sequence
  Description of Artificial Sequence: Synthetic polypeptide
DAEEIRTTNPVATEQYGHVSTGPLQRGENR

SEQ ID NO: 27019 - protein, 28 aa, Artificial Sequence
  Description of Artificial Sequence: Synthetic peptide
DEEEIRTTNPEATEQYGSVSTADENGNR

SEQ ID NO: 27020 - protein, 30 aa, Artificial Sequence
  Description of Artificial Sequence: Synthetic polypeptide
DEEEIRTTNPCATESYGSVSTENLQEQGNR

SEQ ID NO: 27021 - protein, 28 aa, Artificial Sequence
  Description of Artificial Sequence: Synthetic peptide
DEEEIRTTNPVATEQYGSVAEELQNGER

SEQ ID NO: 27022 - protein, 30 aa, Artificial Sequence
  Description of Artificial Sequence: Synthetic polypeptide
DEEEIRTTNPVATEQYGSVISTNLQSLELR

SEQ ID NO: 27023 - protein, 28 aa, Artificial Sequence
  Description of Artificial Sequence: Synthetic peptide
QEQEITTTNPVATEQYGEVSDNLQRGNR

SEQ ID NO: 27024 - protein, 29 aa, Artificial Sequence
  Description of Artificial Sequence: Synthetic peptide
DEEEIATTNPVATECYGSVSTNLQDRGEM

SEQ ID NO: 27025 - protein, 28 aa, Artificial Sequence
  Description of Artificial Sequence: Synthetic peptide
DEQEIRTTNPVATEQYGSVSTDDERGNE

SEQ ID NO: 27026 - protein, 29 aa, Artificial Sequence
  Description of Artificial Sequence: Synthetic peptide
DEEEIAATNPVATEQFGSVSTNLQREGTR

SEQ ID NO: 27027 - protein, 28 aa, Artificial Sequence
  Description of Artificial Sequence: Synthetic peptide
DEEEIRTTNPVATEQYGSVSECLEHGER

SEQ ID NO: 27028 - protein, 28 aa, Artificial Sequence
  Description of Artificial Sequence: Synthetic peptide
DEEEIRTTNPVATENYGSVSTNLMGGTA

SEQ ID NO: 27029 - protein, 30 aa, Artificial Sequence
  Description of Artificial Sequence: Synthetic polypeptide
DEQEIRTTNPVATEQYGSVSCTDLQCHGNR

SEQ ID NO: 27030 - protein, 29 aa, Artificial Sequence
  Description of Artificial Sequence: Synthetic peptide
DENEIRTTNPVATECYGSVSTNLQHGNDL

SEQ ID NO: 27031 - protein, 29 aa, Artificial Sequence
  Description of Artificial Sequence: Synthetic peptide
AEEEIRQTNPVATEQYGSVSTNLVERGND

SEQ ID NO: 27032 - protein, 28 aa, Artificial Sequence
  Description of Artificial Sequence: Synthetic peptide
DEEEIAATNPVATEQYGSVPENEQRGNR

SEQ ID NO: 27033 - protein, 29 aa, Artificial Sequence
  Description of Artificial Sequence: Synthetic peptide
DEEEIRTTNPVATSQYGSVSDNLQVSGGR

SEQ ID NO: 27034 - protein, 28 aa, Artificial Sequence
  Description of Artificial Sequence: Synthetic peptide
KEEEIRTTNPVATEQYGSVSTELQGGDL

SEQ ID NO: 27035 - protein, 31 aa, Artificial Sequence
  Description of Artificial Sequence: Synthetic polypeptide
DEEEIRTTNPVATEQYGSVSTNLQDQEGNDY

SEQ ID NO: 27036 - protein, 28 aa, Artificial Sequence
  Description of Artificial Sequence: Synthetic peptide
SEEEISTTNPVATEQYGSVSENEQRGNS

SEQ ID NO: 27037 - protein, 28 aa, Artificial Sequence
  Description of Artificial Sequence: Synthetic peptide
DEEEIRTTNPVATEQYGSVSEDLQYGDD

SEQ ID NO: 27038 - protein, 28 aa, Artificial Sequence
  Description of Artificial Sequence: Synthetic peptide
MEEEISTTNPVATEQYGSVSDNLQNGNY

SEQ ID NO: 27039 - protein, 31 aa, Artificial Sequence
  Description of Artificial Sequence: Synthetic polypeptide
SEEEIRTTNPVATEQYGSVISTENLQSEGNR

SEQ ID NO: 27040 - protein, 29 aa, Artificial Sequence
  Description of Artificial Sequence: Synthetic peptide
DEEEIRTTNPVAYEIYGGVSSNLQRNGNR

SEQ ID NO: 27041 - protein, 28 aa, Artificial Sequence
  Description of Artificial Sequence: Synthetic peptide
DEEEISCTNPVATEQYGSVSENLQMGNF

SEQ ID NO: 27042 - protein, 28 aa, Artificial Sequence
  Description of Artificial Sequence: Synthetic peptide
KEEEIRTTNPVATEQYGSVSTDLQTGDD

SEQ ID NO: 27043 - protein, 28 aa, Artificial Sequence
  Description of Artificial Sequence: Synthetic peptide
DEEEIRTTNPVATEQYGVVSTDLESGNV

SEQ ID NO: 27044 - protein, 28 aa, Artificial Sequence
  Description of Artificial Sequence: Synthetic peptide
DEEEIRTTNPVATEQYGDVSTDPQPGNY

SEQ ID NO: 27045 - protein, 28 aa, Artificial Sequence
  Description of Artificial Sequence: Synthetic peptide
DEQEIRTTNPVATEQYGSVSTNDMRGTA

SEQ ID NO: 27046 - protein, 28 aa, Artificial Sequence
  Description of Artificial Sequence: Synthetic peptide
AEEEIAQTNPVATEQYGSVSTDLQRGER

SEQ ID NO: 27047 - protein, 28 aa, Artificial Sequence
  Description of Artificial Sequence: Synthetic peptide
DENEIRTTNPVATEQWGSVSTNEMRGNA

SEQ ID NO: 27048 - protein, 31 aa, Artificial Sequence
  Description of Artificial Sequence: Synthetic polypeptide
DEEEIRTTNPVATEQYGDVSCTDLQCRGNDR

SEQ ID NO: 27049 - protein, 28 aa, Artificial Sequence
  Description of Artificial Sequence: Synthetic peptide
DEEEIRTTNPVATEWYGSYSTELETGNR

SEQ ID NO: 27050 - protein, 29 aa, Artificial Sequence
  Description of Artificial Sequence: Synthetic peptide
DEEEIRTTNPVATEQYGSVDTNGDQPGER

SEQ ID NO: 27051 - protein, 30 aa, Artificial Sequence
  Description of Artificial Sequence: Synthetic polypeptide
DEEEIRCTNPVATEIYGCVSATNLQRNGNR

SEQ ID NO: 27052 - protein, 32 aa, Artificial Sequence
  Description of Artificial Sequence: Synthetic polypeptide
DEEEIRTTNPVATEQYGSVSVTENLQDRMGER

SEQ ID NO: 27053 - protein, 28 aa, Artificial Sequence
  Description of Artificial Sequence: Synthetic peptide
DEEEIRTTNPVATEVYGCVANNLERGNR

SEQ ID NO: 27054 - protein, 28 aa, Artificial Sequence
  Description of Artificial Sequence: Synthetic peptide
DEEEIRTTNPVATEQYGSVSTAPQFGEI

SEQ ID NO: 27055 - protein, 31 aa, Artificial Sequence
  Description of Artificial Sequence: Synthetic polypeptide
DEEEIRTTNPVATEQYGSVSTNLQELGENDA

SEQ ID NO: 27056 - protein, 28 aa, Artificial Sequence
  Description of Artificial Sequence: Synthetic peptide
DEHEIATTNPVATEQYGSVSTDLQAGNV

SEQ ID NO: 27057 - protein, 28 aa, Artificial Sequence
  Description of Artificial Sequence: Synthetic peptide
VEEEIRTTNPVCTEMYGNVSTNLQRGNQ

SEQ ID NO: 27058 - protein, 28 aa, Artificial Sequence
  Description of Artificial Sequence: Synthetic peptide
DETEIRTTNPVATEQYGSVSDNQQRLMR

SEQ ID NO: 27059 - protein, 31 aa, Artificial Sequence
  Description of Artificial Sequence: Synthetic polypeptide
DEEEIRTTNPVATEQYGSVSEDNDQERGNPR

SEQ ID NO: 27060 - protein, 31 aa, Artificial Sequence
  Description of Artificial Sequence: Synthetic polypeptide
DEEEIRTTNPVATEQYGSVSTNLQDSEGNDF

SEQ ID NO: 27061 - protein, 29 aa, Artificial Sequence
  Description of Artificial Sequence: Synthetic peptide
DEQEIRTTNPVATEQYGEASATNLQHGNR

SEQ ID NO: 27062 - protein, 30 aa, Artificial Sequence
  Description of Artificial Sequence: Synthetic polypeptide
DEEEIRTTNPVATEQYGSVSTDLQEIGNDN

SEQ ID NO: 27063 - protein, 28 aa, Artificial Sequence
  Description of Artificial Sequence: Synthetic peptide
DEEEIATTNPTATEQYGSVSTNEQQGNL

SEQ ID NO: 27064 - protein, 28 aa, Artificial Sequence
  Description of Artificial Sequence: Synthetic peptide
DEEEIRTTNPEATEQYGSVSTPLDGGER

SEQ ID NO: 27065 - protein, 31 aa, Artificial Sequence
  Description of Artificial Sequence: Synthetic polypeptide
DEEEIRTTNPVATEQYGSVSTNLVQNKGDNL

SEQ ID NO: 27066 - protein, 28 aa, Artificial Sequence
  Description of Artificial Sequence: Synthetic peptide
DESEIRTTNPVATEQYGAVSTNLCNGNT

SEQ ID NO: 27067 - protein, 28 aa, Artificial Sequence
  Description of Artificial Sequence: Synthetic peptide
DEEEIRTTNPVATEQYGSVSTPDDAGND

SEQ ID NO: 27068 - protein, 28 aa, Artificial Sequence
  Description of Artificial Sequence: Synthetic peptide
DEQEIRTTNPVATEQYGSVSENLMHGQR

SEQ ID NO: 27069 - protein, 28 aa, Artificial Sequence
  Description of Artificial Sequence: Synthetic peptide
SEEEIATTNPTATEMYGSVSTNEQRGNR

SEQ ID NO: 27070 - protein, 28 aa, Artificial Sequence
  Description of Artificial Sequence: Synthetic peptide
DEQEIRTTNPVATEQYGIVSENLQHGNM

SEQ ID NO: 27071 - protein, 28 aa, Artificial Sequence
  Description of Artificial Sequence: Synthetic peptide
DEQEIRTTNPVATEQYGDVSTDDQHGNR

SEQ ID NO: 27072 - protein, 28 aa, Artificial Sequence
  Description of Artificial Sequence: Synthetic peptide
MENEIRTTNPVATEQYGSVSTNLQNGQS

SEQ ID NO: 27073 - protein, 28 aa, Artificial Sequence
  Description of Artificial Sequence: Synthetic peptide
DEQEIRTTNPVATEQYGWVSTDLQIGNF

SEQ ID NO: 27074 - protein, 28 aa, Artificial Sequence
  Description of Artificial Sequence: Synthetic peptide
DEEEIRTTNPDATEQYGSVSTNELEGNF

SEQ ID NO: 27075 - protein, 29 aa, Artificial Sequence
  Description of Artificial Sequence: Synthetic peptide
DEEEIATTNPVATEQYGSVSTMDEQQGNR

SEQ ID NO: 27076 - protein, 28 aa, Artificial Sequence
  Description of Artificial Sequence: Synthetic peptide
DEEEIRTTNPVATECYGDVSTCLQRENL

SEQ ID NO: 27077 - protein, 28 aa, Artificial Sequence
  Description of Artificial Sequence: Synthetic peptide
DEEEIRTTNPVASECYGSVSTNPQTGNF

SEQ ID NO: 27078 - protein, 31 aa, Artificial Sequence
  Description of Artificial Sequence: Synthetic polypeptide
DEEEIRQTNPVATEQYGSVSVTNLQERGEPR

SEQ ID NO: 27079 - protein, 30 aa, Artificial Sequence
  Description of Artificial Sequence: Synthetic polypeptide
DEEEIRTTNPVATECYGSVCSTNLQIGEND

SEQ ID NO: 27080 - protein, 29 aa, Artificial Sequence
  Description of Artificial Sequence: Synthetic peptide
DEQEIVTTNPVATEQYGSVSTNLQENENR

SEQ ID NO: 27081 - protein, 30 aa, Artificial Sequence
  Description of Artificial Sequence: Synthetic polypeptide
DEEEIRTTNPVATEQYGSVSTDLQEVNGER

SEQ ID NO: 27082 - protein, 30 aa, Artificial Sequence
  Description of Artificial Sequence: Synthetic polypeptide
DEEEIRTTNPVATEQYGSVSTNEQTHNGNA

SEQ ID NO: 27083 - protein, 29 aa, Artificial Sequence
  Description of Artificial Sequence: Synthetic peptide
QEEEIVTTNPVATEQYGSVSAMNLQRGND

SEQ ID NO: 27084 - protein, 28 aa, Artificial Sequence
  Description of Artificial Sequence: Synthetic peptide
DEEEIRCTNPVASELYGSVATNLQRGNQ

SEQ ID NO: 27085 - protein, 30 aa, Artificial Sequence
  Description of Artificial Sequence: Synthetic polypeptide
DENEIRTTNPVATEQYGSVSTNLQIDEGER

SEQ ID NO: 27086 - protein, 32 aa, Artificial Sequence
  Description of Artificial Sequence: Synthetic polypeptide
DEEEIRTTNPVATEQYGSVSDTPNLQRNGDNP

SEQ ID NO: 27087 - protein, 28 aa, Artificial Sequence
  Description of Artificial Sequence: Synthetic peptide
DEEEIATTNPVATEQYGSVSTPLEVGNI

SEQ ID NO: 27088 - protein, 28 aa, Artificial Sequence
  Description of Artificial Sequence: Synthetic peptide
SEEEIAATNPVATEQYGSVSTNLQQGNF

SEQ ID NO: 27089 - protein, 28 aa, Artificial Sequence
  Description of Artificial Sequence: Synthetic peptide
DEEEICTTNPVATEQYGSNSTNLQNGMM

SEQ ID NO: 27090 - protein, 31 aa, Artificial Sequence
  Description of Artificial Sequence: Synthetic polypeptide
DEEEIRTTNPVATEQYGSVSTTAGLQYGDNR

SEQ ID NO: 27091 - protein, 28 aa, Artificial Sequence
  Description of Artificial Sequence: Synthetic peptide
SDEEIRTTNPVATEQYGSVSTNLQLGTM

SEQ ID NO: 27092 - protein, 29 aa, Artificial Sequence
  Description of Artificial Sequence: Synthetic peptide
DEHEIATTNPVATEQYGSVSTNGDQRGND

SEQ ID NO: 27093 - protein, 28 aa, Artificial Sequence
  Description of Artificial Sequence: Synthetic peptide
DEEEIRTTNPVATEQYGDVSEDLQAGNH

SEQ ID NO: 27094 - protein, 28 aa, Artificial Sequence
  Description of Artificial Sequence: Synthetic peptide
MENEIRTTNPVATEQYGSVSENLQVGNV

SEQ ID NO: 27095 - protein, 30 aa, Artificial Sequence
  Description of Artificial Sequence: Synthetic polypeptide
GEEEIRTTNPVATECYGSVSTNLQEWGNDR

SEQ ID NO: 27096 - protein, 30 aa, Artificial Sequence
  Description of Artificial Sequence: Synthetic polypeptide
DEEEIRTTNPVATEQYGEVSTTNQVERGNR

SEQ ID NO: 27097 - protein, 28 aa, Artificial Sequence
  Description of Artificial Sequence: Synthetic peptide
DEEEIRTTNPVATEQYGCVSNALQEGGR

SEQ ID NO: 27098 - protein, 28 aa, Artificial Sequence
  Description of Artificial Sequence: Synthetic peptide
DEEEIRTTNPVATEQYGSVSSELEAGNV

SEQ ID NO: 27099 - protein, 28 aa, Artificial Sequence
  Description of Artificial Sequence: Synthetic peptide
DEEEIRTTNPVATEQYGSVSTELETGEL

SEQ ID NO: 27100 - protein, 28 aa, Artificial Sequence
  Description of Artificial Sequence: Synthetic peptide
DEEEIRTTNPVATEIYGSVPTNLTTMNR

SEQ ID NO: 27101 - protein, 29 aa, Artificial Sequence
  Description of Artificial Sequence: Synthetic peptide
DEEEIRTTNPVATEQYGSVSTNGQHNGEA

SEQ ID NO: 27102 - protein, 28 aa, Artificial Sequence
  Description of Artificial Sequence: Synthetic peptide
DEEEIRTTNPVATECYGSVSTDLQTGEM

SEQ ID NO: 27103 - protein, 28 aa, Artificial Sequence
  Description of Artificial Sequence: Synthetic peptide
DEEEIRTTNPVATEQYGSVDTQLQHDNF

SEQ ID NO: 27104 - protein, 28 aa, Artificial Sequence
  Description of Artificial Sequence: Synthetic peptide
DEEEITTTNPVATEQYGSVATDLQRENV

SEQ ID NO: 27105 - protein, 28 aa, Artificial Sequence
  Description of Artificial Sequence: Synthetic peptide
DENEIRQTNPVATEQYGSVSENQQRGND

SEQ ID NO: 27106 - protein, 30 aa, Artificial Sequence
  Description of Artificial Sequence: Synthetic polypeptide
DEEEIRTTNPVATEVYGSVSCTDLQRGNDA

SEQ ID NO: 27107 - protein, 32 aa, Artificial Sequence
  Description of Artificial Sequence: Synthetic polypeptide
DEEEIRTTNPVATEQYGSVSTDPLDQIRGNDR

SEQ ID NO: 27108 - protein, 28 aa, Artificial Sequence
  Description of Artificial Sequence: Synthetic peptide
DEEQIRTTNPVAFEQYGSVSTNLHPGSR

SEQ ID NO: 27109 - protein, 28 aa, Artificial Sequence
  Description of Artificial Sequence: Synthetic peptide
DETEIRTTNPVASEQYGSVPTNIQRQNR

SEQ ID NO: 27110 - protein, 31 aa, Artificial Sequence
  Description of Artificial Sequence: Synthetic polypeptide
DEEEIRTTNPVATEQYGSVSTNLQDNGDNDY

SEQ ID NO: 27111 - protein, 28 aa, Artificial Sequence
  Description of Artificial Sequence: Synthetic peptide
DEEEIRTTNPVATEQYGVVSTDLQGGED

SEQ ID NO: 27112 - protein, 29 aa, Artificial Sequence
  Description of Artificial Sequence: Synthetic peptide
MEEEIRTTNPVATEMYGVVSTNLQREGNV

SEQ ID NO: 27113 - protein, 28 aa, Artificial Sequence
  Description of Artificial Sequence: Synthetic peptide
DEEEIRTTNPVATEQYGSVSDNLQNEES

SEQ ID NO: 27114 - protein, 28 aa, Artificial Sequence
  Description of Artificial Sequence: Synthetic peptide
DEEEIRTTNPVATEQYGSVSTDLENGEF

SEQ ID NO: 27115 - protein, 30 aa, Artificial Sequence
  Description of Artificial Sequence: Synthetic polypeptide
DEQEIRTTNPVATEIYGCVSATNLQRNGNR

SEQ ID NO: 27116 - protein, 31 aa, Artificial Sequence
  Description of Artificial Sequence: Synthetic polypeptide
DEEEIRTTNPVATEQYGSVISTMNLQRGETN

SEQ ID NO: 27117 - protein, 28 aa, Artificial Sequence
  Description of Artificial Sequence: Synthetic peptide
DESEIRSTNPCATEQYGSVSTDLERGNR

SEQ ID NO: 27118 - protein, 28 aa, Artificial Sequence
  Description of Artificial Sequence: Synthetic peptide
DEEEIATTNPVATECYGSVSTDLQHGNL

SEQ ID NO: 27119 - protein, 28 aa, Artificial Sequence
  Description of Artificial Sequence: Synthetic peptide
DEEEISTVNPVATEQYGSVSTGLQRENI

SEQ ID NO: 27120 - protein, 30 aa, Artificial Sequence
  Description of Artificial Sequence: Synthetic polypeptide
DEEEIRTTNPVATEQYGSVSETENLEREER

SEQ ID NO: 27121 - protein, 28 aa, Artificial Sequence
  Description of Artificial Sequence: Synthetic peptide
DEVEIRTTNPVATEQYGSVDTNLLHGER

SEQ ID NO: 27122 - protein, 28 aa, Artificial Sequence
  Description of Artificial Sequence: Synthetic peptide
DEGEIRTTNPVATEQYGEVSTNLIQGNQ

SEQ ID NO: 27123 - protein, 30 aa, Artificial Sequence
  Description of Artificial Sequence: Synthetic polypeptide
AEEEIRTTNPVATEQYGSVSATNLQVNGND

SEQ ID NO: 27124 - protein, 28 aa, Artificial Sequence
  Description of Artificial Sequence: Synthetic peptide
QENEIRTTNPVATEQYGSVSTNLQDGEE

SEQ ID NO: 27125 - protein, 28 aa, Artificial Sequence
  Description of Artificial Sequence: Synthetic peptide
AEQEIVTTNPVATEQYGWVSENLQRGNR

SEQ ID NO: 27126 - protein, 29 aa, Artificial Sequence
  Description of Artificial Sequence: Synthetic peptide
DEQEIRTTNPVATEQYGSVSTENEQNGDR

SEQ ID NO: 27127 - protein, 28 aa, Artificial Sequence
  Description of Artificial Sequence: Synthetic peptide
DENEITTTNPVATETYGSVSTNLQRGML

SEQ ID NO: 27128 - protein, 29 aa, Artificial Sequence
  Description of Artificial Sequence: Synthetic peptide
DEQEIRTTNPVATEQYGSVSTNDQEVGER

SEQ ID NO: 27129 - protein, 31 aa, Artificial Sequence
  Description of Artificial Sequence: Synthetic polypeptide
DENEIRTTNPVATECYGSVSTNLQIRGVNDR

SEQ ID NO: 27130 - protein, 32 aa, Artificial Sequence
  Description of Artificial Sequence: Synthetic polypeptide
DEQEIRTTNPVATEQYGSVSATNLQEREGNDR

SEQ ID NO: 27131 - protein, 28 aa, Artificial Sequence
  Description of Artificial Sequence: Synthetic peptide
QEEEIRTTNPVATEQYGSVSTELHIGNY

SEQ ID NO: 27132 - protein, 28 aa, Artificial Sequence
  Description of Artificial Sequence: Synthetic peptide
DEEEIRTVNPVATEQYGSVSTDLQQGDA

SEQ ID NO: 27133 - protein, 28 aa, Artificial Sequence
  Description of Artificial Sequence: Synthetic peptide
VEEEIRTTNPVATEQYGSVSTPLEVGER

SEQ ID NO: 27134 - protein, 28 aa, Artificial Sequence
  Description of Artificial Sequence: Synthetic peptide
DEEEIRTTNPVATEQYGDVSEDLQYGNN

SEQ ID NO: 27135 - protein, 29 aa, Artificial Sequence
  Description of Artificial Sequence: Synthetic peptide
DEEEIRSTNPVAYEQYGSVSAMNLQPGNR

SEQ ID NO: 27136 - protein, 30 aa, Artificial Sequence
  Description of Artificial Sequence: Synthetic polypeptide
DEEEIRTTNPVATEQYGSVSTANPQIGNTA

SEQ ID NO: 27137 - protein, 31 aa, Artificial Sequence
  Description of Artificial Sequence: Synthetic polypeptide
AEQEIRTTNPVATEQYGSVSTGNLQRNGVNR

SEQ ID NO: 27138 - protein, 28 aa, Artificial Sequence
  Description of Artificial Sequence: Synthetic peptide
DEQEIRTTNPVATEHYGQVSENLQRGTR

SEQ ID NO: 27139 - protein, 31 aa, Artificial Sequence
  Description of Artificial Sequence: Synthetic polypeptide
DEEEIRTTNPVATEQYGSVSATENLQREGEA

SEQ ID NO: 27140 - protein, 28 aa, Artificial Sequence
  Description of Artificial Sequence: Synthetic peptide
DEEEIRQTNPVATEQYGDVSTNLQHGQQ

SEQ ID NO: 27141 - protein, 30 aa, Artificial Sequence
  Description of Artificial Sequence: Synthetic polypeptide
DEECIRTTNPVATEQYGSVSDTNPDQPGNR

SEQ ID NO: 27142 - protein, 28 aa, Artificial Sequence
  Description of Artificial Sequence: Synthetic peptide
DEEEIRTTNPFATEQYGSVSTGEQNGND

SEQ ID NO: 27143 - protein, 30 aa, Artificial Sequence
  Description of Artificial Sequence: Synthetic polypeptide
DEEEIRTTNPCATEQYGSVSTGNLQNGINF

SEQ ID NO: 27144 - protein, 29 aa, Artificial Sequence
  Description of Artificial Sequence: Synthetic peptide
DEIEICTTNPVATEQYGSVSVTNLQGGNI

SEQ ID NO: 27145 - protein, 31 aa, Artificial Sequence
  Description of Artificial Sequence: Synthetic polypeptide
DEEEIRTTNPVATECYGSVSTNLQEVEGNDR

SEQ ID NO: 27146 - protein, 30 aa, Artificial Sequence
  Description of Artificial Sequence: Synthetic polypeptide
DEEEIRTTNPVATEQYGSVSTDLEREGNDF

SEQ ID NO: 27147 - protein, 30 aa, Artificial Sequence
  Description of Artificial Sequence: Synthetic polypeptide
DEEEIRTTNPVATENYGEVSTNLQFRAGNM

SEQ ID NO: 27148 - protein, 28 aa, Artificial Sequence
  Description of Artificial Sequence: Synthetic peptide
DEEEIRATNPVATEIYGVVSTNLQMGNS

SEQ ID NO: 27149 - protein, 29 aa, Artificial Sequence
  Description of Artificial Sequence: Synthetic peptide
DEEEIATTNPVATEQYGSVSTDLQRNGEL

SEQ ID NO: 27150 - protein, 29 aa, Artificial Sequence
  Description of Artificial Sequence: Synthetic peptide
DEQEIATTNPVATEQYGDVSADNLQRGNR

SEQ ID NO: 27151 - protein, 31 aa, Artificial Sequence
  Description of Artificial Sequence: Synthetic polypeptide
DEEEIRTTNPVATEQYGSVSTNLQDVNGNDD

SEQ ID NO: 27152 - protein, 31 aa, Artificial Sequence
  Description of Artificial Sequence: Synthetic polypeptide
DEEEIRTTNPCATEQYGDVSCTNLQQRGGNR

SEQ ID NO: 27153 - protein, 29 aa, Artificial Sequence
  Description of Artificial Sequence: Synthetic peptide
DEHEIRTTNPVATEQYGSISTNTQREGLR

SEQ ID NO: 27154 - protein, 31 aa, Artificial Sequence
  Description of Artificial Sequence: Synthetic polypeptide
DEEEIRTTNPVATEQYGSVSTNNLDQMRENS

SEQ ID NO: 27155 - protein, 28 aa, Artificial Sequence
  Description of Artificial Sequence: Synthetic peptide
KEEEIRTTNPVATECYGSVSTELQQGNL

SEQ ID NO: 27156 - protein, 28 aa, Artificial Sequence
  Description of Artificial Sequence: Synthetic peptide
DESEIRTTNPVATEQYGLVSTNPQFGNS

SEQ ID NO: 27157 - protein, 29 aa, Artificial Sequence
  Description of Artificial Sequence: Synthetic peptide
DEVEIRTTNPVATEQYGCVSDTNLQHGNA

SEQ ID NO: 27158 - protein, 29 aa, Artificial Sequence
  Description of Artificial Sequence: Synthetic peptide
DEEEIRCTNPVATEIYGAVSTNLQPNGNR

SEQ ID NO: 27159 - protein, 28 aa, Artificial Sequence
  Description of Artificial Sequence: Synthetic peptide
GEEEIRATNPVATEQYGSVSTDLQWGND

SEQ ID NO: 27160 - protein, 30 aa, Artificial Sequence
  Description of Artificial Sequence: Synthetic polypeptide
DEEEIRTTNPVATEMYGGVSTNEQDRGDNR

SEQ ID NO: 27161 - protein, 28 aa, Artificial Sequence
  Description of Artificial Sequence: Synthetic peptide
DEEEIRTTNPVATELYGSVSTNEEFGNY

SEQ ID NO: 27162 - protein, 30 aa, Artificial Sequence
  Description of Artificial Sequence: Synthetic polypeptide
DEEEIRTTNPVATEQYGSVSTNLQEQGEDL

SEQ ID NO: 27163 - protein, 28 aa, Artificial Sequence
  Description of Artificial Sequence: Synthetic peptide
GEQEIRTTNPVATECYGSVSTNLQVGNS

SEQ ID NO: 27164 - protein, 29 aa, Artificial Sequence
  Description of Artificial Sequence: Synthetic peptide
DEEEIRTTNPVATEQWGSVSENLMGGNTR

SEQ ID NO: 27165 - protein, 28 aa, Artificial Sequence
  Description of Artificial Sequence: Synthetic peptide
DEEEIRTTNPVATEMYGSVCTVLQRGES

SEQ ID NO: 27166 - protein, 28 aa, Artificial Sequence
  Description of Artificial Sequence: Synthetic peptide
DEQEIRTTNPVATEQYGSVSTDDQRGEF

SEQ ID NO: 27167 - protein, 29 aa, Artificial Sequence
  Description of Artificial Sequence: Synthetic peptide
DEHEIRTTNPVATEQYGSASTNDQRFGNT

SEQ ID NO: 27168 - protein, 29 aa, Artificial Sequence
  Description of Artificial Sequence: Synthetic peptide
DEEEIRTTNPVATEQYGSVSTNLEYGEEE

SEQ ID NO: 27169 - protein, 30 aa, Artificial Sequence
  Description of Artificial Sequence: Synthetic polypeptide
DENEIRTTNPVATEQYGSVSTDLQSMGDNR

SEQ ID NO: 27170 - protein, 28 aa, Artificial Sequence
  Description of Artificial Sequence: Synthetic peptide
DEEEIRTTNPVATEQYGDYSENLQRGDM

SEQ ID NO: 27171 - protein, 32 aa, Artificial Sequence
  Description of Artificial Sequence: Synthetic polypeptide
DEEEIRTTNPVATEQYGSAVDSTTNLQRNGNF

SEQ ID NO: 27172 - protein, 29 aa, Artificial Sequence
  Description of Artificial Sequence: Synthetic peptide
DEGEIRTTNPTATEQYGSVSTNLQNNGNT

SEQ ID NO: 27173 - protein, 28 aa, Artificial Sequence
  Description of Artificial Sequence: Synthetic peptide
DEEEISTTNPVATEQYGDVSEILQRENR

SEQ ID NO: 27174 - protein, 28 aa, Artificial Sequence
  Description of Artificial Sequence: Synthetic peptide
DEEEIRTTNPVATQQYGSVSTPLDPGER

SEQ ID NO: 27175 - protein, 28 aa, Artificial Sequence
  Description of Artificial Sequence: Synthetic peptide
HEQEIRTTNPVATEQYGSVSTPLQSGND

SEQ ID NO: 27176 - protein, 30 aa, Artificial Sequence
  Description of Artificial Sequence: Synthetic polypeptide
DEEEIRTTNPVATEQYGSVSTNLPDPRENT

SEQ ID NO: 27177 - protein, 31 aa, Artificial Sequence
  Description of Artificial Sequence: Synthetic polypeptide
DEEEIRCTNPVATEQYGSVSTNPQRNGDNER

SEQ ID NO: 27178 - protein, 29 aa, Artificial Sequence
  Description of Artificial Sequence: Synthetic peptide
SEEEIRTTNPVATEQFGSVSTNPQDFGNR

SEQ ID NO: 27179 - protein, 30 aa, Artificial Sequence
  Description of Artificial Sequence: Synthetic polypeptide
DEEEIRTTNPVATEQYGSVSTNLEREGDEF

SEQ ID NO: 27180 - protein, 28 aa, Artificial Sequence
  Description of Artificial Sequence: Synthetic peptide
DEEEIATTNPVATEQYGSVSTNEQQGDF

SEQ ID NO: 27181 - protein, 30 aa, Artificial Sequence
  Description of Artificial Sequence: Synthetic polypeptide
DAEEIRTTNPVATEVYGSVSTMNLQRGDNQ

SEQ ID NO: 27182 - protein, 28 aa, Artificial Sequence
  Description of Artificial Sequence: Synthetic peptide
DEEEIACTNPVATEPYGSVSTNLERGNA

SEQ ID NO: 27183 - protein, 29 aa, Artificial Sequence
  Description of Artificial Sequence: Synthetic peptide
DEEEIATTNPVATEQYGGVSSNLQRGPNN

SEQ ID NO: 27184 - protein, 29 aa, Artificial Sequence
  Description of Artificial Sequence: Synthetic peptide
DEECIRTTNPVATEQYGSSVSTNPQQGNF

SEQ ID NO: 27185 - protein, 30 aa, Artificial Sequence
  Description of Artificial Sequence: Synthetic polypeptide
DEEEIRTTNPVATEQYGWVSTELVQRGVDR

SEQ ID NO: 27186 - protein, 28 aa, Artificial Sequence
  Description of Artificial Sequence: Synthetic peptide
DENEIRTTNPVSTEQYGSCSTNLQAGNF

SEQ ID NO: 27187 - protein, 29 aa, Artificial Sequence
  Description of Artificial Sequence: Synthetic peptide
DEEEIVTTNPVATEQYGSVSEDLQLRGER

SEQ ID NO: 27188 - protein, 29 aa, Artificial Sequence
  Description of Artificial Sequence: Synthetic peptide
DENEIRTTNPVATEQWGSVSENLMMRGNR

SEQ ID NO: 27189 - protein, 28 aa, Artificial Sequence
  Description of Artificial Sequence: Synthetic peptide
DEEEIRTTNPVATEQYGSVDEPLQSGDR

SEQ ID NO: 27190 - protein, 30 aa, Artificial Sequence
  Description of Artificial Sequence: Synthetic polypeptide
DEEEISTTNPVATEQYGSVSTLNEQLRGTR

SEQ ID NO: 27191 - protein, 28 aa, Artificial Sequence
  Description of Artificial Sequence: Synthetic peptide
NEEEIRTTNPVAYEVYGSVSNNLERGNR

SEQ ID NO: 27192 - protein, 28 aa, Artificial Sequence
  Description of Artificial Sequence: Synthetic peptide
DEEEIRTTNPVATEQYGDVSEDLQQGNN

SEQ ID NO: 27193 - protein, 29 aa, Artificial Sequence
  Description of Artificial Sequence: Synthetic peptide
DEEEIRTTNPVCTEQYGSVSTNGLQTGTA

SEQ ID NO: 27194 - protein, 28 aa, Artificial Sequence
  Description of Artificial Sequence: Synthetic peptide
DEEEIRTTNPVATEQWGSVSENEQRGTL

SEQ ID NO: 27195 - protein, 28 aa, Artificial Sequence
  Description of Artificial Sequence: Synthetic peptide
AEEEITTTNPVATEQYGSASENLQRGGR

SEQ ID NO: 27196 - protein, 29 aa, Artificial Sequence
  Description of Artificial Sequence: Synthetic peptide
KEEEIRTTNPVATEQYGSVSTDLQREGDA

SEQ ID NO: 27197 - protein, 29 aa, Artificial Sequence
  Description of Artificial Sequence: Synthetic peptide
DEEEIRTTNPVATEQWGSVSTNDMNRGNW

SEQ ID NO: 27198 - protein, 28 aa, Artificial Sequence
  Description of Artificial Sequence: Synthetic peptide
DENEIRTTNPVATECYGSVSTDLERGND

SEQ ID NO: 27199 - protein, 31 aa, Artificial Sequence
  Description of Artificial Sequence: Synthetic polypeptide
DEEEIATTNPVATEQYGSVSTNLQERKGENI

SEQ ID NO: 27200 - protein, 28 aa, Artificial Sequence
  Description of Artificial Sequence: Synthetic peptide
DENEIATTNPVATEQYGWVDTNQQRGNR

SEQ ID NO: 27201 - protein, 30 aa, Artificial Sequence
  Description of Artificial Sequence: Synthetic polypeptide
DEEEIRTTNPVATEIYGSVSDNLQNRNGNN

SEQ ID NO: 27202 - protein, 28 aa, Artificial Sequence
  Description of Artificial Sequence: Synthetic peptide
DEEEIRTTNPVATEQYGSVSTPDDTGNN

SEQ ID NO: 27203 - protein, 28 aa, Artificial Sequence
  Description of Artificial Sequence: Synthetic peptide
DEEEIRSTNPVATEQYGSMSTELQFGER

SEQ ID NO: 27204 - protein, 28 aa, Artificial Sequence
  Description of Artificial Sequence: Synthetic peptide
DEEEIRTTNPVATECYGSVSTNEQLGDS

SEQ ID NO: 27205 - protein, 28 aa, Artificial Sequence
  Description of Artificial Sequence: Synthetic peptide
DEEEIRTTNPDATEQYGSVSTNDDWGNS

SEQ ID NO: 27206 - protein, 28 aa, Artificial Sequence
  Description of Artificial Sequence: Synthetic peptide
DEEEIATTNPVATEQYGSVSTDLEVGNL

SEQ ID NO: 27207 - protein, 28 aa, Artificial Sequence
  Description of Artificial Sequence: Synthetic peptide
KEEEIRTTNPVATECYGEVSENLQRGNM

SEQ ID NO: 27208 - protein, 29 aa, Artificial Sequence
  Description of Artificial Sequence: Synthetic peptide
DEEEIRTTNPVATEQYGSISSMDEQRGNR

SEQ ID NO: 27209 - protein, 28 aa, Artificial Sequence
  Description of Artificial Sequence: Synthetic peptide
DEEEIRATNPVATEQYGSVSFNLQQGTG

SEQ ID NO: 27210 - protein, 28 aa, Artificial Sequence
  Description of Artificial Sequence: Synthetic peptide
DEEEIRSTNPVCTENYGSVSTNLQDGNT

SEQ ID NO: 27211 - protein, 29 aa, Artificial Sequence
  Description of Artificial Sequence: Synthetic peptide
DEEEIRTTNPTATEQYGSVSTNEQNGDNV

SEQ ID NO: 27212 - protein, 29 aa, Artificial Sequence
  Description of Artificial Sequence: Synthetic peptide
DEEEIRTTNPVATECYGSVSTNLEIAGNL

SEQ ID NO: 27213 - protein, 32 aa, Artificial Sequence
  Description of Artificial Sequence: Synthetic polypeptide
DEEEIRTTNPVATECYGSVESTPNLVQREGNR

SEQ ID NO: 27214 - protein, 28 aa, Artificial Sequence
  Description of Artificial Sequence: Synthetic peptide
SEEEIRTTNPTATEQYGSVSENLQQGNF

SEQ ID NO: 27215 - protein, 29 aa, Artificial Sequence
  Description of Artificial Sequence: Synthetic peptide
DEEEIRTTNPVATEQYGSVCPTCLQRENL

SEQ ID NO: 27216 - protein, 30 aa, Artificial Sequence
  Description of Artificial Sequence: Synthetic polypeptide
DEEEIRTTNPVATEQYGSVSTNLQEHGEDW

SEQ ID NO: 27217 - protein, 31 aa, Artificial Sequence
  Description of Artificial Sequence: Synthetic polypeptide
DEEEIRTTNPVATEQYGSVSTNLQEAEGNDT

SEQ ID NO: 27218 - protein, 30 aa, Artificial Sequence
  Description of Artificial Sequence: Synthetic polypeptide
DEEEIRTTNPVATEQYGSVSTNLEDVEGER

SEQ ID NO: 27219 - protein, 30 aa, Artificial Sequence
  Description of Artificial Sequence: Synthetic polypeptide
DEEEIRTTNPVATEWYGSYSTALQRAGENR

SEQ ID NO: 27220 - protein, 28 aa, Artificial Sequence
  Description of Artificial Sequence: Synthetic peptide
AEAEITTTNPVSTEQYGSVSTNLQVGNR

SEQ ID NO: 27221 - protein, 29 aa, Artificial Sequence
  Description of Artificial Sequence: Synthetic peptide
DEHEIRTTNPVATEQYGSADCTDLQRGNR

SEQ ID NO: 27222 - protein, 28 aa, Artificial Sequence
  Description of Artificial Sequence: Synthetic peptide
DEEEIRTTNPCASEIYGAVCTNLQRGNR

SEQ ID NO: 27223 - protein, 29 aa, Artificial Sequence
  Description of Artificial Sequence: Synthetic peptide
DEEEIRTTNPVATEQYGSVSENLQDGGDS

SEQ ID NO: 27224 - protein, 28 aa, Artificial Sequence
  Description of Artificial Sequence: Synthetic peptide
DEEEIRTTNPVATECWGSVSTDLQRGEI

SEQ ID NO: 27225 - protein, 28 aa, Artificial Sequence
  Description of Artificial Sequence: Synthetic peptide
DEEEIYTTNPVATEQYGSTSTNVQQGNV

SEQ ID NO: 27226 - protein, 28 aa, Artificial Sequence
  Description of Artificial Sequence: Synthetic peptide
DEEEIRTTNPVATEQYGDVSEIEQRGDR

SEQ ID NO: 27227 - protein, 31 aa, Artificial Sequence
  Description of Artificial Sequence: Synthetic polypeptide
DEEEIRTTNPVATEQYGSVSTNLPESFGNDR

SEQ ID NO: 27228 - protein, 31 aa, Artificial Sequence
  Description of Artificial Sequence: Synthetic polypeptide
DEEEIRTTNPVATEQYGSVSTANLQELGNTV

SEQ ID NO: 27229 - protein, 28 aa, Artificial Sequence
  Description of Artificial Sequence: Synthetic peptide
DEEEIRTTNPVATEQYGSVSTEEQHGEE

SEQ ID NO: 27230 - protein, 31 aa, Artificial Sequence
  Description of Artificial Sequence: Synthetic polypeptide
DEEEIRTTNPTATEQYGSVSTNLQDRGVNDF

SEQ ID NO: 27231 - protein, 28 aa, Artificial Sequence
  Description of Artificial Sequence: Synthetic peptide
DEEEIATTNPIATEQYGSVSTNEQIGNN

SEQ ID NO: 27232 - protein, 31 aa, Artificial Sequence
  Description of Artificial Sequence: Synthetic polypeptide
DEEEIRTTNPVATEQYGSVSETNGLDYGDNR

SEQ ID NO: 27233 - protein, 28 aa, Artificial Sequence
  Description of Artificial Sequence: Synthetic peptide
DEEEIRTTNPVATEQYGSVSTAPQFGEN

SEQ ID NO: 27234 - protein, 28 aa, Artificial Sequence
  Description of Artificial Sequence: Synthetic peptide
DEEEIRTTNPVATECYGSVSTNEMQGNQ

SEQ ID NO: 27235 - protein, 28 aa, Artificial Sequence
  Description of Artificial Sequence: Synthetic peptide
QEEEIRATNPVATEQYGSVSTNDQQGPR

SEQ ID NO: 27236 - protein, 28 aa, Artificial Sequence
  Description of Artificial Sequence: Synthetic peptide
DENEIAATNPVATEVYGWVSTNLQRGNR

SEQ ID NO: 27237 - protein, 30 aa, Artificial Sequence
  Description of Artificial Sequence: Synthetic polypeptide
DEEEIRTTNPVATECYGSVSMELQDRGNDR

SEQ ID NO: 27238 - protein, 28 aa, Artificial Sequence
  Description of Artificial Sequence: Synthetic peptide
DEEEIRSTNPVATEQWGSVSENEQRGNP

SEQ ID NO: 27239 - protein, 28 aa, Artificial Sequence
  Description of Artificial Sequence: Synthetic peptide
MENEIRTTNPVATECYGSVSTNLQNGND

SEQ ID NO: 27240 - protein, 28 aa, Artificial Sequence
  Description of Artificial Sequence: Synthetic peptide
DEEEIRTTNPVGTEQYGSVSNPLERGMR

SEQ ID NO: 27241 - protein, 28 aa, Artificial Sequence
  Description of Artificial Sequence: Synthetic peptide
DEDEIATTNPVATELYGSVSTNGQRGTR

SEQ ID NO: 27242 - protein, 28 aa, Artificial Sequence
  Description of Artificial Sequence: Synthetic peptide
DEEEIRTTNPVATEQYGDVSEDLQAGNQ

SEQ ID NO: 27243 - protein, 29 aa, Artificial Sequence
  Description of Artificial Sequence: Synthetic peptide
DEEEIRCTNPVATEQYGSVDTNLENVGNR

SEQ ID NO: 27244 - protein, 28 aa, Artificial Sequence
  Description of Artificial Sequence: Synthetic peptide
DEEEIATTNPVATEQYGSVSTDLQHGET

SEQ ID NO: 27245 - protein, 28 aa, Artificial Sequence
  Description of Artificial Sequence: Synthetic peptide
DEEEIRTTNPVATECYGSVSTELQVGEI

SEQ ID NO: 27246 - protein, 32 aa, Artificial Sequence
  Description of Artificial Sequence: Synthetic polypeptide
DEEEIATTNPVATEQYGSVSETPNLQDRGNTR

SEQ ID NO: 27247 - protein, 30 aa, Artificial Sequence
  Description of Artificial Sequence: Synthetic polypeptide
DEQEIRTTNPVATEVYGCVSATNLQREGNR

SEQ ID NO: 27248 - protein, 31 aa, Artificial Sequence
  Description of Artificial Sequence: Synthetic polypeptide
DEEEIRTTNPCATEQYGSVSCTMNEQRFGNR

SEQ ID NO: 27249 - protein, 30 aa, Artificial Sequence
  Description of Artificial Sequence: Synthetic polypeptide
DEEEIATTNPVATEQYGVVSTNLQYGENDR

SEQ ID NO: 27250 - protein, 28 aa, Artificial Sequence
  Description of Artificial Sequence: Synthetic peptide
DEEEIRTTNPVATEQYGGVSTPLDHGNW

SEQ ID NO: 27251 - protein, 28 aa, Artificial Sequence
  Description of Artificial Sequence: Synthetic peptide
VEEEIRTTNPTATEHYGSVSTDLERGNR

SEQ ID NO: 27252 - protein, 28 aa, Artificial Sequence
  Description of Artificial Sequence: Synthetic peptide
DEECIRTTNPVATEQFGWVSTNPQRGND

SEQ ID NO: 27253 - protein, 28 aa, Artificial Sequence
  Description of Artificial Sequence: Synthetic peptide
DENEIRTTNPVATEQWGSVSTNEMQGNR

SEQ ID NO: 27254 - protein, 29 aa, Artificial Sequence
  Description of Artificial Sequence: Synthetic peptide
DEDEIRTTNPVATEQYGSVSTDLQAGDDR

SEQ ID NO: 27255 - protein, 28 aa, Artificial Sequence
  Description of Artificial Sequence: Synthetic peptide
DESEIACTNPVATEQYGVVGTNLQRGNR

SEQ ID NO: 27256 - protein, 29 aa, Artificial Sequence
  Description of Artificial Sequence: Synthetic peptide
SEEEIATTNPVATEQFGSVSTMNLQRGNF

SEQ ID NO: 27257 - protein, 28 aa, Artificial Sequence
  Description of Artificial Sequence: Synthetic peptide
MEEEIATTNPVATEQYGSVSTELQTGNS

SEQ ID NO: 27258 - protein, 28 aa, Artificial Sequence
  Description of Artificial Sequence: Synthetic peptide
DEEEIRCTNPIATEQYGSVSTNDQVGPR

SEQ ID NO: 27259 - protein, 28 aa, Artificial Sequence
  Description of Artificial Sequence: Synthetic peptide
DEEEIRTTNPDATEQYGSVSTGLFGGND

SEQ ID NO: 27260 - protein, 28 aa, Artificial Sequence
  Description of Artificial Sequence: Synthetic peptide
DEHEIRTTNPVATEQYGSVSTNDETGNS

SEQ ID NO: 27261 - protein, 28 aa, Artificial Sequence
  Description of Artificial Sequence: Synthetic peptide
DEEEIATTNPTATEQYGSVSTNEQNGNV

SEQ ID NO: 27262 - protein, 29 aa, Artificial Sequence
  Description of Artificial Sequence: Synthetic peptide
DEEEIRTTNPVATEQYGFVSTSFLDTGNR

SEQ ID NO: 27263 - protein, 28 aa, Artificial Sequence
  Description of Artificial Sequence: Synthetic peptide
DEEEIATTNPVATEVYGSVSEELQVGNR

SEQ ID NO: 27264 - protein, 28 aa, Artificial Sequence
  Description of Artificial Sequence: Synthetic peptide
DEEEIYTTNPVATEQYGCVCTNEQRGNF

SEQ ID NO: 27265 - protein, 28 aa, Artificial Sequence
  Description of Artificial Sequence: Synthetic peptide
DEEEIVTTNPVATEQYGSVSDNLERGQA

SEQ ID NO: 27266 - protein, 30 aa, Artificial Sequence
  Description of Artificial Sequence: Synthetic polypeptide
DEEEIRTTNPVATEQYGVVSETNLQPNGER

SEQ ID NO: 27267 - protein, 28 aa, Artificial Sequence
  Description of Artificial Sequence: Synthetic peptide
DEEEIRTTNPVATEMYGSMATNLQDGNY

SEQ ID NO: 27268 - protein, 28 aa, Artificial Sequence
  Description of Artificial Sequence: Synthetic peptide
DEEEIRTTNPVASEQYGCVSTNLEPPNR

SEQ ID NO: 27269 - protein, 31 aa, Artificial Sequence
  Description of Artificial Sequence: Synthetic polypeptide
DEFSIRTTNPVATEQYGSVSTNPLQDRGDNR

SEQ ID NO: 27270 - protein, 28 aa, Artificial Sequence
  Description of Artificial Sequence: Synthetic peptide
QEEEIRTTNPVATEQYGSVSTHLEPGNM

SEQ ID NO: 27271 - protein, 29 aa, Artificial Sequence
  Description of Artificial Sequence: Synthetic peptide
DEEEIRTTNPVATECYGSVSTDLQVGNDY

SEQ ID NO: 27272 - protein, 28 aa, Artificial Sequence
  Description of Artificial Sequence: Synthetic peptide
DEEEIRTTNPVATEQYGSVDTGPNRGDR

SEQ ID NO: 27273 - protein, 29 aa, Artificial Sequence
  Description of Artificial Sequence: Synthetic peptide
DEEEIRTTNPVATEQYGSVSDNLQEHGEN

SEQ ID NO: 27274 - protein, 30 aa, Artificial Sequence
  Description of Artificial Sequence: Synthetic polypeptide
DEQEIATTNPVATEQYGSVSATNLQREGNL

SEQ ID NO: 27275 - protein, 29 aa, Artificial Sequence
  Description of Artificial Sequence: Synthetic peptide
DEEEIRQTNPVATEQYGSVSENLQRAGEK

SEQ ID NO: 27276 - protein, 29 aa, Artificial Sequence
  Description of Artificial Sequence: Synthetic peptide
DDEELRTTNPVATEQYGSVSTNNDNRGNR

SEQ ID NO: 27277 - protein, 31 aa, Artificial Sequence
  Description of Artificial Sequence: Synthetic polypeptide
DEEEIRTTNPVATEQYGSVSTQGLIQIRGER

SEQ ID NO: 27278 - protein, 30 aa, Artificial Sequence
  Description of Artificial Sequence: Synthetic polypeptide
DENEIRTTNPVATEQYGSVSTNLQTEGNDL

SEQ ID NO: 27279 - protein, 28 aa, Artificial Sequence
  Description of Artificial Sequence: Synthetic peptide
DEEEIRCTNPVASEIYGSVSTNLEVGNR

SEQ ID NO: 27280 - protein, 29 aa, Artificial Sequence
  Description of Artificial Sequence: Synthetic peptide
DDEEIRTTNPVATECYGSVSTNLQQGNDM

SEQ ID NO: 27281 - protein, 29 aa, Artificial Sequence
  Description of Artificial Sequence: Synthetic peptide
DEEEIRTTNPVATEQYGSVDTMDEQRGNH

SEQ ID NO: 27282 - protein, 30 aa, Artificial Sequence
  Description of Artificial Sequence: Synthetic polypeptide
DEDEIRTTNPVATEQYGWVSATDLQRGNLR

SEQ ID NO: 27283 - protein, 28 aa, Artificial Sequence
  Description of Artificial Sequence: Synthetic peptide
DEEEIRCTNPVATEIYGSVSNNLERPNR

SEQ ID NO: 27284 - protein, 28 aa, Artificial Sequence
  Description of Artificial Sequence: Synthetic peptide
DEEEIRTTNPVATEQYGSSSTPLQQGPS

SEQ ID NO: 27285 - protein, 30 aa, Artificial Sequence
  Description of Artificial Sequence: Synthetic polypeptide
DEEEIRTTNPVATEMYGTVCSTNDQVRGNR

SEQ ID NO: 27286 - protein, 30 aa, Artificial Sequence
  Description of Artificial Sequence: Synthetic polypeptide
DDEEIRATNPVATEQYGSVSTNLQREGNDY

SEQ ID NO: 27287 - protein, 31 aa, Artificial Sequence
  Description of Artificial Sequence: Synthetic polypeptide
DEEEIRTTNPVATEQYGSVSTPNPLQRGDEP

SEQ ID NO: 27288 - protein, 28 aa, Artificial Sequence
  Description of Artificial Sequence: Synthetic peptide
DEEELRTTNPVATEQWGSVSAITQRGNR

SEQ ID NO: 27289 - protein, 28 aa, Artificial Sequence
  Description of Artificial Sequence: Synthetic peptide
DDEEVACTNPVATEQYGSVSTNLQRLNR

SEQ ID NO: 27290 - protein, 30 aa, Artificial Sequence
  Description of Artificial Sequence: Synthetic polypeptide
DEEEIRTTNPVATEQYGSVSENNLNRDGDR

SEQ ID NO: 27291 - protein, 30 aa, Artificial Sequence
  Description of Artificial Sequence: Synthetic polypeptide
DEQEIRTTNPVATEQYGSVSETNLEDRGNL

SEQ ID NO: 27292 - protein, 30 aa, Artificial Sequence
  Description of Artificial Sequence: Synthetic polypeptide
MEEEIRTTNPVATEQYGSVSTNLQNEGNDM

SEQ ID NO: 27293 - protein, 30 aa, Artificial Sequence
  Description of Artificial Sequence: Synthetic polypeptide
DEEEIRTTNPVATEQYGSVSEMNLQNGDNV

SEQ ID NO: 27294 - protein, 32 aa, Artificial Sequence
  Description of Artificial Sequence: Synthetic polypeptide
DEEEIRTTNPVATEQYGSVSTPDPLQRGDNDR

SEQ ID NO: 27295 - protein, 30 aa, Artificial Sequence
  Description of Artificial Sequence: Synthetic polypeptide
DEEEIRTTNPVATEIYGSVCSENLQLGNSR

SEQ ID NO: 27296 - protein, 32 aa, Artificial Sequence
  Description of Artificial Sequence: Synthetic polypeptide
DEEEIRTTNPVATEQYGSVDSTINDQERNGNR

SEQ ID NO: 27297 - protein, 28 aa, Artificial Sequence
  Description of Artificial Sequence: Synthetic peptide
DEEEIRCTNPVATEQYGSVSTNLDNGEY

SEQ ID NO: 27298 - protein, 28 aa, Artificial Sequence
  Description of Artificial Sequence: Synthetic peptide
DEEELRTTNPVATEWYGSVSEGLQRGNL

SEQ ID NO: 27299 - protein, 30 aa, Artificial Sequence
  Description of Artificial Sequence: Synthetic polypeptide
DEEEIRATNPVATEQYGAVSTNLQERGNDE

SEQ ID NO: 27300 - protein, 29 aa, Artificial Sequence
  Description of Artificial Sequence: Synthetic peptide
NNEEIRTTNPVATEQYGVVSTNLQDGPNR

SEQ ID NO: 27301 - protein, 28 aa, Artificial Sequence
  Description of Artificial Sequence: Synthetic peptide
DENEIRTTNPVATEQWGDVSENEQRGNR

SEQ ID NO: 27302 - protein, 28 aa, Artificial Sequence
  Description of Artificial Sequence: Synthetic peptide
DEEELRTTNPVATEQYGDVSENLQHGNG

SEQ ID NO: 27303 - protein, 28 aa, Artificial Sequence
  Description of Artificial Sequence: Synthetic peptide
DECEIRTTNPVATEQYGSVSMNDQQGNS

SEQ ID NO: 27304 - protein, 28 aa, Artificial Sequence
  Description of Artificial Sequence: Synthetic peptide
DEEEIRCTNPVATELYGSVSTNDQVGDR

SEQ ID NO: 27305 - protein, 28 aa, Artificial Sequence
  Description of Artificial Sequence: Synthetic peptide
QEEEIRTTNPVATEQYGDASTNLQHENR

SEQ ID NO: 27306 - protein, 30 aa, Artificial Sequence
  Description of Artificial Sequence: Synthetic polypeptide
KEEEIRTTNPVATEQYGSVSTNLQEREGDL

SEQ ID NO: 27307 - protein, 30 aa, Artificial Sequence
  Description of Artificial Sequence: Synthetic polypeptide
DENEIRTTNPVATEQYGSVGSTNDQDMGNR

SEQ ID NO: 27308 - protein, 28 aa, Artificial Sequence
  Description of Artificial Sequence: Synthetic peptide
DEEEIRATNPVATEQYGAVGTADQRGNR

SEQ ID NO: 27309 - protein, 28 aa, Artificial Sequence
  Description of Artificial Sequence: Synthetic peptide
DEEEIRTTNPVATEQWGSVSTNEMQGNQ

SEQ ID NO: 27310 - protein, 28 aa, Artificial Sequence
  Description of Artificial Sequence: Synthetic peptide
DEEEIRCTNPVATEQYGTVDTNDQTGNR

SEQ ID NO: 27311 - protein, 28 aa, Artificial Sequence
  Description of Artificial Sequence: Synthetic peptide
DEEEIRTVNPVSYEQYGSVGTNLERGNR

SEQ ID NO: 27312 - protein, 28 aa, Artificial Sequence
  Description of Artificial Sequence: Synthetic peptide
DENEIRTTNPVATEQYGSVSTDLQQGEM

SEQ ID NO: 27313 - protein, 31 aa, Artificial Sequence
  Description of Artificial Sequence: Synthetic polypeptide
DEEEIRTTNPVATEQYGSVSTNLQEQEGNDY

SEQ ID NO: 27314 - protein, 28 aa, Artificial Sequence
  Description of Artificial Sequence: Synthetic peptide
DEQEIRTTNPVATEQYGDVSEELQRGNN

SEQ ID NO: 27315 - protein, 28 aa, Artificial Sequence
  Description of Artificial Sequence: Synthetic peptide
DEEEIRTTNPVATEQWGSVSENEQTGNM

SEQ ID NO: 27316 - protein, 28 aa, Artificial Sequence
  Description of Artificial Sequence: Synthetic peptide
KEEEIRTTNPVATEQYGSVSTELQVGEN

SEQ ID NO: 27317 - protein, 28 aa, Artificial Sequence
  Description of Artificial Sequence: Synthetic peptide
DEEEIRQTNPVATECYGSVSTNLQVGDA

SEQ ID NO: 27318 - protein, 30 aa, Artificial Sequence
  Description of Artificial Sequence: Synthetic polypeptide
DEEEIRATNPVATEQYGSVISTGLYREGNR

SEQ ID NO: 27319 - protein, 28 aa, Artificial Sequence
  Description of Artificial Sequence: Synthetic peptide
DEEEIRTTNPVATEQYGSHSQNDSRGER

SEQ ID NO: 27320 - protein, 28 aa, Artificial Sequence
  Description of Artificial Sequence: Synthetic peptide
DEEEIRCTNPVATEQYGSVSTNPAFGNF

SEQ ID NO: 27321 - protein, 29 aa, Artificial Sequence
  Description of Artificial Sequence: Synthetic peptide
DEEEIRTTNPVATEQYGSVSENLQDIGDS

SEQ ID NO: 27322 - protein, 30 aa, Artificial Sequence
  Description of Artificial Sequence: Synthetic polypeptide
DEEEIRTTNPVATEQYGSVSTENLEDEGNF

SEQ ID NO: 27323 - protein, 30 aa, Artificial Sequence
  Description of Artificial Sequence: Synthetic polypeptide
DDEEIRTTNPVATEQYGSCSDNLQREGNDR

SEQ ID NO: 27324 - protein, 29 aa, Artificial Sequence
  Description of Artificial Sequence: Synthetic peptide
DEEEIRTVNPVATEQYGSVSEDLQDIGNR

SEQ ID NO: 27325 - protein, 28 aa, Artificial Sequence
  Description of Artificial Sequence: Synthetic peptide
DEQEIVATNPVATEIYGVVSTNLQRGNR

SEQ ID NO: 27326 - protein, 28 aa, Artificial Sequence
  Description of Artificial Sequence: Synthetic peptide
DEEEIRTTNPVATEQYGSVSTEPDYGNL

SEQ ID NO: 27327 - protein, 28 aa, Artificial Sequence
  Description of Artificial Sequence: Synthetic peptide
HEHEIRCTNPVASEQYGSVSTNLQNGNR

SEQ ID NO: 27328 - protein, 28 aa, Artificial Sequence
  Description of Artificial Sequence: Synthetic peptide
DEEEIRTTNPIATELYGYVSTNEQRGNF

SEQ ID NO: 27329 - protein, 30 aa, Artificial Sequence
  Description of Artificial Sequence: Synthetic polypeptide
DENEIRTTNPVATEQYGSVDCTNLQRFGNT

SEQ ID NO: 27330 - protein, 30 aa, Artificial Sequence
  Description of Artificial Sequence: Synthetic polypeptide
DEEEIRTTNPVATEQYGSVSTADLQFGNAA

SEQ ID NO: 27331 - protein, 29 aa, Artificial Sequence
  Description of Artificial Sequence: Synthetic peptide
DEEEIRTTNPVATEQYGSVPENLQAGLLR

SEQ ID NO: 27332 - protein, 31 aa, Artificial Sequence
  Description of Artificial Sequence: Synthetic polypeptide
DEEEITTTNPVATEQYGVVSTNLQDRKGNPR

SEQ ID NO: 27333 - protein, 30 aa, Artificial Sequence
  Description of Artificial Sequence: Synthetic polypeptide
DEEEIRTTNPVATEQYGSVETGLDRNGDNR

SEQ ID NO: 27334 - protein, 28 aa, Artificial Sequence
  Description of Artificial Sequence: Synthetic peptide
QEQEIRTTNPVATEQYGSVSTNWQRGTF

SEQ ID NO: 27335 - protein, 29 aa, Artificial Sequence
  Description of Artificial Sequence: Synthetic peptide
DEVEIRTTNPVATEQYGSVSENEQDQGNR

SEQ ID NO: 27336 - protein, 28 aa, Artificial Sequence
  Description of Artificial Sequence: Synthetic peptide
DEECIRTTNPVATEQYGSVHENLQDMNR

SEQ ID NO: 27337 - protein, 30 aa, Artificial Sequence
  Description of Artificial Sequence: Synthetic polypeptide
AEEEIRQTNPVATEQYGSVSTNPLQHGNDR

SEQ ID NO: 27338 - protein, 28 aa, Artificial Sequence
  Description of Artificial Sequence: Synthetic peptide
DEEEIRTTNPVATEQYGSVSTNLLYEDD

SEQ ID NO: 27339 - protein, 28 aa, Artificial Sequence
  Description of Artificial Sequence: Synthetic peptide
DEEEIATTNPVATEQYGSVSTGLEHGNQ

SEQ ID NO: 27340 - protein, 31 aa, Artificial Sequence
  Description of Artificial Sequence: Synthetic polypeptide
DEEEIRTTNPVATEQYGSVSTNLQDQEGNDL

SEQ ID NO: 27341 - protein, 29 aa, Artificial Sequence
  Description of Artificial Sequence: Synthetic peptide
DEEEIRTTNPVATEQWGSVSTNEQMVGNL

SEQ ID NO: 27342 - protein, 28 aa, Artificial Sequence
  Description of Artificial Sequence: Synthetic peptide
DEDEIRTTNPEATEVYGSVSTNLQRGQH

SEQ ID NO: 27343 - protein, 28 aa, Artificial Sequence
  Description of Artificial Sequence: Synthetic peptide
DEEEIRQTNPVATEQYGSVSTELQAGET

SEQ ID NO: 27344 - protein, 28 aa, Artificial Sequence
  Description of Artificial Sequence: Synthetic peptide
DEEEIRCTNPVATEMYGCVSTNLERGNF

SEQ ID NO: 27345 - protein, 30 aa, Artificial Sequence
  Description of Artificial Sequence: Synthetic polypeptide
DEEEIRTTNPVATEQYGSVSATNLQIGTHG

SEQ ID NO: 27346 - protein, 28 aa, Artificial Sequence
  Description of Artificial Sequence: Synthetic peptide
GEEEIRCTNPVATEQYGSVSNNLEYGNR

SEQ ID NO: 27347 - protein, 30 aa, Artificial Sequence
  Description of Artificial Sequence: Synthetic polypeptide
DEEEIRTTNPVATEIYGSVSTALQFRGTDR

SEQ ID NO: 27348 - protein, 28 aa, Artificial Sequence
  Description of Artificial Sequence: Synthetic peptide
DEEEIRSTNPVATEQYGQVSTGLQRLTR

SEQ ID NO: 27349 - protein, 29 aa, Artificial Sequence
  Description of Artificial Sequence: Synthetic peptide
DEEEIRTTNPTATEQYGSVSTSPLQRENG

SEQ ID NO: 27350 - protein, 28 aa, Artificial Sequence
  Description of Artificial Sequence: Synthetic peptide
DEEEICCTNPVCTEQYGSVSTGLQQGNR

SEQ ID NO: 27351 - protein, 28 aa, Artificial Sequence
  Description of Artificial Sequence: Synthetic peptide
DEEEIRTVNPVATETYGEVSTVLQRGNH

SEQ ID NO: 27352 - protein, 28 aa, Artificial Sequence
  Description of Artificial Sequence: Synthetic peptide
DENEIRTTNPVATEQWGSVSENLQIGNA

SEQ ID NO: 27353 - protein, 28 aa, Artificial Sequence
  Description of Artificial Sequence: Synthetic peptide
DEEEIRTTNPVATEQYGDVSTNEQQGIT

SEQ ID NO: 27354 - protein, 28 aa, Artificial Sequence
  Description of Artificial Sequence: Synthetic peptide
QENEIRTTNPVATEQYGSVSTNLQHGES

SEQ ID NO: 27355 - protein, 29 aa, Artificial Sequence
  Description of Artificial Sequence: Synthetic peptide
DEEEIRTTNPVATEQYGSVSTNEMNQGNF

SEQ ID NO: 27356 - protein, 28 aa, Artificial Sequence
  Description of Artificial Sequence: Synthetic peptide
DEEEIRTTNPFATEQYGSVSTADQRDDR

SEQ ID NO: 27357 - protein, 29 aa, Artificial Sequence
  Description of Artificial Sequence: Synthetic peptide
DEQEIRTTNPVATEQYGSVSTNEQMQGNW

SEQ ID NO: 27358 - protein, 28 aa, Artificial Sequence
  Description of Artificial Sequence: Synthetic peptide
DEEEIRTTNPVCTEQYGGVSVGEQRGNR

SEQ ID NO: 27359 - protein, 30 aa, Artificial Sequence
  Description of Artificial Sequence: Synthetic polypeptide
DEEEIRTTNPVATEQYGSVDDAENLERGNR

SEQ ID NO: 27360 - protein, 28 aa, Artificial Sequence
  Description of Artificial Sequence: Synthetic peptide
DEEEIRTTNPVCTEQYGSVSANGQRGTA

SEQ ID NO: 27361 - protein, 30 aa, Artificial Sequence
  Description of Artificial Sequence: Synthetic polypeptide
DTEEIRTTNPVATEQYGSVASTNLDRKGNE

SEQ ID NO: 27362 - protein, 28 aa, Artificial Sequence
  Description of Artificial Sequence: Synthetic peptide
DEEEIRTTNPVATEQWGSVSENEMRGNA

SEQ ID NO: 27363 - protein, 28 aa, Artificial Sequence
  Description of Artificial Sequence: Synthetic peptide
DEQEIRTTNPVATEQYGSVETDLQRGDH

SEQ ID NO: 27364 - protein, 29 aa, Artificial Sequence
  Description of Artificial Sequence: Synthetic peptide
DEEEIVTTNPVATECYGSVSETNLEYGNR

SEQ ID NO: 27365 - protein, 29 aa, Artificial Sequence
  Description of Artificial Sequence: Synthetic peptide
MEEEIRTTNPVATEQYGSVSTDLQNGNDI

SEQ ID NO: 27366 - protein, 29 aa, Artificial Sequence
  Description of Artificial Sequence: Synthetic peptide
DEEEIRTTNPVATEQYGSVSDNLQISEDR

SEQ ID NO: 27367 - protein, 29 aa, Artificial Sequence
  Description of Artificial Sequence: Synthetic peptide
DEDEIAQTNPVATEQYGSVSTNLQRGPNK

SEQ ID NO: 27368 - protein, 28 aa, Artificial Sequence
  Description of Artificial Sequence: Synthetic peptide
DEEEIRTTNPDATEQYGSVSTPLDPGNG

SEQ ID NO: 27369 - protein, 28 aa, Artificial Sequence
  Description of Artificial Sequence: Synthetic peptide
DEEEIWTTNPVATEQYGEVSTNEQREER

SEQ ID NO: 27370 - protein, 28 aa, Artificial Sequence
  Description of Artificial Sequence: Synthetic peptide
SEVEIRTTNPVATEQYGGVSTNLQQGNF

SEQ ID NO: 27371 - protein, 31 aa, Artificial Sequence
  Description of Artificial Sequence: Synthetic polypeptide
DEEEIRTTNPFATEQYGSVSTNLVDLRGENR

SEQ ID NO: 27372 - protein, 31 aa, Artificial Sequence
  Description of Artificial Sequence: Synthetic polypeptide
DEEEIRTTNPVATEQYGSVSTNLQDHEGEDR

SEQ ID NO: 27373 - protein, 29 aa, Artificial Sequence
  Description of Artificial Sequence: Synthetic peptide
DEEEIRTTNPCATEQYGSVSTNFQRPNEF

SEQ ID NO: 27374 - protein, 28 aa, Artificial Sequence
  Description of Artificial Sequence: Synthetic peptide
QEEEIRTTNPVATEQYGSVSTPLQLGEM

SEQ ID NO: 27375 - protein, 28 aa, Artificial Sequence
  Description of Artificial Sequence: Synthetic peptide
DEEEIRTTNPVATEQWGSVSENEQTGNL

SEQ ID NO: 27376 - protein, 32 aa, Artificial Sequence
  Description of Artificial Sequence: Synthetic polypeptide
DEEEIRTTNPVATEQYGESVSTVNEQERGNER

SEQ ID NO: 27377 - protein, 32 aa, Artificial Sequence
  Description of Artificial Sequence: Synthetic polypeptide
DEEEIRTTNPVATEQYGSVSDTTGLQLRGENR

SEQ ID NO: 27378 - protein, 32 aa, Artificial Sequence
  Description of Artificial Sequence: Synthetic polypeptide
DEEEIRTTNPVATEQYGSVSTANLIEIRDGNR

SEQ ID NO: 27379 - protein, 28 aa, Artificial Sequence
  Description of Artificial Sequence: Synthetic peptide
DDDEIRTTNPVATEQYGSISCNLQHGNR

SEQ ID NO: 27380 - protein, 29 aa, Artificial Sequence
  Description of Artificial Sequence: Synthetic peptide
DEEEIQTTNPVATEQYGSVSETLQERGNQ

SEQ ID NO: 27381 - protein, 31 aa, Artificial Sequence
  Description of Artificial Sequence: Synthetic polypeptide
DEEEIRTTNPVATEQYGSVSSTNLQVVGNQS

SEQ ID NO: 27382 - protein, 29 aa, Artificial Sequence
  Description of Artificial Sequence: Synthetic peptide
EEEEIRTTNPVATEQYGIVISDNLQNGNR

SEQ ID NO: 27383 - protein, 28 aa, Artificial Sequence
  Description of Artificial Sequence: Synthetic peptide
DEEEIATTNPVATEQYGSVSTDLQYGED

SEQ ID NO: 27384 - protein, 28 aa, Artificial Sequence
  Description of Artificial Sequence: Synthetic peptide
DENEIRTTNPVATEQWGSVSTIEQQGNR

SEQ ID NO: 27385 - protein, 28 aa, Artificial Sequence
  Description of Artificial Sequence: Synthetic peptide
DEQEIRTTNPVATEQYGSVSENEQIGNF

SEQ ID NO: 27386 - protein, 28 aa, Artificial Sequence
  Description of Artificial Sequence: Synthetic peptide
SEEEIRTTNPVATEQYGSVSTNEQLGTS

SEQ ID NO: 27387 - protein, 31 aa, Artificial Sequence
  Description of Artificial Sequence: Synthetic polypeptide
DEEEIRTTNPVATEQYGSVSTNLQDIEGNDV

SEQ ID NO: 27388 - protein, 29 aa, Artificial Sequence
  Description of Artificial Sequence: Synthetic peptide
DEEEIRTTNPVATEHFGGVSTANLQRGNQ

SEQ ID NO: 27389 - protein, 28 aa, Artificial Sequence
  Description of Artificial Sequence: Synthetic peptide
DENEIATTNPVATEQYGSVSTDLQNGNM

SEQ ID NO: 27390 - protein, 28 aa, Artificial Sequence
  Description of Artificial Sequence: Synthetic peptide
DEEEIRTTNPVCVEQYGSVSTNDQNGNQ

SEQ ID NO: 27391 - protein, 31 aa, Artificial Sequence
  Description of Artificial Sequence: Synthetic polypeptide
DEEEIRTTNPVATEQYGSVSTEPLQVRDGNE

SEQ ID NO: 27392 - protein, 28 aa, Artificial Sequence
  Description of Artificial Sequence: Synthetic peptide
TEEGIRTTNPVATEQYGSVSTNLSMLNR

SEQ ID NO: 27393 - protein, 29 aa, Artificial Sequence
  Description of Artificial Sequence: Synthetic peptide
DEDEIRTTNPVATEGYGSVSTVLMRGPNR

SEQ ID NO: 27394 - protein, 29 aa, Artificial Sequence
  Description of Artificial Sequence: Synthetic peptide
DEEEIRTVNPVATEQYGSVSTDLQNGNDA

SEQ ID NO: 27395 - protein, 28 aa, Artificial Sequence
  Description of Artificial Sequence: Synthetic peptide
DEEEIATTNPTATEQYGSVSTNEQNGNQ

SEQ ID NO: 27396 - protein, 31 aa, Artificial Sequence
  Description of Artificial Sequence: Synthetic polypeptide
DEEEIRTTNPVATEQYGSVSTANEQENGNTR

SEQ ID NO: 27397 - protein, 30 aa, Artificial Sequence
  Description of Artificial Sequence: Synthetic polypeptide
DEEEIRTTNPVATEQWGSVSTNDMLRGNDR

SEQ ID NO: 27398 - protein, 28 aa, Artificial Sequence
  Description of Artificial Sequence: Synthetic peptide
DEEEIRTTNPVATECYGSVSTDLQTGET

SEQ ID NO: 27399 - protein, 29 aa, Artificial Sequence
  Description of Artificial Sequence: Synthetic peptide
DEEEIRTTNPVATELYGDVSTNEQNQGNR

SEQ ID NO: 27400 - protein, 28 aa, Artificial Sequence
  Description of Artificial Sequence: Synthetic peptide
NEEEIRTTNPVAYEIYGSVSTNWQRGNP

SEQ ID NO: 27401 - protein, 30 aa, Artificial Sequence
  Description of Artificial Sequence: Synthetic polypeptide
SEEEIRTTNPVATEQYGSVSTANPQDRGNF

SEQ ID NO: 27402 - protein, 30 aa, Artificial Sequence
  Description of Artificial Sequence: Synthetic polypeptide
DEEEIRTTNPVATEQYGSVSTDLQDREGEN

SEQ ID NO: 27403 - protein, 29 aa, Artificial Sequence
  Description of Artificial Sequence: Synthetic peptide
DEEEIRTTNPVATEQWGSVSTNEMMIGNR

SEQ ID NO: 27404 - protein, 29 aa, Artificial Sequence
  Description of Artificial Sequence: Synthetic peptide
DEEEIRTTNPVATEQYGSVSENEQMQGNW

SEQ ID NO: 27405 - protein, 29 aa, Artificial Sequence
  Description of Artificial Sequence: Synthetic peptide
MEEEIRTTNPVATECYGSVSTNLQNEGNM

SEQ ID NO: 27406 - protein, 28 aa, Artificial Sequence
  Description of Artificial Sequence: Synthetic peptide
DEEEIRCTNPTATEIYGSVSTNEQFGNR

SEQ ID NO: 27407 - protein, 33 aa, Artificial Sequence
  Description of Artificial Sequence: Synthetic polypeptide
DEEEIRTTNPVATEQYGSVDSTENLVQEREGNR

SEQ ID NO: 27408 - protein, 30 aa, Artificial Sequence
  Description of Artificial Sequence: Synthetic polypeptide
DEEEIRTTNPVSTEQYGSVSSNLQDQEGNR

SEQ ID NO: 27409 - protein, 28 aa, Artificial Sequence
  Description of Artificial Sequence: Synthetic peptide
DENEIVTTNPVATEQYGVVSTNLDGGNR

SEQ ID NO: 27410 - protein, 31 aa, Artificial Sequence
  Description of Artificial Sequence: Synthetic polypeptide
DEEEIRTTNPVATEQYGSVDSTNDIERDGNR

SEQ ID NO: 27411 - protein, 29 aa, Artificial Sequence
  Description of Artificial Sequence: Synthetic peptide
DEEEIRTTNPVATEMYGSVATNLDERGDR

SEQ ID NO: 27412 - protein, 29 aa, Artificial Sequence
  Description of Artificial Sequence: Synthetic peptide
DEEEIATTNPCATEQYGCVSATNLQRGNF

SEQ ID NO: 27413 - protein, 31 aa, Artificial Sequence
  Description of Artificial Sequence: Synthetic polypeptide
DEEEIRTTNPVATEQYGSVSTLNGLDERGER

SEQ ID NO: 27414 - protein, 30 aa, Artificial Sequence
  Description of Artificial Sequence: Synthetic polypeptide
DEEELRTTNPVATEQYGSVSTNPQRGANDF

SEQ ID NO: 27415 - protein, 29 aa, Artificial Sequence
  Description of Artificial Sequence: Synthetic peptide
DEEEIRTTNPVATEQYGSVSDTNDDIGNL

SEQ ID NO: 27416 - protein, 29 aa, Artificial Sequence
  Description of Artificial Sequence: Synthetic peptide
SEEEIATTNPVATEQYGSVSTMLEQRGDR

SEQ ID NO: 27417 - protein, 28 aa, Artificial Sequence
  Description of Artificial Sequence: Synthetic peptide
DENEIRTTNPCATEQYGSVSTNLQIGPL

SEQ ID NO: 27418 - protein, 28 aa, Artificial Sequence
  Description of Artificial Sequence: Synthetic peptide
DENEIATTNPVATECYGSVSTNLQIGNM

SEQ ID NO: 27419 - protein, 29 aa, Artificial Sequence
  Description of Artificial Sequence: Synthetic peptide
DEEEIRTTNPVATEQWGSVDTNLEMRGNQ

SEQ ID NO: 27420 - protein, 30 aa, Artificial Sequence
  Description of Artificial Sequence: Synthetic polypeptide
DEQEIRTTNPVATEQYGTVSCTNLQAGVNR

SEQ ID NO: 27421 - protein, 29 aa, Artificial Sequence
  Description of Artificial Sequence: Synthetic peptide
DEEEIRTTNPFATEQYGSVSTNDQRKGEP

SEQ ID NO: 27422 - protein, 28 aa, Artificial Sequence
  Description of Artificial Sequence: Synthetic peptide
DEEEIRTTNPVATEQYGSVSTELEVGED

SEQ ID NO: 27423 - protein, 28 aa, Artificial Sequence
  Description of Artificial Sequence: Synthetic peptide
DEEEIATTNPTATEQYGSVSTNEQQGNA

SEQ ID NO: 27424 - protein, 28 aa, Artificial Sequence
  Description of Artificial Sequence: Synthetic peptide
DEEEIRTTNPVATEQYGDVSENEQHGDR

SEQ ID NO: 27425 - protein, 31 aa, Artificial Sequence
  Description of Artificial Sequence: Synthetic polypeptide
DEEEIRTTNPVATEMYGSVSTNGLPQDRGTR

SEQ ID NO: 27426 - protein, 28 aa, Artificial Sequence
  Description of Artificial Sequence: Synthetic peptide
DEGEIRTTNPVATEMYGSVSENPQQGNR

SEQ ID NO: 27427 - protein, 30 aa, Artificial Sequence
  Description of Artificial Sequence: Synthetic polypeptide
DEQEIRTTNPVATEQYGSVSTGNLQIHGNF

SEQ ID NO: 27428 - protein, 29 aa, Artificial Sequence
  Description of Artificial Sequence: Synthetic peptide
DEEEIATTNPCATEQYGSVSATFLQRGMR

SEQ ID NO: 27429 - protein, 28 aa, Artificial Sequence
  Description of Artificial Sequence: Synthetic peptide
DEQEVRTTNPVATEQYGSCATNLQRGER

SEQ ID NO: 27430 - protein, 28 aa, Artificial Sequence
  Description of Artificial Sequence: Synthetic peptide
DEEEIKTTNPVATEQYGTVSTDLERPNR

SEQ ID NO: 27431 - protein, 28 aa, Artificial Sequence
  Description of Artificial Sequence: Synthetic peptide
SEEEIATTNPAATEQYGSVSTNLQRGTE

SEQ ID NO: 27432 - protein, 28 aa, Artificial Sequence
  Description of Artificial Sequence: Synthetic peptide
DEEEIRQTNPVATEQYGVVSENLQRGED

SEQ ID NO: 27433 - protein, 29 aa, Artificial Sequence
  Description of Artificial Sequence: Synthetic peptide
DEEEIRTTNPVATEQYGSVSTELQILGDY

SEQ ID NO: 27434 - protein, 28 aa, Artificial Sequence
  Description of Artificial Sequence: Synthetic peptide
DEQEIRTTNPVATEQYGSVDTNLELGNQ

SEQ ID NO: 27435 - protein, 30 aa, Artificial Sequence
  Description of Artificial Sequence: Synthetic polypeptide
DEEEIRATNPVATEQYGSVSTSALQRGDNM

SEQ ID NO: 27436 - protein, 30 aa, Artificial Sequence
  Description of Artificial Sequence: Synthetic polypeptide
DEEEIRCTNPVATEQYGSVSTNDMIRGNDR

SEQ ID NO: 27437 - protein, 28 aa, Artificial Sequence
  Description of Artificial Sequence: Synthetic peptide
DEECIRTTNPVATLQYGSVSHGLQPGNR

SEQ ID NO: 27438 - protein, 29 aa, Artificial Sequence
  Description of Artificial Sequence: Synthetic peptide
DEEEITTTNPVATEQYGSVSENLQHAGMR

SEQ ID NO: 27439 - protein, 29 aa, Artificial Sequence
  Description of Artificial Sequence: Synthetic peptide
DEEEICTTNPVATEVFGSVSTNLQRGVNF

SEQ ID NO: 27440 - protein, 31 aa, Artificial Sequence
  Description of Artificial Sequence: Synthetic polypeptide
DEEEIRTTNPVATEQYGSVSATNLQLVGNDD

SEQ ID NO: 27441 - protein, 29 aa, Artificial Sequence
  Description of Artificial Sequence: Synthetic peptide
SEEEIRTTNPVATEQFGSVSTMNLQQGNF

SEQ ID NO: 27442 - protein, 28 aa, Artificial Sequence
  Description of Artificial Sequence: Synthetic peptide
DEEEIRTTNPVATEQYGSVSEDLQLGDS

SEQ ID NO: 27443 - protein, 28 aa, Artificial Sequence
  Description of Artificial Sequence: Synthetic peptide
DEQEIRTTNPVATECYGSVSTDLEQGNR

SEQ ID NO: 27444 - protein, 28 aa, Artificial Sequence
  Description of Artificial Sequence: Synthetic peptide
DEEEIRTTNPVATECYGSVSTDLEHGNM

SEQ ID NO: 27445 - protein, 29 aa, Artificial Sequence
  Description of Artificial Sequence: Synthetic peptide
DEEEIRTTNPVAYEQYGWSSANLQRGNAR

SEQ ID NO: 27446 - protein, 30 aa, Artificial Sequence
  Description of Artificial Sequence: Synthetic polypeptide
DEGEIRTTNPVATEQYGSVSTANLQDLGTR

SEQ ID NO: 27447 - protein, 28 aa, Artificial Sequence
  Description of Artificial Sequence: Synthetic peptide
DEEEIVTTNPVATEQYGSVSTNPQMGEE

SEQ ID NO: 27448 - protein, 29 aa, Artificial Sequence
  Description of Artificial Sequence: Synthetic peptide
DEEEIRTTNPCATEQYGAVSCTDLQRGNM

SEQ ID NO: 27449 - protein, 31 aa, Artificial Sequence
  Description of Artificial Sequence: Synthetic polypeptide
DEEEIRTTNPVATEQYGSVSTPNPLFIRGER

SEQ ID NO: 27450 - protein, 29 aa, Artificial Sequence
  Description of Artificial Sequence: Synthetic peptide
DEEEIRTTNPVATEQYGSVSTELQSDLNY

SEQ ID NO: 27451 - protein, 28 aa, Artificial Sequence
  Description of Artificial Sequence: Synthetic peptide
DEEEIRTTNPTATEQFGSVSTNPQLGNA

SEQ ID NO: 27452 - protein, 31 aa, Artificial Sequence
  Description of Artificial Sequence: Synthetic polypeptide
DEEEIRTTNPVATEQYGSVDSTPLVQIGGNR

SEQ ID NO: 27453 - protein, 28 aa, Artificial Sequence
  Description of Artificial Sequence: Synthetic peptide
DEEEIATTNPEATECYGSVSTNLQHGNF

SEQ ID NO: 27454 - protein, 28 aa, Artificial Sequence
  Description of Artificial Sequence: Synthetic peptide
DEEEIRQTNPVATEQYGVVSTDLQVGND

SEQ ID NO: 27455 - protein, 30 aa, Artificial Sequence
  Description of Artificial Sequence: Synthetic polypeptide
DEEEIRTTNPVATEQYGVVCSTNLQDRGDI

SEQ ID NO: 27456 - protein, 32 aa, Artificial Sequence
  Description of Artificial Sequence: Synthetic polypeptide
DEEEIRTTNPVATEQYGSVSDTDELQRGENER

SEQ ID NO: 27457 - protein, 28 aa, Artificial Sequence
  Description of Artificial Sequence: Synthetic peptide
DEEEIRTTNPVATEQYGSVFTNDDDGNE

SEQ ID NO: 27458 - protein, 28 aa, Artificial Sequence
  Description of Artificial Sequence: Synthetic peptide
DENEIRTTNPVATEQYGSASTNLMRMQR

SEQ ID NO: 27459 - protein, 28 aa, Artificial Sequence
  Description of Artificial Sequence: Synthetic peptide
AEEEIRCTNPVATEQYGSASDNLQRGQR

SEQ ID NO: 27460 - protein, 29 aa, Artificial Sequence
  Description of Artificial Sequence: Synthetic peptide
DTEEIRTTNPVATEQYGSVHTPNLQPGTR

SEQ ID NO: 27461 - protein, 30 aa, Artificial Sequence
  Description of Artificial Sequence: Synthetic polypeptide
DEEEIRPTNPVATEQYGSVSMTGLPQTGNR

SEQ ID NO: 27462 - protein, 31 aa, Artificial Sequence
  Description of Artificial Sequence: Synthetic polypeptide
DEEEIRTTNPVATEQYGSVSTELQIDKGNDR

SEQ ID NO: 27463 - protein, 30 aa, Artificial Sequence
  Description of Artificial Sequence: Synthetic polypeptide
DEEEIRTTNPVATECYGSVSATNLERGNDL

SEQ ID NO: 27464 - protein, 29 aa, Artificial Sequence
  Description of Artificial Sequence: Synthetic peptide
DEEEIRTTNPVATEQYGSVSTCDQQCGNF

SEQ ID NO: 27465 - protein, 28 aa, Artificial Sequence
  Description of Artificial Sequence: Synthetic peptide
DEEEIRTTNPVATEQYGSVSTEPQIGEM

SEQ ID NO: 27466 - protein, 31 aa, Artificial Sequence
  Description of Artificial Sequence: Synthetic polypeptide
DEEEIRTTNPVATEQWGSVSTNLPQDRGENG

SEQ ID NO: 27467 - protein, 28 aa, Artificial Sequence
  Description of Artificial Sequence: Synthetic peptide
DEQEIRTTNPVATEQYGSVSEVLQHGGR

SEQ ID NO: 27468 - protein, 28 aa, Artificial Sequence
  Description of Artificial Sequence: Synthetic peptide
DEEEIRTTNPVATELWGSVSTNLMQGNF

SEQ ID NO: 27469 - protein, 28 aa, Artificial Sequence
  Description of Artificial Sequence: Synthetic peptide
DEEPIHTTNPVATEQYGSWSTGLQPGNR

SEQ ID NO: 27470 - protein, 28 aa, Artificial Sequence
  Description of Artificial Sequence: Synthetic peptide
DEQEIRTTNPVATEQYGSVSTDLQVGDI

SEQ ID NO: 27471 - protein, 28 aa, Artificial Sequence
  Description of Artificial Sequence: Synthetic peptide
DEEEIRTTNPVATEQYGSVSECLCREER

SEQ ID NO: 27472 - protein, 28 aa, Artificial Sequence
  Description of Artificial Sequence: Synthetic peptide
DEEEIRATNPVATEQYGSVGQELQVGNR

SEQ ID NO: 27473 - protein, 31 aa, Artificial Sequence
  Description of Artificial Sequence: Synthetic polypeptide
DEEELRTTNPVATEQYGSVSTNGLQVEGFNR

SEQ ID NO: 27474 - protein, 28 aa, Artificial Sequence
  Description of Artificial Sequence: Synthetic peptide
DEEEIRTTNPVATEQYGSVETEDERGNP

SEQ ID NO: 27475 - protein, 30 aa, Artificial Sequence
  Description of Artificial Sequence: Synthetic polypeptide
HEEEIRTTNPVATEQYGSVSVALQMRNGNR

SEQ ID NO: 27476 - protein, 30 aa, Artificial Sequence
  Description of Artificial Sequence: Synthetic polypeptide
DEEEIRTTNPVATEQYGSVSTNLVDRGDEE

SEQ ID NO: 27477 - protein, 28 aa, Artificial Sequence
  Description of Artificial Sequence: Synthetic peptide
MEEEIRTTNPVATECYGSVSTNLQHGEE

SEQ ID NO: 27478 - protein, 28 aa, Artificial Sequence
  Description of Artificial Sequence: Synthetic peptide
DEEEIRTTNPVATEQYGAVSTAEFRGND

SEQ ID NO: 27479 - protein, 30 aa, Artificial Sequence
  Description of Artificial Sequence: Synthetic polypeptide
DEEEIRTVNPVAYEQYGTVSATNLQRNGNR

SEQ ID NO: 27480 - protein, 30 aa, Artificial Sequence
  Description of Artificial Sequence: Synthetic polypeptide
DEEEIRTTNPVATEQYGEVSENLQLGDNDR

SEQ ID NO: 27481 - protein, 28 aa, Artificial Sequence
  Description of Artificial Sequence: Synthetic peptide
DEEEIRCTNPAATECYGSVSENLQRGDR

SEQ ID NO: 27482 - protein, 28 aa, Artificial Sequence
  Description of Artificial Sequence: Synthetic peptide
DEEEIRQTNPVATEQYGSVSTDPQHGNL

SEQ ID NO: 27483 - protein, 29 aa, Artificial Sequence
  Description of Artificial Sequence: Synthetic peptide
DEQEIRTTNPVATEWYGSVSTNLQMGGNF

SEQ ID NO: 27484 - protein, 30 aa, Artificial Sequence
  Description of Artificial Sequence: Synthetic polypeptide
DEEEIRTTNPVATEQYGSVSTNLEDVGNDD

SEQ ID NO: 27485 - protein, 28 aa, Artificial Sequence
  Description of Artificial Sequence: Synthetic peptide
DEQEIRTTNPVATEQYGSVSTEDQRENI

SEQ ID NO: 27486 - protein, 28 aa, Artificial Sequence
  Description of Artificial Sequence: Synthetic peptide
DEEEIRTTNPVATEQYGSVDTDLIRGDH

SEQ ID NO: 27487 - protein, 30 aa, Artificial Sequence
  Description of Artificial Sequence: Synthetic polypeptide
DENEIRTTNPVATEQYGSVSTNLQDQEGNF

SEQ ID NO: 27488 - protein, 28 aa, Artificial Sequence
  Description of Artificial Sequence: Synthetic peptide
DEEEIRTTNPVGTEQYGSVSTEGQPGNL

SEQ ID NO: 27489 - protein, 28 aa, Artificial Sequence
  Description of Artificial Sequence: Synthetic peptide
DEEEIRTTNPVATEQYGDVSEDLQTGNS

SEQ ID NO: 27490 - protein, 28 aa, Artificial Sequence
  Description of Artificial Sequence: Synthetic peptide
DEEEIRTTNPVATEIYGSVSTELEGGNV

SEQ ID NO: 27491 - protein, 28 aa, Artificial Sequence
  Description of Artificial Sequence: Synthetic peptide
DEEEIRTTNPVATECYGSVSTELEDGNM

SEQ ID NO: 27492 - protein, 28 aa, Artificial Sequence
  Description of Artificial Sequence: Synthetic peptide
DEEEIRCTNPVATEQYGSVPTNDQNGNA

SEQ ID NO: 27493 - protein, 28 aa, Artificial Sequence
  Description of Artificial Sequence: Synthetic peptide
DEEEIRQTNPVATEGYGSASTNLQHGGR

SEQ ID NO: 27494 - protein, 29 aa, Artificial Sequence
  Description of Artificial Sequence: Synthetic peptide
QEEEIRTTNPVATECYGSVSDTNLQLGNM

SEQ ID NO: 27495 - protein, 28 aa, Artificial Sequence
  Description of Artificial Sequence: Synthetic peptide
DEEEIRTTNPVATEIYGNVSTNDQLGNY

SEQ ID NO: 27496 - protein, 28 aa, Artificial Sequence
  Description of Artificial Sequence: Synthetic peptide
DEQEIRTTNPVATEQYGSVSTDLQHGES

SEQ ID NO: 27497 - protein, 31 aa, Artificial Sequence
  Description of Artificial Sequence: Synthetic polypeptide
DEHEIRTTNPVATEQYGSVSCTNWQCRGENR

SEQ ID NO: 27498 - protein, 29 aa, Artificial Sequence
  Description of Artificial Sequence: Synthetic peptide
DEEEIRTTNPVATEQYGDVSEEDLQHGNR

SEQ ID NO: 27499 - protein, 30 aa, Artificial Sequence
  Description of Artificial Sequence: Synthetic polypeptide
DEEEIRTTNPVATEQYGSVSDNLQVHENER

SEQ ID NO: 27500 - protein, 29 aa, Artificial Sequence
  Description of Artificial Sequence: Synthetic peptide
DDDEIRTTNPVATEQYGSVSTDFQREGNR

SEQ ID NO: 27501 - protein, 28 aa, Artificial Sequence
  Description of Artificial Sequence: Synthetic peptide
DEEEINTTNPVATEHYGSVSENLQQGPR

SEQ ID NO: 27502 - protein, 28 aa, Artificial Sequence
  Description of Artificial Sequence: Synthetic peptide
DEEEIRTTNPVATEIYGSVSHNGQPPNR

SEQ ID NO: 27503 - protein, 28 aa, Artificial Sequence
  Description of Artificial Sequence: Synthetic peptide
DEQEIRTTNPVATEQYGSVSTGEQHGND

SEQ ID NO: 27504 - protein, 28 aa, Artificial Sequence
  Description of Artificial Sequence: Synthetic peptide
DEEEIRTTNPVATEAYGSVSTLLNPGNT

SEQ ID NO: 27505 - protein, 28 aa, Artificial Sequence
  Description of Artificial Sequence: Synthetic peptide
DEEEIRCTNPVSTEQYGSVSTNDQIGNL

SEQ ID NO: 27506 - protein, 28 aa, Artificial Sequence
  Description of Artificial Sequence: Synthetic peptide
DEEEIKTTNPVATCQYGSVGTNLQRDNS

SEQ ID NO: 27507 - protein, 29 aa, Artificial Sequence
  Description of Artificial Sequence: Synthetic peptide
DEEEIRTTNPTATEQYGSVSTMNEQNGNV

SEQ ID NO: 27508 - protein, 28 aa, Artificial Sequence
  Description of Artificial Sequence: Synthetic peptide
DEQEIRTTNPVATEQYGSVSTELQAGDF

SEQ ID NO: 27509 - protein, 30 aa, Artificial Sequence
  Description of Artificial Sequence: Synthetic polypeptide
DEEEIRTTNPVATEQYGSVSTGELQDGNDD

SEQ ID NO: 27510 - protein, 33 aa, Artificial Sequence
  Description of Artificial Sequence: Synthetic polypeptide
DEEEIRTTNPVATEQYGSVSITPNPLVQRGNPR

SEQ ID NO: 27511 - protein, 32 aa, Artificial Sequence
  Description of Artificial Sequence: Synthetic polypeptide
DEEEIRTTNPVATEQYGSVSTTNLVQVNGENR

SEQ ID NO: 27512 - protein, 28 aa, Artificial Sequence
  Description of Artificial Sequence: Synthetic peptide
DENEIRQTNPVATEQYGVVSTDQQRGNR

SEQ ID NO: 27513 - protein, 28 aa, Artificial Sequence
  Description of Artificial Sequence: Synthetic peptide
DEQEIRTTNPVATEQYGVVSTELQVGND

SEQ ID NO: 27514 - protein, 31 aa, Artificial Sequence
  Description of Artificial Sequence: Synthetic polypeptide
DEEEIRTTNPVATEQYGSVSTTGLEREGNDR

SEQ ID NO: 27515 - protein, 29 aa, Artificial Sequence
  Description of Artificial Sequence: Synthetic peptide
DEEEIRTTNPVATEQYGSCSDNLDREGNS

SEQ ID NO: 27516 - protein, 28 aa, Artificial Sequence
  Description of Artificial Sequence: Synthetic peptide
VDEEIRTTNPVATENYGSVSTNLQRLNQ

SEQ ID NO: 27517 - protein, 31 aa, Artificial Sequence
  Description of Artificial Sequence: Synthetic polypeptide
DEEEIRTTNPVATEQYGSVSTNLQEVEGNDF

SEQ ID NO: 27518 - protein, 28 aa, Artificial Sequence
  Description of Artificial Sequence: Synthetic peptide
DENEIRTTNPVATEPYGSVATNLQYGND

SEQ ID NO: 27519 - protein, 31 aa, Artificial Sequence
  Description of Artificial Sequence: Synthetic polypeptide
DEEEIRTTNPTATEQYGSVSTGNLQLGDNTR

SEQ ID NO: 27520 - protein, 28 aa, Artificial Sequence
  Description of Artificial Sequence: Synthetic peptide
DEEEIRTTNPVATEQYGSVSTPDENGNI

SEQ ID NO: 27521 - protein, 30 aa, Artificial Sequence
  Description of Artificial Sequence: Synthetic polypeptide
DEEEIRTTNPVATEQYGTVSTNLPQVGELR

SEQ ID NO: 27522 - protein, 29 aa, Artificial Sequence
  Description of Artificial Sequence: Synthetic peptide
NEHEIRTTNPVATEQYGSVSTNLQLTGNS

SEQ ID NO: 27523 - protein, 31 aa, Artificial Sequence
  Description of Artificial Sequence: Synthetic polypeptide
DEEEIRATNPVATEQYGSVSDTPNLQRKGNE

SEQ ID NO: 27524 - protein, 30 aa, Artificial Sequence
  Description of Artificial Sequence: Synthetic polypeptide
DEEEIRTTNPVSTEQWGIVSTNLQRGENDR

SEQ ID NO: 27525 - protein, 28 aa, Artificial Sequence
  Description of Artificial Sequence: Synthetic peptide
DEEEIATTNPVATELYGSVSTNVQWENR

SEQ ID NO: 27526 - protein, 30 aa, Artificial Sequence
  Description of Artificial Sequence: Synthetic polypeptide
DEEEIRTTNPVATEQYGSVSTDLQDAGDNW

SEQ ID NO: 27527 - protein, 28 aa, Artificial Sequence
  Description of Artificial Sequence: Synthetic peptide
DEEEIRTTNPVATEQYGVVSTDLQMGEM

SEQ ID NO: 27528 - protein, 30 aa, Artificial Sequence
  Description of Artificial Sequence: Synthetic polypeptide
DEQEIRTTNPVATEQYGSVDSTPLERGNDR

SEQ ID NO: 27529 - protein, 28 aa, Artificial Sequence
  Description of Artificial Sequence: Synthetic peptide
DEREIRCTNPVATEQYGSVSTNPQHGNA

SEQ ID NO: 27530 - protein, 28 aa, Artificial Sequence
  Description of Artificial Sequence: Synthetic peptide
DEQEVRTTNPVATEQYGCVSMNLERGNR

SEQ ID NO: 27531 - protein, 31 aa, Artificial Sequence
  Description of Artificial Sequence: Synthetic polypeptide
DEEEIRTTNPVATEQYGSVASTEPQLRGNYR

SEQ ID NO: 27532 - protein, 31 aa, Artificial Sequence
  Description of Artificial Sequence: Synthetic polypeptide
HEEEIRTTNPVATEQYGSVDATNLQRKGDNR

SEQ ID NO: 27533 - protein, 28 aa, Artificial Sequence
  Description of Artificial Sequence: Synthetic peptide
DEEEIRTTNPVATEIYGVVSTNLEVGER

SEQ ID NO: 27534 - protein, 29 aa, Artificial Sequence
  Description of Artificial Sequence: Synthetic peptide
DEQEIRTTNPVATECYGSVSTNLEHEGNR

SEQ ID NO: 27535 - protein, 28 aa, Artificial Sequence
  Description of Artificial Sequence: Synthetic peptide
DEHEIRTTNPVATEVYGEVCTNLQRGNH

SEQ ID NO: 27536 - protein, 28 aa, Artificial Sequence
  Description of Artificial Sequence: Synthetic peptide
DEEEIRTTNPVATEQYGSVSTPDNEENR

SEQ ID NO: 27537 - protein, 31 aa, Artificial Sequence
  Description of Artificial Sequence: Synthetic polypeptide
DEEEIRTTNPVATEIYGSVSTANLPQRGPNN

SEQ ID NO: 27538 - protein, 28 aa, Artificial Sequence
  Description of Artificial Sequence: Synthetic peptide
SEEEIATTNPVATEQYGSVSDNEQRGDR

SEQ ID NO: 27539 - protein, 29 aa, Artificial Sequence
  Description of Artificial Sequence: Synthetic peptide
DEEEIRTTNPVATEQYGSVDSTNEQHEER

SEQ ID NO: 27540 - protein, 28 aa, Artificial Sequence
  Description of Artificial Sequence: Synthetic peptide
DEEEIVTTNPVATEQYGSVSNNLQHGEL

SEQ ID NO: 27541 - protein, 29 aa, Artificial Sequence
  Description of Artificial Sequence: Synthetic peptide
DEVEIRTTNPVATEQYGVCSENLQERGNR

SEQ ID NO: 27542 - protein, 28 aa, Artificial Sequence
  Description of Artificial Sequence: Synthetic peptide
DEQEIRTTNPVATEIYGSVSTALQRGEI

SEQ ID NO: 27543 - protein, 28 aa, Artificial Sequence
  Description of Artificial Sequence: Synthetic peptide
DEAEIAATNPVATENYGSVATNLQRGNR

SEQ ID NO: 27544 - protein, 31 aa, Artificial Sequence
  Description of Artificial Sequence: Synthetic polypeptide
DEEEIRTTNPVATEQYGSVSTNEQQMQGNTR

SEQ ID NO: 27545 - protein, 28 aa, Artificial Sequence
  Description of Artificial Sequence: Synthetic peptide
DEEEIRTTNPVATEWWGSVSTNLQQGTQ

SEQ ID NO: 27546 - protein, 29 aa, Artificial Sequence
  Description of Artificial Sequence: Synthetic peptide
DESEIRTTNPVATEQYGEVSDNLQSRGNL

SEQ ID NO: 27547 - protein, 28 aa, Artificial Sequence
  Description of Artificial Sequence: Synthetic peptide
DEEEIRTTNPVATEQYGSVSEDLQAGDD

SEQ ID NO: 27548 - protein, 28 aa, Artificial Sequence
  Description of Artificial Sequence: Synthetic peptide
DEEEIRTTNPVATEQYGSVSTDDQDGEW

SEQ ID NO: 27549 - protein, 32 aa, Artificial Sequence
  Description of Artificial Sequence: Synthetic polypeptide
DEEEIRTTNPVATEQYGSVSVTANLQREGINE

SEQ ID NO: 27550 - protein, 30 aa, Artificial Sequence
  Description of Artificial Sequence: Synthetic polypeptide
DEEEIRCTNPVATEQYGIVSTNLQIRGNDL

SEQ ID NO: 27551 - protein, 28 aa, Artificial Sequence
  Description of Artificial Sequence: Synthetic peptide
DEQEIRTTNPVATEQYGSVETNLQHGEF

SEQ ID NO: 27552 - protein, 29 aa, Artificial Sequence
  Description of Artificial Sequence: Synthetic peptide
DEEEIATTNPVATEQYGSVSTDLQEHGER

SEQ ID NO: 27553 - protein, 28 aa, Artificial Sequence
  Description of Artificial Sequence: Synthetic peptide
DEEEIRTTNPVATEQWGSVHTPLQRGTP

SEQ ID NO: 27554 - protein, 28 aa, Artificial Sequence
  Description of Artificial Sequence: Synthetic peptide
DEEEIRGTNPVATEQYGSVSTLLQPGEN

SEQ ID NO: 27555 - protein, 30 aa, Artificial Sequence
  Description of Artificial Sequence: Synthetic polypeptide
DEEEIRTTNPVATEQYGSVSTQNEQEIGER

SEQ ID NO: 27556 - protein, 30 aa, Artificial Sequence
  Description of Artificial Sequence: Synthetic polypeptide
DEEEIRTTNPVATEQYGSVSTNPQVLKGNN

SEQ ID NO: 27557 - protein, 30 aa, Artificial Sequence
  Description of Artificial Sequence: Synthetic polypeptide
DEEEIRTTNPVATEQYGSVSTNEQEQGNTN

SEQ ID NO: 27558 - protein, 28 aa, Artificial Sequence
  Description of Artificial Sequence: Synthetic peptide
DEEEIRTTNPVATQQYGSVSHGLDRGER

SEQ ID NO: 27559 - protein, 28 aa, Artificial Sequence
  Description of Artificial Sequence: Synthetic peptide
SENEIRTTNPVATEQYGIYSTNLQQGNR

SEQ ID NO: 27560 - protein, 28 aa, Artificial Sequence
  Description of Artificial Sequence: Synthetic peptide
DEQEIRTTNPVATEQYGSVSTNDQIEER

SEQ ID NO: 27561 - protein, 28 aa, Artificial Sequence
  Description of Artificial Sequence: Synthetic peptide
DEDEIRTTNPVATELYGSVSTDLQGGNI

SEQ ID NO: 27562 - protein, 29 aa, Artificial Sequence
  Description of Artificial Sequence: Synthetic peptide
DEEEIRTTNPVATEQWGIVSTNDQRGNDS

SEQ ID NO: 27563 - protein, 30 aa, Artificial Sequence
  Description of Artificial Sequence: Synthetic polypeptide
DEEEIRTTNPVATEQYGSASVTNDQQYGNR

SEQ ID NO: 27564 - protein, 30 aa, Artificial Sequence
  Description of Artificial Sequence: Synthetic polypeptide
DEEEIRTTNPVATEQYGSVSTNLEERGEDS

SEQ ID NO: 27565 - protein, 32 aa, Artificial Sequence
  Description of Artificial Sequence: Synthetic polypeptide
DEEEIRTTNPVATEQYGSVASITNLQREPANR

SEQ ID NO: 27566 - protein, 29 aa, Artificial Sequence
  Description of Artificial Sequence: Synthetic peptide
DEEEIRTTNPVATEIYGSVSTNLEIAGNH

SEQ ID NO: 27567 - protein, 33 aa, Artificial Sequence
  Description of Artificial Sequence: Synthetic polypeptide
DEEEIRTTNPVATEQYGSVSTANLQEREGDNTR

SEQ ID NO: 27568 - protein, 31 aa, Artificial Sequence
  Description of Artificial Sequence: Synthetic polypeptide
DEEEIRTTNPVATEQYGSVSTNLQDRKGEDM

SEQ ID NO: 27569 - protein, 28 aa, Artificial Sequence
  Description of Artificial Sequence: Synthetic peptide
DEEEIRTTNPVATEQYGEVSENEQQGNF

SEQ ID NO: 27570 - protein, 28 aa, Artificial Sequence
  Description of Artificial Sequence: Synthetic peptide
DEEEIRTTNPTATEQYGSVSTNPQFGTA

SEQ ID NO: 27571 - protein, 28 aa, Artificial Sequence
  Description of Artificial Sequence: Synthetic peptide
DEEEIRTTNPVATEQYGEVSENLQAGEM

SEQ ID NO: 27572 - protein, 30 aa, Artificial Sequence
  Description of Artificial Sequence: Synthetic polypeptide
DEEEIRTTNPVSTEQYGSVSTNLQVAGDDR

SEQ ID NO: 27573 - protein, 30 aa, Artificial Sequence
  Description of Artificial Sequence: Synthetic polypeptide
DEEEIRTTNPVATEQYGECSTNPLQRQGER

SEQ ID NO: 27574 - protein, 30 aa, Artificial Sequence
  Description of Artificial Sequence: Synthetic polypeptide
MEEEIRTTNPVATEQYGSVSTNLQENGNDS

SEQ ID NO: 27575 - protein, 31 aa, Artificial Sequence
  Description of Artificial Sequence: Synthetic polypeptide
DEEEIRTTNPVATEQYGSVSVTANLQDAGNQ

SEQ ID NO: 27576 - protein, 28 aa, Artificial Sequence
  Description of Artificial Sequence: Synthetic peptide
DEEEIRTTNPVATEWYGSVDTNLMIGNM

SEQ ID NO: 27577 - protein, 31 aa, Artificial Sequence
  Description of Artificial Sequence: Synthetic polypeptide
DEEEIRTTNPVATEQYGSVSTNLQEDNGENT

SEQ ID NO: 27578 - protein, 28 aa, Artificial Sequence
  Description of Artificial Sequence: Synthetic peptide
DEEEIRATNPVATEQYGSVSTELQNGEL

SEQ ID NO: 27579 - protein, 32 aa, Artificial Sequence
  Description of Artificial Sequence: Synthetic polypeptide
DEEEIRTTNPVATEQYGSVCSTNLPEERGVNR

SEQ ID NO: 27580 - protein, 28 aa, Artificial Sequence
  Description of Artificial Sequence: Synthetic peptide
DEEEIRTTNPVATEQYGDVSTNDFAGNL

SEQ ID NO: 27581 - protein, 32 aa, Artificial Sequence
  Description of Artificial Sequence: Synthetic polypeptide
DEEEIRTTNPVATEQYGSVSTTTNLQVRKGER

SEQ ID NO: 27582 - protein, 29 aa, Artificial Sequence
  Description of Artificial Sequence: Synthetic peptide
DEEEIRTTNPVGTEQYGSVSEILDQRGNL

SEQ ID NO: 27583 - protein, 30 aa, Artificial Sequence
  Description of Artificial Sequence: Synthetic polypeptide
DEEEIATTNPTATEQYGSVSTGNEQRGNDR

SEQ ID NO: 27584 - protein, 29 aa, Artificial Sequence
  Description of Artificial Sequence: Synthetic peptide
DEEEIRTTNPVATEQWGSVSENEQMLGNR

SEQ ID NO: 27585 - protein, 28 aa, Artificial Sequence
  Description of Artificial Sequence: Synthetic peptide
GEEEISTTNPVATEMYGSVSTELQRGDR

SEQ ID NO: 27586 - protein, 29 aa, Artificial Sequence
  Description of Artificial Sequence: Synthetic peptide
DEEEIRTTNPVATEQYGSVSTDLQDYGEF

SEQ ID NO: 27587 - protein, 32 aa, Artificial Sequence
  Description of Artificial Sequence: Synthetic polypeptide
DEEEIRTTNPVATEQYGSVSDTEPGLQDRGNR

SEQ ID NO: 27588 - protein, 29 aa, Artificial Sequence
  Description of Artificial Sequence: Synthetic peptide
DEEEIRTTNPTATEQYGSVSTMNEQQGTR

SEQ ID NO: 27589 - protein, 28 aa, Artificial Sequence
  Description of Artificial Sequence: Synthetic peptide
DEDEIATTNPVATEQYGIVGTNLQRGTR

SEQ ID NO: 27590 - protein, 28 aa, Artificial Sequence
  Description of Artificial Sequence: Synthetic peptide
DEQEIRTTNPVATEQYGSVSTDLDLGNF

SEQ ID NO: 27591 - protein, 30 aa, Artificial Sequence
  Description of Artificial Sequence: Synthetic polypeptide
DEEEIRTTNPVATEQYGSVSTNEQEIGNTQ

SEQ ID NO: 27592 - protein, 28 aa, Artificial Sequence
  Description of Artificial Sequence: Synthetic peptide
DEEEIRTTNPVATEQYGEVSTDPQGGDR

SEQ ID NO: 27593 - protein, 30 aa, Artificial Sequence
  Description of Artificial Sequence: Synthetic polypeptide
DEEEIRTTNPVATECYGSVSETELQTGENR

SEQ ID NO: 27594 - protein, 30 aa, Artificial Sequence
  Description of Artificial Sequence: Synthetic polypeptide
DEEEIRTTNPVATMQYGSVSENLQQHGDNR

SEQ ID NO: 27595 - protein, 30 aa, Artificial Sequence
  Description of Artificial Sequence: Synthetic polypeptide
DENEIATTNPVATEQYGSVSTNLELREGNR

SEQ ID NO: 27596 - protein, 30 aa, Artificial Sequence
  Description of Artificial Sequence: Synthetic polypeptide
QEEEIRTTNPVATEQYGSVCPCTNLQRGER

SEQ ID NO: 27597 - protein, 28 aa, Artificial Sequence
  Description of Artificial Sequence: Synthetic peptide
DEEEIRTTNPVATQQYGSVSTPDDPGNR

SEQ ID NO: 27598 - protein, 28 aa, Artificial Sequence
  Description of Artificial Sequence: Synthetic peptide
DENEIRTTNPVATECYGSASTNLQRGEL

SEQ ID NO: 27599 - protein, 28 aa, Artificial Sequence
  Description of Artificial Sequence: Synthetic peptide
DEEEIATTNPTATEQYGSVSTNEQNGNA

SEQ ID NO: 27600 - protein, 28 aa, Artificial Sequence
  Description of Artificial Sequence: Synthetic peptide
DEEEIRTTNPVATEIYGSVSTDLQVGEA

SEQ ID NO: 27601 - protein, 28 aa, Artificial Sequence
  Description of Artificial Sequence: Synthetic peptide
DEEEIRATNPVAYEQYGSVSTNPQLGNF

SEQ ID NO: 27602 - protein, 28 aa, Artificial Sequence
  Description of Artificial Sequence: Synthetic peptide
DEQEIRSTNPVATENYGWVSTNLQVGNR

SEQ ID NO: 27603 - protein, 28 aa, Artificial Sequence
  Description of Artificial Sequence: Synthetic peptide
DEEEIRTTNPVATEVYGAVSTNEQVGNT

SEQ ID NO: 27604 - protein, 28 aa, Artificial Sequence
  Description of Artificial Sequence: Synthetic peptide
DEEEIRTTNPVATECFGCVSTNLQRGDH

SEQ ID NO: 27605 - protein, 30 aa, Artificial Sequence
  Description of Artificial Sequence: Synthetic polypeptide
DEEEIRTTNPVSTEQYGSASSTNPLQRGER

SEQ ID NO: 27606 - protein, 28 aa, Artificial Sequence
  Description of Artificial Sequence: Synthetic peptide
DEQEIRTTNPVATEQYGSVSTDDQGGNF

SEQ ID NO: 27607 - protein, 30 aa, Artificial Sequence
  Description of Artificial Sequence: Synthetic polypeptide
DEEEIRTTNPVCTEIYGSVSTGNLQQRGNE

SEQ ID NO: 27608 - protein, 28 aa, Artificial Sequence
  Description of Artificial Sequence: Synthetic peptide
DEECIRTTNPVATQQYGVVSHNLQRGND

SEQ ID NO: 27609 - protein, 29 aa, Artificial Sequence
  Description of Artificial Sequence: Synthetic peptide
DEQEIRTTNPVATECYGSVSTNLEREGER

SEQ ID NO: 27610 - protein, 28 aa, Artificial Sequence
  Description of Artificial Sequence: Synthetic peptide
DEEEIRATNPVSTEQYGSASTNPDRGNR

SEQ ID NO: 27611 - protein, 31 aa, Artificial Sequence
  Description of Artificial Sequence: Synthetic polypeptide
DEEEIRTTNPVATEQYGSVISTMNLPQHGNQ

SEQ ID NO: 27612 - protein, 28 aa, Artificial Sequence
  Description of Artificial Sequence: Synthetic peptide
DEEEIVTTNPVATEQYGSVSTDLQVGEE

SEQ ID NO: 27613 - protein, 28 aa, Artificial Sequence
  Description of Artificial Sequence: Synthetic peptide
DEQEIASTNPVATEVYGTVSTNLQRGNR

SEQ ID NO: 27614 - protein, 29 aa, Artificial Sequence
  Description of Artificial Sequence: Synthetic peptide
DEQEIRTTNPVATEQYGSVSTDLQHGNDD

SEQ ID NO: 27615 - protein, 30 aa, Artificial Sequence
  Description of Artificial Sequence: Synthetic polypeptide
DEEEIRTTNPVATEQYGSVSTDLQIEGDDR

SEQ ID NO: 27616 - protein, 28 aa, Artificial Sequence
  Description of Artificial Sequence: Synthetic peptide
DEEEIATTNPVATEQFGSVNTNLQQENR

SEQ ID NO: 27617 - protein, 28 aa, Artificial Sequence
  Description of Artificial Sequence: Synthetic peptide
DEQEIATTNPVATECYGSVSTNLQHGND

SEQ ID NO: 27618 - protein, 30 aa, Artificial Sequence
  Description of Artificial Sequence: Synthetic polypeptide
DEEEIRTTNPVASEQYGCVSATNLERNGNR

SEQ ID NO: 27619 - protein, 28 aa, Artificial Sequence
  Description of Artificial Sequence: Synthetic peptide
DEEEIVTTNPVATEQYGSVSTDLIQGNW

SEQ ID NO: 27620 - protein, 28 aa, Artificial Sequence
  Description of Artificial Sequence: Synthetic peptide
DEEEIRTTNPVATEQYGVVSTDLEVGNT

SEQ ID NO: 27621 - protein, 31 aa, Artificial Sequence
  Description of Artificial Sequence: Synthetic polypeptide
DEEEIRTTNPVATEQYGSVSCTDLQCTGNDR

SEQ ID NO: 27622 - protein, 28 aa, Artificial Sequence
  Description of Artificial Sequence: Synthetic peptide
DEEEIATTNPVATECYGSVSTNLQSGEI

SEQ ID NO: 27623 - protein, 28 aa, Artificial Sequence
  Description of Artificial Sequence: Synthetic peptide
DEQEIRTTNPVATEQYGSMSDNQQRGER

SEQ ID NO: 27624 - protein, 28 aa, Artificial Sequence
  Description of Artificial Sequence: Synthetic peptide
DEEEIRTTNPVATEQYGSVSYEQQDGDR

SEQ ID NO: 27625 - protein, 31 aa, Artificial Sequence
  Description of Artificial Sequence: Synthetic polypeptide
DEEEIRTTNPVATEQYGSVSATDEVQIRGNR

SEQ ID NO: 27626 - protein, 28 aa, Artificial Sequence
  Description of Artificial Sequence: Synthetic peptide
MEEEIRTTNPVATEQYGSVSTNEQHGEQ

SEQ ID NO: 27627 - protein, 28 aa, Artificial Sequence
  Description of Artificial Sequence: Synthetic peptide
NEEEVSTTNPVATEQYGSVATNLQRLNR

SEQ ID NO: 27628 - protein, 28 aa, Artificial Sequence
  Description of Artificial Sequence: Synthetic peptide
SEEEIRTTNPVATEQYGSVSENEQRGDI

SEQ ID NO: 27629 - protein, 30 aa, Artificial Sequence
  Description of Artificial Sequence: Synthetic polypeptide
MEEEIRTTNPVATEQYGSVSTDLQNEGNDR

SEQ ID NO: 27630 - protein, 28 aa, Artificial Sequence
  Description of Artificial Sequence: Synthetic peptide
DEQEIRTTNPVATECYGSVSTNLQHGEL

SEQ ID NO: 27631 - protein, 30 aa, Artificial Sequence
  Description of Artificial Sequence: Synthetic polypeptide
DEEEIRTTNPVATEQYGSVSEMNLQDQGDR

SEQ ID NO: 27632 - protein, 28 aa, Artificial Sequence
  Description of Artificial Sequence: Synthetic peptide
DEEEISTTNPVGTEQYGSVSTNLNLGND

SEQ ID NO: 27633 - protein, 29 aa, Artificial Sequence
  Description of Artificial Sequence: Synthetic peptide
DEGEIRTTNPVATECYGSVSTNLQVGNDT

SEQ ID NO: 27634 - protein, 32 aa, Artificial Sequence
  Description of Artificial Sequence: Synthetic polypeptide
DEEEIRTTNPVATEQYGSVSTGNLQERGDNTE

SEQ ID NO: 27635 - protein, 30 aa, Artificial Sequence
  Description of Artificial Sequence: Synthetic polypeptide
DEEEIRTTNPVATEQYGSVSEANEQRGNDE

SEQ ID NO: 27636 - protein, 28 aa, Artificial Sequence
  Description of Artificial Sequence: Synthetic peptide
DEEEICTTNPVATETYGDVSTNLQTGNE

SEQ ID NO: 27637 - protein, 28 aa, Artificial Sequence
  Description of Artificial Sequence: Synthetic peptide
DEHEIRSTNPVATEQYGEISDNLQRGNR

SEQ ID NO: 27638 - protein, 31 aa, Artificial Sequence
  Description of Artificial Sequence: Synthetic polypeptide
DEEEIRTTNPVATEQYGSVSTVNEPQLRGTR

SEQ ID NO: 27639 - protein, 29 aa, Artificial Sequence
  Description of Artificial Sequence: Synthetic peptide
DEMEIATTNPVATEQYGSVSTELQVGENR

SEQ ID NO: 27640 - protein, 29 aa, Artificial Sequence
  Description of Artificial Sequence: Synthetic peptide
DENEIRTTNPVATEGYGSVPTNLQNRGER

SEQ ID NO: 27641 - protein, 31 aa, Artificial Sequence
  Description of Artificial Sequence: Synthetic polypeptide
DEEEIRTTNPVATEQYGSVSSTNGTQRGNEF

SEQ ID NO: 27642 - protein, 29 aa, Artificial Sequence
  Description of Artificial Sequence: Synthetic peptide
DEEEIRTTNPVATEQYGIVSTNNQQRENF

SEQ ID NO: 27643 - protein, 30 aa, Artificial Sequence
  Description of Artificial Sequence: Synthetic polypeptide
DEEEIRTTNPVATEQYGSVSTDNLIVGINY

SEQ ID NO: 27644 - protein, 28 aa, Artificial Sequence
  Description of Artificial Sequence: Synthetic peptide
DEQEIRTTNPVATEIWGSVSNNLERGNR

SEQ ID NO: 27645 - protein, 30 aa, Artificial Sequence
  Description of Artificial Sequence: Synthetic polypeptide
DEEEIRTTNPVATEQYGSVSTTDLERNGND

SEQ ID NO: 27646 - protein, 28 aa, Artificial Sequence
  Description of Artificial Sequence: Synthetic peptide
DEQEIRTTNPVATEQYGSVSTNLDSGDI

SEQ ID NO: 27647 - protein, 28 aa, Artificial Sequence
  Description of Artificial Sequence: Synthetic peptide
DEEEIATTNPVATEQYGVVSTNLQVGET

SEQ ID NO: 27648 - protein, 28 aa, Artificial Sequence
  Description of Artificial Sequence: Synthetic peptide
DHTEIRTTNPVATEQYGSVSTNLQAENE

SEQ ID NO: 27649 - protein, 29 aa, Artificial Sequence
  Description of Artificial Sequence: Synthetic peptide
DEEEIRTTNPVATEQWGDVSENLQRGDDR

SEQ ID NO: 27650 - protein, 31 aa, Artificial Sequence
  Description of Artificial Sequence: Synthetic polypeptide
DEEEIRTTNPVATEQYGSVETDNLQREGDNL

SEQ ID NO: 27651 - protein, 30 aa, Artificial Sequence
  Description of Artificial Sequence: Synthetic polypeptide
DEEEIRTTNPVATEQYGDVAATNLQRGNYI

SEQ ID NO: 27652 - protein, 28 aa, Artificial Sequence
  Description of Artificial Sequence: Synthetic peptide
DEEEIRTTNPVATEQYGFVSTEDQMGNS

SEQ ID NO: 27653 - protein, 30 aa, Artificial Sequence
  Description of Artificial Sequence: Synthetic polypeptide
DEEEIRTTNPVATEQYGSVSTNLQEFDGEY

SEQ ID NO: 27654 - protein, 28 aa, Artificial Sequence
  Description of Artificial Sequence: Synthetic peptide
DEQEIVTTNPVATEVYGWVATNLQRGNR

SEQ ID NO: 27655 - protein, 31 aa, Artificial Sequence
  Description of Artificial Sequence: Synthetic polypeptide
DEEEIRTTNPVATEQYGSVSSTNNGLQLGNN

SEQ ID NO: 27656 - protein, 29 aa, Artificial Sequence
  Description of Artificial Sequence: Synthetic peptide
DEEEIRTTNPVATEQYGSVSIENDQRDER

SEQ ID NO: 27657 - protein, 30 aa, Artificial Sequence
  Description of Artificial Sequence: Synthetic polypeptide
AEEEIRTTNPVATEQYGSVSENLVQRGEND

SEQ ID NO: 27658 - protein, 29 aa, Artificial Sequence
  Description of Artificial Sequence: Synthetic peptide
DEEEIATTNPVATECYGSVSATDLQHGNR

SEQ ID NO: 27659 - protein, 29 aa, Artificial Sequence
  Description of Artificial Sequence: Synthetic peptide
CEEEIRTTNPVATEQWGSVCSTNEERGNR

SEQ ID NO: 27660 - protein, 30 aa, Artificial Sequence
  Description of Artificial Sequence: Synthetic polypeptide
DEEEIRTTNPVATEQYGSVISENLQFEGNY

SEQ ID NO: 27661 - protein, 28 aa, Artificial Sequence
  Description of Artificial Sequence: Synthetic peptide
DEQEIRCTNPVATEIYGCVSTNLERGNR

SEQ ID NO: 27662 - protein, 29 aa, Artificial Sequence
  Description of Artificial Sequence: Synthetic peptide
DECEITTTNPVATECYGSVSTLNLQRGNF

SEQ ID NO: 27663 - protein, 29 aa, Artificial Sequence
  Description of Artificial Sequence: Synthetic peptide
DEEEIRTTNPVATEQYGSVSTNEEWQGNQ

SEQ ID NO: 27664 - protein, 30 aa, Artificial Sequence
  Description of Artificial Sequence: Synthetic polypeptide
DEEEIRTTNPVATECYGSVSTNLQPEGNDI

SEQ ID NO: 27665 - protein, 30 aa, Artificial Sequence
  Description of Artificial Sequence: Synthetic polypeptide
DEEEIATTNPVCTEQYGDVSCTNLQQRGNR

SEQ ID NO: 27666 - protein, 28 aa, Artificial Sequence
  Description of Artificial Sequence: Synthetic peptide
QEEEICATNPVATEIYGSVSTDLQRGNR

SEQ ID NO: 27667 - protein, 30 aa, Artificial Sequence
  Description of Artificial Sequence: Synthetic polypeptide
DEEEIRTTNPVSTEQYGEVSATNLQRAGGR

SEQ ID NO: 27668 - protein, 30 aa, Artificial Sequence
  Description of Artificial Sequence: Synthetic polypeptide
DEEEIRTTNPVATEQYGDVSTDLQRAGNDQ

SEQ ID NO: 27669 - protein, 29 aa, Artificial Sequence
  Description of Artificial Sequence: Synthetic peptide
DEEEIASTNPCATEQYGSVSTGNGQRGNR

SEQ ID NO: 27670 - protein, 32 aa, Artificial Sequence
  Description of Artificial Sequence: Synthetic polypeptide
DEEEIRTTNPVATEQYGSVDSTNLQDDEGENR

SEQ ID NO: 27671 - protein, 30 aa, Artificial Sequence
  Description of Artificial Sequence: Synthetic polypeptide
DEEEIRTTNPVATEQYGSVSTNPEQTGDER

SEQ ID NO: 27672 - protein, 28 aa, Artificial Sequence
  Description of Artificial Sequence: Synthetic peptide
DEQEIRTTNPVATEQYGSVSTDLQDGEF

SEQ ID NO: 27673 - protein, 28 aa, Artificial Sequence
  Description of Artificial Sequence: Synthetic peptide
DEEEIRQTNPVATEQYGSVSTGLENGND

SEQ ID NO: 27674 - protein, 30 aa, Artificial Sequence
  Description of Artificial Sequence: Synthetic polypeptide
DEEEIRTTNPVATEQYGSVSTEPLQHDGDR

SEQ ID NO: 27675 - protein, 30 aa, Artificial Sequence
  Description of Artificial Sequence: Synthetic polypeptide
DEEEIRTTNPVATECYGSVSTNLQDHNGNA

SEQ ID NO: 27676 - protein, 28 aa, Artificial Sequence
  Description of Artificial Sequence: Synthetic peptide
KEEEIRTTNPVATEQYGSVSTELQQGET

SEQ ID NO: 27677 - protein, 28 aa, Artificial Sequence
  Description of Artificial Sequence: Synthetic peptide
DEEEIRTTNPCATEQYGSVSTAEQSGNL

SEQ ID NO: 27678 - protein, 28 aa, Artificial Sequence
  Description of Artificial Sequence: Synthetic peptide
DEEEIRQTNPVATEQYGSVSTNQEVGNM

SEQ ID NO: 27679 - protein, 28 aa, Artificial Sequence
  Description of Artificial Sequence: Synthetic peptide
DEEEIRTTNPVATEQYGSVSMNEEHGNT

SEQ ID NO: 27680 - protein, 30 aa, Artificial Sequence
  Description of Artificial Sequence: Synthetic polypeptide
DEEEIRTTNPVATEQYGSVSTGLEDRGNDI

SEQ ID NO: 27681 - protein, 28 aa, Artificial Sequence
  Description of Artificial Sequence: Synthetic peptide
DEEEIRTTNPVATEQYGSVSTNDDSGEN

SEQ ID NO: 27682 - protein, 31 aa, Artificial Sequence
  Description of Artificial Sequence: Synthetic polypeptide
DEEEIRTTNPVATEQYGSVSTANEQERGNTV

SEQ ID NO: 27683 - protein, 28 aa, Artificial Sequence
  Description of Artificial Sequence: Synthetic peptide
DEEEIRTTNPVATEQYGSMSEDLQNGNS

SEQ ID NO: 27684 - protein, 30 aa, Artificial Sequence
  Description of Artificial Sequence: Synthetic polypeptide
DEQEIRTTNPVATEQYGSVDSITNDLRGNR

SEQ ID NO: 27685 - protein, 28 aa, Artificial Sequence
  Description of Artificial Sequence: Synthetic peptide
DEQEIRTTNPVATEQYGSVSTDLQHGEH

SEQ ID NO: 27686 - protein, 28 aa, Artificial Sequence
  Description of Artificial Sequence: Synthetic peptide
DEQEIRTTNPVATEQYGSVSTNLEREEI

SEQ ID NO: 27687 - protein, 29 aa, Artificial Sequence
  Description of Artificial Sequence: Synthetic peptide
DEEEIRTTNPEAVEAYGSVSTGLQRGENR

SEQ ID NO: 27688 - protein, 28 aa, Artificial Sequence
  Description of Artificial Sequence: Synthetic peptide
DEDEIRCTNPVATELYGSVSTNLQAGNL

SEQ ID NO: 27689 - protein, 28 aa, Artificial Sequence
  Description of Artificial Sequence: Synthetic peptide
DEEEIRTTNPVCTEQYGSVSTEDQLGNY

SEQ ID NO: 27690 - protein, 28 aa, Artificial Sequence
  Description of Artificial Sequence: Synthetic peptide
MEQEIRTTNPVATEQYGSVSTDLQNGNF

SEQ ID NO: 27691 - protein, 28 aa, Artificial Sequence
  Description of Artificial Sequence: Synthetic peptide
DEEEIATTNPVATEQYGSVCCNLQHGNV

SEQ ID NO: 27692 - protein, 28 aa, Artificial Sequence
  Description of Artificial Sequence: Synthetic peptide
DETECRTTNPVATEQYGSVSTDLQTGNQ

SEQ ID NO: 27693 - protein, 29 aa, Artificial Sequence
  Description of Artificial Sequence: Synthetic peptide
DEEEIRTTNPVATECYGSVSTDLQAGNDS

SEQ ID NO: 27694 - protein, 28 aa, Artificial Sequence
  Description of Artificial Sequence: Synthetic peptide
DEVEITTTNPVATEIYGSVSCNLQRGNL

SEQ ID NO: 27695 - protein, 28 aa, Artificial Sequence
  Description of Artificial Sequence: Synthetic peptide
QEEEIRTTNPVATECYGDVSTNLQRENL

SEQ ID NO: 27696 - protein, 31 aa, Artificial Sequence
  Description of Artificial Sequence: Synthetic polypeptide
DEEEIRTTNPVATEQYGSVSITNPLVRGDNM

SEQ ID NO: 27697 - protein, 31 aa, Artificial Sequence
  Description of Artificial Sequence: Synthetic polypeptide
DEHEIRTTNPVATEQYGSVSCTELQCRGNDR

SEQ ID NO: 27698 - protein, 28 aa, Artificial Sequence
  Description of Artificial Sequence: Synthetic peptide
DEEEIATVNPVATEQYGSASEVLQRGNR

SEQ ID NO: 27699 - protein, 28 aa, Artificial Sequence
  Description of Artificial Sequence: Synthetic peptide
TEEEIRTTNPVATEQYGSVSDHLQSGNQ

SEQ ID NO: 27700 - protein, 30 aa, Artificial Sequence
  Description of Artificial Sequence: Synthetic polypeptide
DEEEIRTTNPVATECYGSVSTDLQLKGNDR

SEQ ID NO: 27701 - protein, 28 aa, Artificial Sequence
  Description of Artificial Sequence: Synthetic peptide
DEEEIRTTNPVATEQYGSVSENELFGNS

SEQ ID NO: 27702 - protein, 29 aa, Artificial Sequence
  Description of Artificial Sequence: Synthetic peptide
DEEEIRATNPVATEQYGVVSTDLQRGNDD

SEQ ID NO: 27703 - protein, 31 aa, Artificial Sequence
  Description of Artificial Sequence: Synthetic polypeptide
DEEEIRTTNPVATEQYGSVSTNLEDVGENER

SEQ ID NO: 27704 - protein, 28 aa, Artificial Sequence
  Description of Artificial Sequence: Synthetic peptide
DEEEIRTTNPVATEVYGSVSDNVQRGET

SEQ ID NO: 27705 - protein, 28 aa, Artificial Sequence
  Description of Artificial Sequence: Synthetic peptide
DENEIRTTNPVATECYGSVSTNLQYGEL

SEQ ID NO: 27706 - protein, 28 aa, Artificial Sequence
  Description of Artificial Sequence: Synthetic peptide
DEEEIATTNPTATEQYGSVSTNEQQGNV

SEQ ID NO: 27707 - protein, 28 aa, Artificial Sequence
  Description of Artificial Sequence: Synthetic peptide
DENEIRTTNPVATECYGSVSTDLQRGED

SEQ ID NO: 27708 - protein, 29 aa, Artificial Sequence
  Description of Artificial Sequence: Synthetic peptide
DEQEIRTTNPVATELYGSVSTNLQDQGNM

SEQ ID NO: 27709 - protein, 28 aa, Artificial Sequence
  Description of Artificial Sequence: Synthetic peptide
DEEEIRTTNPVATEWWGIYSTNLQTGNR

SEQ ID NO: 27710 - protein, 29 aa, Artificial Sequence
  Description of Artificial Sequence: Synthetic peptide
DEEEIRTTNPVATESYGVCVSTPLQRGND

SEQ ID NO: 27711 - protein, 28 aa, Artificial Sequence
  Description of Artificial Sequence: Synthetic peptide
DEEEIATTNPVATEQYGSVSTDLEHGER

SEQ ID NO: 27712 - protein, 30 aa, Artificial Sequence
  Description of Artificial Sequence: Synthetic polypeptide
CEEEIRTTNPVATEQYGDVSTNLTQGLGNR

SEQ ID NO: 27713 - protein, 30 aa, Artificial Sequence
  Description of Artificial Sequence: Synthetic polypeptide
DEEEIRTTNPVATEQYGSVSTDLQDDGNDF

SEQ ID NO: 27714 - protein, 31 aa, Artificial Sequence
  Description of Artificial Sequence: Synthetic polypeptide
DEEEIRTTNPVATEQYGSTSTENLQLRNGND

SEQ ID NO: 27715 - protein, 28 aa, Artificial Sequence
  Description of Artificial Sequence: Synthetic peptide
DEEEIATTNPTATEQYGSVSTNEQNGNG

SEQ ID NO: 27716 - protein, 28 aa, Artificial Sequence
  Description of Artificial Sequence: Synthetic peptide
DENEIRTTNPVATEQWGSVSTNLMQGNL

SEQ ID NO: 27717 - protein, 31 aa, Artificial Sequence
  Description of Artificial Sequence: Synthetic polypeptide
DEEEIRTTNPVATEQYGSVSTMNPQERGDNI

SEQ ID NO: 27718 - protein, 28 aa, Artificial Sequence
  Description of Artificial Sequence: Synthetic peptide
DEEEIRTTNPVATEQYGSVSENLQQEDA

SEQ ID NO: 27719 - protein, 28 aa, Artificial Sequence
  Description of Artificial Sequence: Synthetic peptide
YEEEIRTVNPVATEQYGEVSTTLQHGNR

SEQ ID NO: 27720 - protein, 28 aa, Artificial Sequence
  Description of Artificial Sequence: Synthetic peptide
DEEEIRSTNPCCTEQYGSVSTDLQRANR

SEQ ID NO: 27721 - protein, 28 aa, Artificial Sequence
  Description of Artificial Sequence: Synthetic peptide
DEEEIRTTNPEATEQYWSVSTEDERGNR

SEQ ID NO: 27722 - protein, 31 aa, Artificial Sequence
  Description of Artificial Sequence: Synthetic polypeptide
DEEEIRTTNPVATEQYGSVSETNGLVQRGEF

SEQ ID NO: 27723 - protein, 30 aa, Artificial Sequence
  Description of Artificial Sequence: Synthetic polypeptide
DENEIRTTNPVATEQYGSVSTDLQENGNDR

SEQ ID NO: 27724 - protein, 29 aa, Artificial Sequence
  Description of Artificial Sequence: Synthetic peptide
DEEEIACTNPVATEQYGSVSENLQDRGNG

SEQ ID NO: 27725 - protein, 28 aa, Artificial Sequence
  Description of Artificial Sequence: Synthetic peptide
SEEEIRTTNPTATEQFGSVSTNPQIGNR

SEQ ID NO: 27726 - protein, 29 aa, Artificial Sequence
  Description of Artificial Sequence: Synthetic peptide
DEEEIRTTNPVATEQFGSVSTENEQNGNF

SEQ ID NO: 27727 - protein, 30 aa, Artificial Sequence
  Description of Artificial Sequence: Synthetic polypeptide
DEEEIRTTNPVATEQYGSVSTNLEERGEED

SEQ ID NO: 27728 - protein, 29 aa, Artificial Sequence
  Description of Artificial Sequence: Synthetic peptide
DEEEIRTTNPVATEVYGSVGEVLQRAGNR

SEQ ID NO: 27729 - protein, 30 aa, Artificial Sequence
  Description of Artificial Sequence: Synthetic polypeptide
DEEEIRTTNPVATECYGSVSENLQHKGNDR

SEQ ID NO: 27730 - protein, 30 aa, Artificial Sequence
  Description of Artificial Sequence: Synthetic polypeptide
DEEEIRTTNPVATEQYGSVSENEQRGDNTG

SEQ ID NO: 27731 - protein, 30 aa, Artificial Sequence
  Description of Artificial Sequence: Synthetic polypeptide
DEEEIRTTNPVATEQYGSVSTNPQEQGNTN

SEQ ID NO: 27732 - protein, 29 aa, Artificial Sequence
  Description of Artificial Sequence: Synthetic peptide
DEEEIRATNPVATEQYGSVSTNLQVHGEM

SEQ ID NO: 27733 - protein, 30 aa, Artificial Sequence
  Description of Artificial Sequence: Synthetic polypeptide
DEFEIRTTNPVATEQYGSVSATNEQLGDNR

SEQ ID NO: 27734 - protein, 28 aa, Artificial Sequence
  Description of Artificial Sequence: Synthetic peptide
DEEEIATTNPVATEQYGSVSTDLQDGEL

SEQ ID NO: 27735 - protein, 30 aa, Artificial Sequence
  Description of Artificial Sequence: Synthetic polypeptide
DEEEIRTTNPVATEQYGSVSTNLQDKGEDQ

SEQ ID NO: 27736 - protein, 28 aa, Artificial Sequence
  Description of Artificial Sequence: Synthetic peptide
SEVEIRATNPTATEQYGSVSENLQRGNR

SEQ ID NO: 27737 - protein, 31 aa, Artificial Sequence
  Description of Artificial Sequence: Synthetic polypeptide
DEEEIRTTNPVATEQYGDVSTNLQEHSGNDR

SEQ ID NO: 27738 - protein, 29 aa, Artificial Sequence
  Description of Artificial Sequence: Synthetic peptide
DEEEIRQTNPVATEQYGVVSTTNLQVGND

SEQ ID NO: 27739 - protein, 28 aa, Artificial Sequence
  Description of Artificial Sequence: Synthetic peptide
DEEEIRCTNPVGTEQYGSVSNNLQRGDM

SEQ ID NO: 27740 - protein, 28 aa, Artificial Sequence
  Description of Artificial Sequence: Synthetic peptide
DEQEIRTTNPVATEQYGSCSTNEQHGND

SEQ ID NO: 27741 - protein, 28 aa, Artificial Sequence
  Description of Artificial Sequence: Synthetic peptide
KEHEIRTTNPVATEQYGSVSTNLQHEDR

SEQ ID NO: 27742 - protein, 29 aa, Artificial Sequence
  Description of Artificial Sequence: Synthetic peptide
DEMEIRTTNPVSTEQYGSVSTNLQMNGNI

SEQ ID NO: 27743 - protein, 30 aa, Artificial Sequence
  Description of Artificial Sequence: Synthetic polypeptide
DEEEIRTTNPVATEWYGSVSTNDQRKGEDR

SEQ ID NO: 27744 - protein, 31 aa, Artificial Sequence
  Description of Artificial Sequence: Synthetic polypeptide
DEEEIATTNPVATEQYGVVSTTNLVQRGENR

SEQ ID NO: 27745 - protein, 28 aa, Artificial Sequence
  Description of Artificial Sequence: Synthetic peptide
DEHEIRTTNPVATEQYGDVSEDLQRGNQ

SEQ ID NO: 27746 - protein, 30 aa, Artificial Sequence
  Description of Artificial Sequence: Synthetic polypeptide
DEEEIRTTNPVATEQYGSVSITNLQDGEDS

SEQ ID NO: 27747 - protein, 28 aa, Artificial Sequence
  Description of Artificial Sequence: Synthetic peptide
DENEIRQTNPVATEQYGVVSTNPDRGNR

SEQ ID NO: 27748 - protein, 31 aa, Artificial Sequence
  Description of Artificial Sequence: Synthetic polypeptide
DEDEIRTTNPVATEQYGSVISTNLQLIGNTR

SEQ ID NO: 27749 - protein, 28 aa, Artificial Sequence
  Description of Artificial Sequence: Synthetic peptide
DEQEIRTTNPVATEQYGSVSTDLQMEER

SEQ ID NO: 27750 - protein, 28 aa, Artificial Sequence
  Description of Artificial Sequence: Synthetic peptide
DEEEIRTTNPVATEQYGSVDTPEEMGNR

SEQ ID NO: 27751 - protein, 30 aa, Artificial Sequence
  Description of Artificial Sequence: Synthetic polypeptide
DEEEIRTTNPVATEIYGVVSTNLQRGENDW

SEQ ID NO: 27752 - protein, 28 aa, Artificial Sequence
  Description of Artificial Sequence: Synthetic peptide
DEQEIRTTNPVATELWGSVSTNLMRGNA

SEQ ID NO: 27753 - protein, 30 aa, Artificial Sequence
  Description of Artificial Sequence: Synthetic polypeptide
DEEEIRTTNPVATEQFGSVNTNGLQRGNTF

SEQ ID NO: 27754 - protein, 28 aa, Artificial Sequence
  Description of Artificial Sequence: Synthetic peptide
DEQEIRTTNPVATEQYGIVSENLQREHR

SEQ ID NO: 27755 - protein, 32 aa, Artificial Sequence
  Description of Artificial Sequence: Synthetic polypeptide
DEEEIRTTNPVATEQYGSVSETNGLQLDGENR

SEQ ID NO: 27756 - protein, 28 aa, Artificial Sequence
  Description of Artificial Sequence: Synthetic peptide
DEEEIATTNPVATEQYGSVSTDLQVGEM

SEQ ID NO: 27757 - protein, 28 aa, Artificial Sequence
  Description of Artificial Sequence: Synthetic peptide
QEEEIRTTNPVSTEQYGSVSTLLQHGNI

SEQ ID NO: 27758 - protein, 31 aa, Artificial Sequence
  Description of Artificial Sequence: Synthetic polypeptide
DEEEIRTTNPVATEQYGSVSTNLQEVEGEDR

SEQ ID NO: 27759 - protein, 31 aa, Artificial Sequence
  Description of Artificial Sequence: Synthetic polypeptide
DEEEIRTTNPVATEQYGSVSATNLQDNGNDT

SEQ ID NO: 27760 - protein, 32 aa, Artificial Sequence
  Description of Artificial Sequence: Synthetic polypeptide
DEEEIRTTNPVATEQYGSVSTLNLQNRGENLF

SEQ ID NO: 27761 - protein, 28 aa, Artificial Sequence
  Description of Artificial Sequence: Synthetic peptide
DEEEIAQTNPVATEQYGSVSTNLQGGEA

SEQ ID NO: 27762 - protein, 29 aa, Artificial Sequence
  Description of Artificial Sequence: Synthetic peptide
AEEEIRTTNPVATEQYGSVSCTNIQNGNM

SEQ ID NO: 27763 - protein, 28 aa, Artificial Sequence
  Description of Artificial Sequence: Synthetic peptide
DEEEIRTTNPVATEQYGSVSTNEMTGDQ

SEQ ID NO: 27764 - protein, 28 aa, Artificial Sequence
  Description of Artificial Sequence: Synthetic peptide
DEEEISTVNPVATEQYGDVSTNDQQGNR

SEQ ID NO: 27765 - protein, 30 aa, Artificial Sequence
  Description of Artificial Sequence: Synthetic polypeptide
DEEEIRTTNPVATEQYGSVSTMNEQDIGNV

SEQ ID NO: 27766 - protein, 28 aa, Artificial Sequence
  Description of Artificial Sequence: Synthetic peptide
DENEIRSTNPVATEQYGWVSTNLQVGNA

SEQ ID NO: 27767 - protein, 28 aa, Artificial Sequence
  Description of Artificial Sequence: Synthetic peptide
KEEEIRTVNPVATEMYGSVSTNLQTGNQ

SEQ ID NO: 27768 - protein, 29 aa, Artificial Sequence
  Description of Artificial Sequence: Synthetic peptide
DESEIRTTNPVSTEMYGSVSTNLQRNGNG

SEQ ID NO: 27769 - protein, 31 aa, Artificial Sequence
  Description of Artificial Sequence: Synthetic polypeptide
DEEEIRTTNPVATENYGSVSTTNPLQTNGNR

SEQ ID NO: 27770 - protein, 28 aa, Artificial Sequence
  Description of Artificial Sequence: Synthetic peptide
DEEEIRTTNPVATEQYGSVDTDPQNGDR

SEQ ID NO: 27771 - protein, 30 aa, Artificial Sequence
  Description of Artificial Sequence: Synthetic polypeptide
DEEEIRATNPVATEHYGSVSTGLPQRGNLR

SEQ ID NO: 27772 - protein, 29 aa, Artificial Sequence
  Description of Artificial Sequence: Synthetic peptide
DEEEIRTTNPVATELWGSVSTNEQMTGNR

SEQ ID NO: 27773 - protein, 28 aa, Artificial Sequence
  Description of Artificial Sequence: Synthetic peptide
DEEEIATTNPVATECYGSVSTNLETGNI

SEQ ID NO: 27774 - protein, 28 aa, Artificial Sequence
  Description of Artificial Sequence: Synthetic peptide
SEEEIRTTNPTATEQFGSVSTDLQRGNF

SEQ ID NO: 27775 - protein, 31 aa, Artificial Sequence
  Description of Artificial Sequence: Synthetic polypeptide
DEEEIRTTNPVATEQYGSVSTNLQEVEGNDS

SEQ ID NO: 27776 - protein, 29 aa, Artificial Sequence
  Description of Artificial Sequence: Synthetic peptide
DEEEIRATNPVATEQYGSIATINLQRGDR

SEQ ID NO: 27777 - protein, 30 aa, Artificial Sequence
  Description of Artificial Sequence: Synthetic polypeptide
DEEEIRTTNPVATEQYGSVSTNLQDGGEDT

SEQ ID NO: 27778 - protein, 30 aa, Artificial Sequence
  Description of Artificial Sequence: Synthetic polypeptide
DEEEIRTTNPVATEQYGSVSTDLQRKGEDQ

SEQ ID NO: 27779 - protein, 28 aa, Artificial Sequence
  Description of Artificial Sequence: Synthetic peptide
DEEEIRTTNPVATEQYGSVSTDLEWGEL

SEQ ID NO: 27780 - protein, 28 aa, Artificial Sequence
  Description of Artificial Sequence: Synthetic peptide
TEEEIRTTNPVGTEQYGNVSENLQRGNA

SEQ ID NO: 27781 - protein, 28 aa, Artificial Sequence
  Description of Artificial Sequence: Synthetic peptide
KEEEIRTTNPVATECYGSVSTNLQLGDY

SEQ ID NO: 27782 - protein, 28 aa, Artificial Sequence
  Description of Artificial Sequence: Synthetic peptide
DEEEIRTTNPVATEQYGSVSTNPQEDEP

SEQ ID NO: 27783 - protein, 29 aa, Artificial Sequence
  Description of Artificial Sequence: Synthetic peptide
DEEEIRTTNPVATECYGSVSTELQESGNW

SEQ ID NO: 27784 - protein, 31 aa, Artificial Sequence
  Description of Artificial Sequence: Synthetic polypeptide
DEEEIATTNPVATEQYGSVSDTGNLVQNGNR

SEQ ID NO: 27785 - protein, 32 aa, Artificial Sequence
  Description of Artificial Sequence: Synthetic polypeptide
DEEEIRTTNPVATEQYGSVSTDNLTDIRGSNR

SEQ ID NO: 27786 - protein, 29 aa, Artificial Sequence
  Description of Artificial Sequence: Synthetic peptide
DEEEIRTVNPVATEQYGSVSAEILQRGGR

SEQ ID NO: 27787 - protein, 28 aa, Artificial Sequence
  Description of Artificial Sequence: Synthetic peptide
DETEIRTTNPVATEQYGYVSTNLQRLEQ

SEQ ID NO: 27788 - protein, 28 aa, Artificial Sequence
  Description of Artificial Sequence: Synthetic peptide
DEEEIRTTNPVATEQYGSVSTEPQIGEH

SEQ ID NO: 27789 - protein, 29 aa, Artificial Sequence
  Description of Artificial Sequence: Synthetic peptide
DEEEIRTTNPVATEHYGSVFSENLQSGNF

SEQ ID NO: 27790 - protein, 31 aa, Artificial Sequence
  Description of Artificial Sequence: Synthetic polypeptide
DEEEIRTTNPVATEQYGSVSCTMELQRGNDS

SEQ ID NO: 27791 - protein, 28 aa, Artificial Sequence
  Description of Artificial Sequence: Synthetic peptide
DEEEIRTTNPVATEQWGSVSEGLQDGER

SEQ ID NO: 27792 - protein, 30 aa, Artificial Sequence
  Description of Artificial Sequence: Synthetic polypeptide
DEEEIRTTNPVATEQWGSVTSMTNGQRGER

SEQ ID NO: 27793 - protein, 28 aa, Artificial Sequence
  Description of Artificial Sequence: Synthetic peptide
MENEIRTTNPVATEQYGSVSTNLQFGDA

SEQ ID NO: 27794 - protein, 28 aa, Artificial Sequence
  Description of Artificial Sequence: Synthetic peptide
DEEEIRTTNPVSTECYGSVSTNLQPGEN

SEQ ID NO: 27795 - protein, 28 aa, Artificial Sequence
  Description of Artificial Sequence: Synthetic peptide
DEEEIRQTNPVATEQYGSASTNCQHGER

SEQ ID NO: 27796 - protein, 30 aa, Artificial Sequence
  Description of Artificial Sequence: Synthetic polypeptide
DEEEIATTNPVATEQYGSVSTDLQRKGEDR

SEQ ID NO: 27797 - protein, 28 aa, Artificial Sequence
  Description of Artificial Sequence: Synthetic peptide
DEEEIRTTNPVATEQYGSVSENLQTEEL

SEQ ID NO: 27798 - protein, 28 aa, Artificial Sequence
  Description of Artificial Sequence: Synthetic peptide
DEEEIRTTNPCSTENYGSVSTNLQRGEE

SEQ ID NO: 27799 - protein, 30 aa, Artificial Sequence
  Description of Artificial Sequence: Synthetic polypeptide
DEEEIRTTNPVATECYGSVSTNGLQERGET

SEQ ID NO: 27800 - protein, 28 aa, Artificial Sequence
  Description of Artificial Sequence: Synthetic peptide
NEEEIRTTNPVATEQYGSVDTDLQQGNS

SEQ ID NO: 27801 - protein, 29 aa, Artificial Sequence
  Description of Artificial Sequence: Synthetic peptide
DEEEIRTTNPVATEQYGSVSTELQWKGDM

SEQ ID NO: 27802 - protein, 28 aa, Artificial Sequence
  Description of Artificial Sequence: Synthetic peptide
DEEEIRTTNPVATEWWGSVSTNEQRGDQ

SEQ ID NO: 27803 - protein, 28 aa, Artificial Sequence
  Description of Artificial Sequence: Synthetic peptide
DEEEIATTNPVATEQYGSVSTDLQIGEN

SEQ ID NO: 27804 - protein, 31 aa, Artificial Sequence
  Description of Artificial Sequence: Synthetic polypeptide
DEEEIRTTNPVATEQYGVVSVTNLQRKGDER

SEQ ID NO: 27805 - protein, 30 aa, Artificial Sequence
  Description of Artificial Sequence: Synthetic polypeptide
DEEEIRTTNPVATEQYGSVSTNEQDIGDNV

SEQ ID NO: 27806 - protein, 30 aa, Artificial Sequence
  Description of Artificial Sequence: Synthetic polypeptide
DEEEIRTTNPVATEQYGSVSTDLEDRGNDL

SEQ ID NO: 27807 - protein, 28 aa, Artificial Sequence
  Description of Artificial Sequence: Synthetic peptide
DEQEIRTTNPVATECYGSVSTNLERGES

SEQ ID NO: 27808 - protein, 30 aa, Artificial Sequence
  Description of Artificial Sequence: Synthetic polypeptide
DEEEIRTTNPVATEQYGSVSTNLEDHEGER

SEQ ID NO: 27809 - protein, 28 aa, Artificial Sequence
  Description of Artificial Sequence: Synthetic peptide
DEEEIRCTNPVATEIYGWVSMNLQRGNE

SEQ ID NO: 27810 - protein, 28 aa, Artificial Sequence
  Description of Artificial Sequence: Synthetic peptide
DEVEIRTTNPVATEQYGDVSTNFQQGNS

SEQ ID NO: 27811 - protein, 29 aa, Artificial Sequence
  Description of Artificial Sequence: Synthetic peptide
DEEEIRTTNPVATEQYGSVSTDLQQGEDA

SEQ ID NO: 27812 - protein, 30 aa, Artificial Sequence
  Description of Artificial Sequence: Synthetic polypeptide
DEEEIRTTNPVATEQYGSVSTNDQQSGNDE

SEQ ID NO: 27813 - protein, 28 aa, Artificial Sequence
  Description of Artificial Sequence: Synthetic peptide
DESEIISTNPVATEQYGSVSEQLQRGNR

SEQ ID NO: 27814 - protein, 28 aa, Artificial Sequence
  Description of Artificial Sequence: Synthetic peptide
DEEEIRTTNPTATEQYGSVSTALQLGTL

SEQ ID NO: 27815 - protein, 29 aa, Artificial Sequence
  Description of Artificial Sequence: Synthetic peptide
DEQEIRTTNPVATECYGSVSETNLQIGNL

SEQ ID NO: 27816 - protein, 31 aa, Artificial Sequence
  Description of Artificial Sequence: Synthetic polypeptide
DEEEIRTTNPVATEQYGSVSTTDNGLERENR

SEQ ID NO: 27817 - protein, 28 aa, Artificial Sequence
  Description of Artificial Sequence: Synthetic peptide
DENEIRTTNPVATELWGSVSENLQIGNR

SEQ ID NO: 27818 - protein, 28 aa, Artificial Sequence
  Description of Artificial Sequence: Synthetic peptide
DDEEIRTTNPVATEQYGSVSTELQLGTQ

SEQ ID NO: 27819 - protein, 28 aa, Artificial Sequence
  Description of Artificial Sequence: Synthetic peptide
DEEEIRTTNPVATEQYGSVDTEDQSGNH

SEQ ID NO: 27820 - protein, 28 aa, Artificial Sequence
  Description of Artificial Sequence: Synthetic peptide
DEVEIRATNPVATEQFGSVSTNEQRGTR

SEQ ID NO: 27821 - protein, 30 aa, Artificial Sequence
  Description of Artificial Sequence: Synthetic polypeptide
DEEEIRTTNPVATEQYGSVSTDLQDHGEDR

SEQ ID NO: 27822 - protein, 31 aa, Artificial Sequence
  Description of Artificial Sequence: Synthetic polypeptide
DEEEIRTTNPVATEQYGSVSTNLVQPGGNDE

SEQ ID NO: 27823 - protein, 28 aa, Artificial Sequence
  Description of Artificial Sequence: Synthetic peptide
MEEEIRTTNPVATEVYGSVSTALQDGND

SEQ ID NO: 27824 - protein, 28 aa, Artificial Sequence
  Description of Artificial Sequence: Synthetic peptide
DEEEIRTTNPVATECYGSVSTELQVGEV

SEQ ID NO: 27825 - protein, 28 aa, Artificial Sequence
  Description of Artificial Sequence: Synthetic peptide
AEEEIRQTNPVATEQYGSVSENLQQGNV

SEQ ID NO: 27826 - protein, 31 aa, Artificial Sequence
  Description of Artificial Sequence: Synthetic polypeptide
DEEEIRTTNPVATEQYGSVDSTNLQDIGDNL

SEQ ID NO: 27827 - protein, 28 aa, Artificial Sequence
  Description of Artificial Sequence: Synthetic peptide
DEEEIRATNPVATECYGSVSTELQSGDR

SEQ ID NO: 27828 - protein, 29 aa, Artificial Sequence
  Description of Artificial Sequence: Synthetic peptide
DEEEIRTTNPVATEQWGSVSTNEMNRGNM

SEQ ID NO: 27829 - protein, 28 aa, Artificial Sequence
  Description of Artificial Sequence: Synthetic peptide
DEEEIRTTNPVATETFGSVSTNPQQGNF

SEQ ID NO: 27830 - protein, 28 aa, Artificial Sequence
  Description of Artificial Sequence: Synthetic peptide
DENEIRTTNPVATEQYGSVSCNQIRGND

SEQ ID NO: 27831 - protein, 29 aa, Artificial Sequence
  Description of Artificial Sequence: Synthetic peptide
DEVEIRTTNPVATEQYGSVSTGDLQGGND

SEQ ID NO: 27832 - protein, 28 aa, Artificial Sequence
  Description of Artificial Sequence: Synthetic peptide
DEEEIRTTNPVATECWGSVSTNLEVGNS

SEQ ID NO: 27833 - protein, 29 aa, Artificial Sequence
  Description of Artificial Sequence: Synthetic peptide
DEEEIATVNPVATEQYGSVSAENLQRGGR

SEQ ID NO: 27834 - protein, 29 aa, Artificial Sequence
  Description of Artificial Sequence: Synthetic peptide
DEEEIRTTNPVASEIYGCVSATNLERGNR

SEQ ID NO: 27835 - protein, 30 aa, Artificial Sequence
  Description of Artificial Sequence: Synthetic polypeptide
DEEEIRTTNPVATECYGVVSTNLQEDKGNR

SEQ ID NO: 27836 - protein, 30 aa, Artificial Sequence
  Description of Artificial Sequence: Synthetic polypeptide
DECEIRATNPVATEQYGSVSATNLQRAGMR

SEQ ID NO: 27837 - protein, 28 aa, Artificial Sequence
  Description of Artificial Sequence: Synthetic peptide
DEEEICTTNPVCTEQWGSVCTNLQRLNR

SEQ ID NO: 27838 - protein, 29 aa, Artificial Sequence
  Description of Artificial Sequence: Synthetic peptide
DDEEIRTTNPVATEQYGVVCSTNLQRGDW

SEQ ID NO: 27839 - protein, 28 aa, Artificial Sequence
  Description of Artificial Sequence: Synthetic peptide
MEEEIASTNPVATEQYGNVSMNLQRGNR

SEQ ID NO: 27840 - protein, 28 aa, Artificial Sequence
  Description of Artificial Sequence: Synthetic peptide
DEEEIRTTNPFATEQYGSVSTGLILGER

SEQ ID NO: 27841 - protein, 28 aa, Artificial Sequence
  Description of Artificial Sequence: Synthetic peptide
DEEEIRTTNPVATEQWGSVSTNLMQGDA

SEQ ID NO: 27842 - protein, 30 aa, Artificial Sequence
  Description of Artificial Sequence: Synthetic polypeptide
DENEIATTNPVATEQYGSVSTNLQRNGEER

SEQ ID NO: 27843 - protein, 29 aa, Artificial Sequence
  Description of Artificial Sequence: Synthetic peptide
DEEEIRTTNPVATECWGSVSTNLQIQGNL

SEQ ID NO: 27844 - protein, 30 aa, Artificial Sequence
  Description of Artificial Sequence: Synthetic polypeptide
SEEEIRTTNPVATEQYGSVSTNEQVEGNTR

SEQ ID NO: 27845 - protein, 30 aa, Artificial Sequence
  Description of Artificial Sequence: Synthetic polypeptide
DEEEIRTTNPVATEQYGSVDDTDELQRGER

SEQ ID NO: 27846 - protein, 28 aa, Artificial Sequence
  Description of Artificial Sequence: Synthetic peptide
DEMEIRGTNPVATEQWGSVSTNLQVGNE

SEQ ID NO: 27847 - protein, 28 aa, Artificial Sequence
  Description of Artificial Sequence: Synthetic peptide
DDSEIRTTNPVATEQYGSVATNLDRGER

SEQ ID NO: 27848 - protein, 29 aa, Artificial Sequence
  Description of Artificial Sequence: Synthetic peptide
DENEIRTTNPVATEQYGSVSENLMMRGNA

SEQ ID NO: 27849 - protein, 28 aa, Artificial Sequence
  Description of Artificial Sequence: Synthetic peptide
DEEEIRTTNPVATEQYGSVSDNDQVGTT

SEQ ID NO: 27850 - protein, 28 aa, Artificial Sequence
  Description of Artificial Sequence: Synthetic peptide
MEEEIATTNPVATEQYGSVSTNLQHGEV

SEQ ID NO: 27851 - protein, 31 aa, Artificial Sequence
  Description of Artificial Sequence: Synthetic polypeptide
DEEEIRTTNPVATEQYGSVSTNPLQVFKGER

SEQ ID NO: 27852 - protein, 29 aa, Artificial Sequence
  Description of Artificial Sequence: Synthetic peptide
DEEEIRTTNPVATECYGSVSTNEQMLGNA

SEQ ID NO: 27853 - protein, 29 aa, Artificial Sequence
  Description of Artificial Sequence: Synthetic peptide
DEEEIRTTNPVATECYGSVSTNLEERGEI

SEQ ID NO: 27854 - protein, 28 aa, Artificial Sequence
  Description of Artificial Sequence: Synthetic peptide
DEEEIVTTNPVATEQYGTASTNDERGNR

SEQ ID NO: 27855 - protein, 28 aa, Artificial Sequence
  Description of Artificial Sequence: Synthetic peptide
DEEEIRTTNPVATEQYGSVSADLYQGNE

SEQ ID NO: 27856 - protein, 30 aa, Artificial Sequence
  Description of Artificial Sequence: Synthetic polypeptide
DENEIRTTNPVATEQYGSVATNLQVEGNDR

SEQ ID NO: 27857 - protein, 28 aa, Artificial Sequence
  Description of Artificial Sequence: Synthetic peptide
DTEEIRTTNPVATEQWGSVHTNLQPGNP

SEQ ID NO: 27858 - protein, 30 aa, Artificial Sequence
  Description of Artificial Sequence: Synthetic polypeptide
DEEEIRTTNPVATEQYGSVSTLLQEHSGNN

SEQ ID NO: 27859 - protein, 28 aa, Artificial Sequence
  Description of Artificial Sequence: Synthetic peptide
DEEEIVTTNPVATECYGSVSTNLEDGNW

SEQ ID NO: 27860 - protein, 30 aa, Artificial Sequence
  Description of Artificial Sequence: Synthetic polypeptide
DEEEIRTTNPTATEQYGSVSTNLQEIGNDI

SEQ ID NO: 27861 - protein, 30 aa, Artificial Sequence
  Description of Artificial Sequence: Synthetic polypeptide
DEEEIRTTNPVATEQYGSVSETELERGNDY

SEQ ID NO: 27862 - protein, 31 aa, Artificial Sequence
  Description of Artificial Sequence: Synthetic polypeptide
DEEEIRTTNPVATEQYGSVSTPPQFRGLNDR

SEQ ID NO: 27863 - protein, 28 aa, Artificial Sequence
  Description of Artificial Sequence: Synthetic peptide
DEEEIRTTNPVATEQYGSVSDNDERENN

SEQ ID NO: 27864 - protein, 31 aa, Artificial Sequence
  Description of Artificial Sequence: Synthetic polypeptide
DEEEIRTTNPVATEQYGSVCSMNGLQRGEER

SEQ ID NO: 27865 - protein, 28 aa, Artificial Sequence
  Description of Artificial Sequence: Synthetic peptide
DEEEIRTTNPVGTENYGSVSTQLQRGTI

SEQ ID NO: 27866 - protein, 28 aa, Artificial Sequence
  Description of Artificial Sequence: Synthetic peptide
QEEEIRTTNPVATQQYGSVSTELQDGNS

SEQ ID NO: 27867 - protein, 30 aa, Artificial Sequence
  Description of Artificial Sequence: Synthetic polypeptide
DEEEIRTTNPVATEQYGSVSTANPQQGNTI

SEQ ID NO: 27868 - protein, 28 aa, Artificial Sequence
  Description of Artificial Sequence: Synthetic peptide
DEVEIRTTNPVATECYGDVSTNLQLGNM

SEQ ID NO: 27869 - protein, 30 aa, Artificial Sequence
  Description of Artificial Sequence: Synthetic polypeptide
DEEEIATTNPVATEQYGSVSTNLQDFKGDR

SEQ ID NO: 27870 - protein, 30 aa, Artificial Sequence
  Description of Artificial Sequence: Synthetic polypeptide
DEEEIRTTNPVATEQYGSVSATNLEREGEL

SEQ ID NO: 27871 - protein, 29 aa, Artificial Sequence
  Description of Artificial Sequence: Synthetic peptide
DEEEIRTTNPVATECYGSVSENLQQGNDL

SEQ ID NO: 27872 - protein, 30 aa, Artificial Sequence
  Description of Artificial Sequence: Synthetic polypeptide
DEEEIRTTNPVATEQFGGVSTMALQRGDNR

SEQ ID NO: 27873 - protein, 29 aa, Artificial Sequence
  Description of Artificial Sequence: Synthetic peptide
DEEEIRTTNPVATEQYGSTSTEDERGNER

SEQ ID NO: 27874 - protein, 29 aa, Artificial Sequence
  Description of Artificial Sequence: Synthetic peptide
MENEIRTTNPVATEQYGSVSTNLQENGNA

SEQ ID NO: 27875 - protein, 28 aa, Artificial Sequence
  Description of Artificial Sequence: Synthetic peptide
DEEEIRTTNPVSTEQWGIVSTNLQRGDF

SEQ ID NO: 27876 - protein, 28 aa, Artificial Sequence
  Description of Artificial Sequence: Synthetic peptide
DEEEIRTTNPTATEQYGGVSMNLQQGNI

SEQ ID NO: 27877 - protein, 28 aa, Artificial Sequence
  Description of Artificial Sequence: Synthetic peptide
DEVEIRTTNPVATEQYGVVSTNLQTGEH

SEQ ID NO: 27878 - protein, 30 aa, Artificial Sequence
  Description of Artificial Sequence: Synthetic polypeptide
DEEEIRTTNPVATEQYGSVSTDLQDQGNDS

SEQ ID NO: 27879 - protein, 32 aa, Artificial Sequence
  Description of Artificial Sequence: Synthetic polypeptide
DEEEIRTTNPVATEQYGSVSTNGLQPKGENDR

SEQ ID NO: 27880 - protein, 30 aa, Artificial Sequence
  Description of Artificial Sequence: Synthetic polypeptide
SEEEIRTTNPVATEMYGSVSTNLQEREGNS

SEQ ID NO: 27881 - protein, 28 aa, Artificial Sequence
  Description of Artificial Sequence: Synthetic peptide
MENEIRTTNPVATEMYGSVSTNLQLGNM

SEQ ID NO: 27882 - protein, 29 aa, Artificial Sequence
  Description of Artificial Sequence: Synthetic peptide
DENEIRTTNPVATEQWGSHVSENLQRGDR

SEQ ID NO: 27883 - protein, 30 aa, Artificial Sequence
  Description of Artificial Sequence: Synthetic polypeptide
DEEEICTTNPVATEQYGSVSANLQDFGNTR

SEQ ID NO: 27884 - protein, 28 aa, Artificial Sequence
  Description of Artificial Sequence: Synthetic peptide
DEESIRTTNPVATELYGGVSTNWQRGNQ

SEQ ID NO: 27885 - protein, 29 aa, Artificial Sequence
  Description of Artificial Sequence: Synthetic peptide
DEEEIRTTNPVATEHYGSVANNLELRGNR

SEQ ID NO: 27886 - protein, 29 aa, Artificial Sequence
  Description of Artificial Sequence: Synthetic peptide
DEEEIRATNPTATEIYGSVSTNLQSGNDR

SEQ ID NO: 27887 - protein, 28 aa, Artificial Sequence
  Description of Artificial Sequence: Synthetic peptide
DEEEIATTNPVATEQYGSVSTDLEAGNF

SEQ ID NO: 27888 - protein, 31 aa, Artificial Sequence
  Description of Artificial Sequence: Synthetic polypeptide
DEEEIRPTNPVATEQYGSVSEPNLQRGDNPR

SEQ ID NO: 27889 - protein, 28 aa, Artificial Sequence
  Description of Artificial Sequence: Synthetic peptide
DESEIRTTNPVATECYGSVSTNQQRGEY

SEQ ID NO: 27890 - protein, 31 aa, Artificial Sequence
  Description of Artificial Sequence: Synthetic polypeptide
DEGEIRTTNPVATEQYGSVSTGNLQRGENQF

SEQ ID NO: 27891 - protein, 28 aa, Artificial Sequence
  Description of Artificial Sequence: Synthetic peptide
DEEEIRTTNPVSTEQYGSAPTNLQHENR

SEQ ID NO: 27892 - protein, 28 aa, Artificial Sequence
  Description of Artificial Sequence: Synthetic peptide
DEEEIRTTNPVATEQYGSVDTNDDRGEL

SEQ ID NO: 27893 - protein, 29 aa, Artificial Sequence
  Description of Artificial Sequence: Synthetic peptide
QEEEIRTTNPVATEQYGSVSDILQNHGNR

SEQ ID NO: 27894 - protein, 30 aa, Artificial Sequence
  Description of Artificial Sequence: Synthetic polypeptide
DEEEIRTTNPVATEQYGDVSTENLQTTGNQ

SEQ ID NO: 27895 - protein, 30 aa, Artificial Sequence
  Description of Artificial Sequence: Synthetic polypeptide
DENEIRTTNPVATECYGSVSTNLQVLGENR

SEQ ID NO: 27896 - protein, 28 aa, Artificial Sequence
  Description of Artificial Sequence: Synthetic peptide
DEEEIVTTNPVATEQYGEASENLQRGGR

SEQ ID NO: 27897 - protein, 28 aa, Artificial Sequence
  Description of Artificial Sequence: Synthetic peptide
DEEEIATTNPVATEQYGSVSTDLQYGEL

SEQ ID NO: 27898 - protein, 31 aa, Artificial Sequence
  Description of Artificial Sequence: Synthetic polypeptide
DEEEIRTTNPVAFEQYGSVSMTNLQERKGER

SEQ ID NO: 27899 - protein, 28 aa, Artificial Sequence
  Description of Artificial Sequence: Synthetic peptide
DEEEIRTTNPVATEQYGSVSTNDESGEF

SEQ ID NO: 27900 - protein, 30 aa, Artificial Sequence
  Description of Artificial Sequence: Synthetic polypeptide
DEEEIRTTNPVATECYGSVSETELQRNGER

SEQ ID NO: 27901 - protein, 28 aa, Artificial Sequence
  Description of Artificial Sequence: Synthetic peptide
GEQEIRCTNPVATEPYGSVSTNLQAGNR

SEQ ID NO: 27902 - protein, 30 aa, Artificial Sequence
  Description of Artificial Sequence: Synthetic polypeptide
DEQEIRTTNPVATEQYGSVSETNDQRDGNM

SEQ ID NO: 27903 - protein, 28 aa, Artificial Sequence
  Description of Artificial Sequence: Synthetic peptide
DEEEIRTTNPVATEQYGSVETDDQRGEY

SEQ ID NO: 27904 - protein, 28 aa, Artificial Sequence
  Description of Artificial Sequence: Synthetic peptide
DEEEIRATNPVATEIYGVVSTELQLGNR

SEQ ID NO: 27905 - protein, 28 aa, Artificial Sequence
  Description of Artificial Sequence: Synthetic peptide
DEEEIRTTNPVATEQYGSVQTDKIIGNR

SEQ ID NO: 27906 - protein, 28 aa, Artificial Sequence
  Description of Artificial Sequence: Synthetic peptide
DEEEIATTNPVATEQYGSVSTDLQTGET

SEQ ID NO: 27907 - protein, 28 aa, Artificial Sequence
  Description of Artificial Sequence: Synthetic peptide
DEEEIATTNPVATECYGSVSTNLERGED

SEQ ID NO: 27908 - protein, 28 aa, Artificial Sequence
  Description of Artificial Sequence: Synthetic peptide
DEQEIRTTNPVATEQYGDVSEELQRGNS

SEQ ID NO: 27909 - protein, 30 aa, Artificial Sequence
  Description of Artificial Sequence: Synthetic polypeptide
DEEEIRTTNPVATEQYGSVSTNPLQDAGED

SEQ ID NO: 27910 - protein, 28 aa, Artificial Sequence
  Description of Artificial Sequence: Synthetic peptide
DEEEIRTTNPVATEQYGSVSTDLEHGEQ

SEQ ID NO: 27911 - protein, 28 aa, Artificial Sequence
  Description of Artificial Sequence: Synthetic peptide
MEQEIRTTNPVATEQYGSVSENLQSGNM

SEQ ID NO: 27912 - protein, 29 aa, Artificial Sequence
  Description of Artificial Sequence: Synthetic peptide
DEEEIRATNPVATEQFGSVSTNEQLGNTR

SEQ ID NO: 27913 - protein, 28 aa, Artificial Sequence
  Description of Artificial Sequence: Synthetic peptide
DESEIRTVNPVATEMYGSVSTNLERPNR

SEQ ID NO: 27914 - protein, 29 aa, Artificial Sequence
  Description of Artificial Sequence: Synthetic peptide
DEEEIRTTNPVATECYGSVSTDLQRGDDF

SEQ ID NO: 27915 - protein, 28 aa, Artificial Sequence
  Description of Artificial Sequence: Synthetic peptide
DEEEIRTTNPVATEQYGTVSENLQIGED

SEQ ID NO: 27916 - protein, 28 aa, Artificial Sequence
  Description of Artificial Sequence: Synthetic peptide
DEEEIRTTNPVATEQYGEVSDNLQQGEV

SEQ ID NO: 27917 - protein, 31 aa, Artificial Sequence
  Description of Artificial Sequence: Synthetic polypeptide
DEEEIRTTNPVATEQYGSVSCEMNLQRGNDS

SEQ ID NO: 27918 - protein, 28 aa, Artificial Sequence
  Description of Artificial Sequence: Synthetic peptide
DEEEIATTNPVATECYGSVSTNLEQGER

SEQ ID NO: 27919 - protein, 28 aa, Artificial Sequence
  Description of Artificial Sequence: Synthetic peptide
DEEEIRTTNPVATEWYGSVSTGLDQGER

SEQ ID NO: 27920 - protein, 28 aa, Artificial Sequence
  Description of Artificial Sequence: Synthetic peptide
DEEEIRTTNPVATEQYGSVSTGPEIGNY

SEQ ID NO: 27921 - protein, 30 aa, Artificial Sequence
  Description of Artificial Sequence: Synthetic polypeptide
DEEEIRTTNPVATEQYGSVSTVNLIHKGNG

SEQ ID NO: 27922 - protein, 29 aa, Artificial Sequence
  Description of Artificial Sequence: Synthetic peptide
DEEEIRTTNPVATEQYGQVSTLDNLVGNR

SEQ ID NO: 27923 - protein, 28 aa, Artificial Sequence
  Description of Artificial Sequence: Synthetic peptide
DEEEIRTTNPVATECYGSVSTDLQIGET

SEQ ID NO: 27924 - protein, 30 aa, Artificial Sequence
  Description of Artificial Sequence: Synthetic polypeptide
DEEEIRTTNPTATEQYGSVSTMNLQQMNDR

SEQ ID NO: 27925 - protein, 28 aa, Artificial Sequence
  Description of Artificial Sequence: Synthetic peptide
DEEEIATTNPVATEMYGEVSTNLQMGNF

SEQ ID NO: 27926 - protein, 28 aa, Artificial Sequence
  Description of Artificial Sequence: Synthetic peptide
DEEEIRTTNPVATEQYGSVSTDQENGND

SEQ ID NO: 27927 - protein, 28 aa, Artificial Sequence
  Description of Artificial Sequence: Synthetic peptide
DEEEIRTTNPVATEQYGSVETAGQAGNT

SEQ ID NO: 27928 - protein, 28 aa, Artificial Sequence
  Description of Artificial Sequence: Synthetic peptide
DEEEIAATNPVATEQYGSANTNLQRENR

SEQ ID NO: 27929 - protein, 30 aa, Artificial Sequence
  Description of Artificial Sequence: Synthetic polypeptide
DDEEIRTTNPVAYEQYGSVSTPNLQREGND

SEQ ID NO: 27930 - protein, 31 aa, Artificial Sequence
  Description of Artificial Sequence: Synthetic polypeptide
DEEEIRTTNPVATEQYGSVSTNLQEVNGNDE

SEQ ID NO: 27931 - protein, 29 aa, Artificial Sequence
  Description of Artificial Sequence: Synthetic peptide
DEEEIRTTNPVATEQYGSVAADELQAGNR

SEQ ID NO: 27932 - protein, 29 aa, Artificial Sequence
  Description of Artificial Sequence: Synthetic peptide
DEEEIRTTNPVATEQYGDVSENLQHGNDM

SEQ ID NO: 27933 - protein, 28 aa, Artificial Sequence
  Description of Artificial Sequence: Synthetic peptide
DEQEIRCTNPVATEMYGSVSTNLQRGTV

SEQ ID NO: 27934 - protein, 30 aa, Artificial Sequence
  Description of Artificial Sequence: Synthetic polypeptide
DEEEIRTTNPVATEQYGSVSTDLQRNGEDD

SEQ ID NO: 27935 - protein, 28 aa, Artificial Sequence
  Description of Artificial Sequence: Synthetic peptide
DEVEIRTTNPVATEQYGSVMTDLQQGNA

SEQ ID NO: 27936 - protein, 31 aa, Artificial Sequence
  Description of Artificial Sequence: Synthetic polypeptide
DEEEIRTTNPVATEQYGSVSCTELQCTGNDR

SEQ ID NO: 27937 - protein, 28 aa, Artificial Sequence
  Description of Artificial Sequence: Synthetic peptide
DEEEIRCTNPVATEQYGSVSNNDQVENR

SEQ ID NO: 27938 - protein, 28 aa, Artificial Sequence
  Description of Artificial Sequence: Synthetic peptide
DEQEVATTNPVATEVYGWVSTNLQRGNR

SEQ ID NO: 27939 - protein, 30 aa, Artificial Sequence
  Description of Artificial Sequence: Synthetic polypeptide
DEEEIRTTNPVATEQYGSVSTEPLQYDGNL

SEQ ID NO: 27940 - protein, 31 aa, Artificial Sequence
  Description of Artificial Sequence: Synthetic polypeptide
DEEEIRTTNPVATEQYGSVSTANEQRGDNTG

SEQ ID NO: 27941 - protein, 28 aa, Artificial Sequence
  Description of Artificial Sequence: Synthetic peptide
DEEEIRTTNPVATEQYGSVSTNDDPGEL

SEQ ID NO: 27942 - protein, 28 aa, Artificial Sequence
  Description of Artificial Sequence: Synthetic peptide
DEEEISTVNPCATEQYGDVSTNLQRENR

SEQ ID NO: 27943 - protein, 29 aa, Artificial Sequence
  Description of Artificial Sequence: Synthetic peptide
MEEEIRTTNPVATECYGTVSTNLQRGNDL

SEQ ID NO: 27944 - protein, 28 aa, Artificial Sequence
  Description of Artificial Sequence: Synthetic peptide
DEMEIRATNPVATEQYGVVATNLQRGNI

SEQ ID NO: 27945 - protein, 28 aa, Artificial Sequence
  Description of Artificial Sequence: Synthetic peptide
DEQEIRATNPVATEQYGSVSTNLQNGDI

SEQ ID NO: 27946 - protein, 29 aa, Artificial Sequence
  Description of Artificial Sequence: Synthetic peptide
DEEEIVTTNPVATEQYGVVSTNLERGENL

SEQ ID NO: 27947 - protein, 28 aa, Artificial Sequence
  Description of Artificial Sequence: Synthetic peptide
DEEEIRTTNPVATECYGSVSTELQYGEM

SEQ ID NO: 27948 - protein, 30 aa, Artificial Sequence
  Description of Artificial Sequence: Synthetic polypeptide
DEEEIRTTNPVATEQYGSVSTDEPMQLGNR

SEQ ID NO: 27949 - protein, 28 aa, Artificial Sequence
  Description of Artificial Sequence: Synthetic peptide
DEEEIRTTNPAATETYGSVSTNPQRGTG

SEQ ID NO: 27950 - protein, 28 aa, Artificial Sequence
  Description of Artificial Sequence: Synthetic peptide
DEQEIRTTNPVATEQYGDVSEDLQRGNA

SEQ ID NO: 27951 - protein, 29 aa, Artificial Sequence
  Description of Artificial Sequence: Synthetic peptide
DEEEIRTTNPVAYEQYGSVSENLQIGDNS

SEQ ID NO: 27952 - protein, 28 aa, Artificial Sequence
  Description of Artificial Sequence: Synthetic peptide
DEHEIRTTNPVATEQYGSVSEDLQLGNS

SEQ ID NO: 27953 - protein, 29 aa, Artificial Sequence
  Description of Artificial Sequence: Synthetic peptide
DEQEIRTTNPVATECYGSVSTNLQYGNDQ

SEQ ID NO: 27954 - protein, 29 aa, Artificial Sequence
  Description of Artificial Sequence: Synthetic peptide
DEEEIRTTNPVATEQYGSVDTNLQLGTDY

SEQ ID NO: 27955 - protein, 28 aa, Artificial Sequence
  Description of Artificial Sequence: Synthetic peptide
DEEEIRTTNPVATECYGGVSTNLQVGTD

SEQ ID NO: 27956 - protein, 28 aa, Artificial Sequence
  Description of Artificial Sequence: Synthetic peptide
MEEEIRTTNPVATEQYGDVSTALQRTNA

SEQ ID NO: 27957 - protein, 28 aa, Artificial Sequence
  Description of Artificial Sequence: Synthetic peptide
DEEEIRTTNPVATEVWGSVSENLQIGNF

SEQ ID NO: 27958 - protein, 30 aa, Artificial Sequence
  Description of Artificial Sequence: Synthetic polypeptide
DEEEIRTTNPVATEQYGWVSTTNLQDDGND

SEQ ID NO: 27959 - protein, 30 aa, Artificial Sequence
  Description of Artificial Sequence: Synthetic polypeptide
DEEEIRTTNPVATEQYGSVSTEPLQVYGNG

SEQ ID NO: 27960 - protein, 29 aa, Artificial Sequence
  Description of Artificial Sequence: Synthetic peptide
DEEEIRTTNPVATEQYGSVSTNLEPGDEF

SEQ ID NO: 27961 - protein, 29 aa, Artificial Sequence
  Description of Artificial Sequence: Synthetic peptide
DEEEIRTTNPVATEQYGSVSTDLQIVGEH

SEQ ID NO: 27962 - protein, 29 aa, Artificial Sequence
  Description of Artificial Sequence: Synthetic peptide
DEEEIRTVNPVATEGYGWCSTNLQRAGNR

SEQ ID NO: 27963 - protein, 28 aa, Artificial Sequence
  Description of Artificial Sequence: Synthetic peptide
DEEEIRTTNPVATEQYGSVSEILQQENA

SEQ ID NO: 27964 - protein, 28 aa, Artificial Sequence
  Description of Artificial Sequence: Synthetic peptide
SEEEIRTTNPTATEQYGSVSTNPQVGNG

SEQ ID NO: 27965 - protein, 28 aa, Artificial Sequence
  Description of Artificial Sequence: Synthetic peptide
MENEIRTTNPVATEQYGSVSTDLQGGNA

SEQ ID NO: 27966 - protein, 28 aa, Artificial Sequence
  Description of Artificial Sequence: Synthetic peptide
DEEEIRTTNPVATECYGSVSTDLQNGDQ

SEQ ID NO: 27967 - protein, 28 aa, Artificial Sequence
  Description of Artificial Sequence: Synthetic peptide
DEEEIRTTNPVATEQYGDVSECLQHGER

SEQ ID NO: 27968 - protein, 30 aa, Artificial Sequence
  Description of Artificial Sequence: Synthetic polypeptide
DEEEIRTTNPVATEQYGSVSTLDGQNRGNF

SEQ ID NO: 27969 - protein, 28 aa, Artificial Sequence
  Description of Artificial Sequence: Synthetic peptide
SEEEIRCTNPVATEQYGVVSTNLQQGDR

SEQ ID NO: 27970 - protein, 30 aa, Artificial Sequence
  Description of Artificial Sequence: Synthetic polypeptide
DEQEIRTTNPVATEQYGSVSTDLQLEGNDR

SEQ ID NO: 27971 - protein, 28 aa, Artificial Sequence
  Description of Artificial Sequence: Synthetic peptide
DEEEIRATNPTCTEQYGSVSTNLQLGTR

SEQ ID NO: 27972 - protein, 30 aa, Artificial Sequence
  Description of Artificial Sequence: Synthetic polypeptide
DEVEIRTTNPVATEQFGSVSTNWQDRGDNR

SEQ ID NO: 27973 - protein, 28 aa, Artificial Sequence
  Description of Artificial Sequence: Synthetic peptide
DEQEIRATNPVATEVYGSVSSNLERGNR

SEQ ID NO: 27974 - protein, 28 aa, Artificial Sequence
  Description of Artificial Sequence: Synthetic peptide
DEEEIATTNPCATECYGSVSTNLQQGNT

SEQ ID NO: 27975 - protein, 30 aa, Artificial Sequence
  Description of Artificial Sequence: Synthetic polypeptide
DEEEIRTTNPVATEQYGSVSTNPQENGNTH

SEQ ID NO: 27976 - protein, 28 aa, Artificial Sequence
  Description of Artificial Sequence: Synthetic peptide
DEEEIRCTNPVATEQYGSVSTNDEQGNY

SEQ ID NO: 27977 - protein, 28 aa, Artificial Sequence
  Description of Artificial Sequence: Synthetic peptide
DDEEIGTTNPVATEQYGSVSTNLQVGDF

SEQ ID NO: 27978 - protein, 30 aa, Artificial Sequence
  Description of Artificial Sequence: Synthetic polypeptide
DEEEIRTTNPVAYEQYGSVETPNLQRPNPR

SEQ ID NO: 27979 - protein, 28 aa, Artificial Sequence
  Description of Artificial Sequence: Synthetic peptide
MEQEIRTTNPVATEQYGEVSTDLQRGNF

SEQ ID NO: 27980 - protein, 30 aa, Artificial Sequence
  Description of Artificial Sequence: Synthetic polypeptide
DEEEIRTTNPVATEQYGSVSTNPQELGNTN

SEQ ID NO: 27981 - protein, 28 aa, Artificial Sequence
  Description of Artificial Sequence: Synthetic peptide
DEEEIRTTNPVATEQYGWVSPYLQQGNN

SEQ ID NO: 27982 - protein, 30 aa, Artificial Sequence
  Description of Artificial Sequence: Synthetic polypeptide
DEQEIRTTNPVATEQYGSVSTINEQDSGNR

SEQ ID NO: 27983 - protein, 28 aa, Artificial Sequence
  Description of Artificial Sequence: Synthetic peptide
DEVEIETTNPVATENWGSVSENLQRGNR

SEQ ID NO: 27984 - protein, 28 aa, Artificial Sequence
  Description of Artificial Sequence: Synthetic peptide
CEEEIRTTNPVATEQYGSVDTDLQWGNM

SEQ ID NO: 27985 - protein, 30 aa, Artificial Sequence
  Description of Artificial Sequence: Synthetic polypeptide
DEEEIRTTNPVATEQYGSVSTGNPQDVGNG

SEQ ID NO: 27986 - protein, 29 aa, Artificial Sequence
  Description of Artificial Sequence: Synthetic peptide
DEEEIATTNPVATEQYGSVSTNLQTKGEM

SEQ ID NO: 27987 - protein, 28 aa, Artificial Sequence
  Description of Artificial Sequence: Synthetic peptide
DEGEIRTTNPVATEQYGEVSENLQNGDR

SEQ ID NO: 27988 - protein, 28 aa, Artificial Sequence
  Description of Artificial Sequence: Synthetic peptide
DEEEIRCTNPVSTEQYGIVSENEQRGNR

SEQ ID NO: 27989 - protein, 32 aa, Artificial Sequence
  Description of Artificial Sequence: Synthetic polypeptide
DEEEIRTTNPVATEQYGSVSTMNPVQERGVNR

SEQ ID NO: 27990 - protein, 31 aa, Artificial Sequence
  Description of Artificial Sequence: Synthetic polypeptide
DEEEIRTTNPVATEQYGSVSTNLQEQEGNDQ

SEQ ID NO: 27991 - protein, 28 aa, Artificial Sequence
  Description of Artificial Sequence: Synthetic peptide
DEEEIRTTNPVATEQWGSVDTNLQQGTF

SEQ ID NO: 27992 - protein, 28 aa, Artificial Sequence
  Description of Artificial Sequence: Synthetic peptide
DEEEIRTTNPVATEIYGFVSTNLQTGTE

SEQ ID NO: 27993 - protein, 28 aa, Artificial Sequence
  Description of Artificial Sequence: Synthetic peptide
DEEEIAATNPVATEQFGSVSTNEQIGNR

SEQ ID NO: 27994 - protein, 30 aa, Artificial Sequence
  Description of Artificial Sequence: Synthetic polypeptide
MEEEIWTTNPVATEQYGSVSTNLQDVGNDR

SEQ ID NO: 27995 - protein, 29 aa, Artificial Sequence
  Description of Artificial Sequence: Synthetic peptide
DEEEIRTTNPVATECYGSVSTDLQAGNDN

SEQ ID NO: 27996 - protein, 30 aa, Artificial Sequence
  Description of Artificial Sequence: Synthetic polypeptide
DEGEIATTNPTATEQYGSVSTMNLQERGNR

SEQ ID NO: 27997 - protein, 30 aa, Artificial Sequence
  Description of Artificial Sequence: Synthetic polypeptide
DEQEIRTTNPVATEQYGESVSTNLQHGEER

SEQ ID NO: 27998 - protein, 30 aa, Artificial Sequence
  Description of Artificial Sequence: Synthetic polypeptide
MENEIRTTNPVATEQYGSVSTDLQEREGNR

SEQ ID NO: 27999 - protein, 31 aa, Artificial Sequence
  Description of Artificial Sequence: Synthetic polypeptide
KEEEIRTTNPVATEQYGSVSTNLQDREGNDY

SEQ ID NO: 28000 - protein, 28 aa, Artificial Sequence
  Description of Artificial Sequence: Synthetic peptide
CEEEIRTTNPVSTECYGSVSTNIQRGNG

SEQ ID NO: 28001 - protein, 30 aa, Artificial Sequence
  Description of Artificial Sequence: Synthetic polypeptide
DEEEIRTTNPVATEQYGSVSTISLQDLGNH

SEQ ID NO: 28002 - protein, 30 aa, Artificial Sequence
  Description of Artificial Sequence: Synthetic polypeptide
DEEEIRCTNPVATEQFGSVSTNPQDRGDNR

SEQ ID NO: 28003 - protein, 28 aa, Artificial Sequence
  Description of Artificial Sequence: Synthetic peptide
KEEEIRTTNPVATECYGSVSTDLQTGNQ

SEQ ID NO: 28004 - protein, 28 aa, Artificial Sequence
  Description of Artificial Sequence: Synthetic peptide
DEGEIRCTNPVATEQYGSVSTNLEFGND

SEQ ID NO: 28005 - protein, 30 aa, Artificial Sequence
  Description of Artificial Sequence: Synthetic polypeptide
DEEEIRTTNPVATEQYGSVSTNLQFNKDNA

SEQ ID NO: 28006 - protein, 28 aa, Artificial Sequence
  Description of Artificial Sequence: Synthetic peptide
DEQEITTTNPVATEQYGSVSTALQMGNY

SEQ ID NO: 28007 - protein, 32 aa, Artificial Sequence
  Description of Artificial Sequence: Synthetic polypeptide
DEEEIRTTNPVATEQYGSVSTNPLVQYGINER

SEQ ID NO: 28008 - protein, 28 aa, Artificial Sequence
  Description of Artificial Sequence: Synthetic peptide
DEAEITATNPVSTEQYGSVATNLQRGNR

SEQ ID NO: 28009 - protein, 28 aa, Artificial Sequence
  Description of Artificial Sequence: Synthetic peptide
YEEEIRCTNPVATEQYGSVSTNLQAENL

SEQ ID NO: 28010 - protein, 30 aa, Artificial Sequence
  Description of Artificial Sequence: Synthetic polypeptide
DEEEIRTTNPVATEQYGSVSTNLQIHKGEL

SEQ ID NO: 28011 - protein, 28 aa, Artificial Sequence
  Description of Artificial Sequence: Synthetic peptide
DENEIRTTNPVATECYGSVSTDLQLGND

SEQ ID NO: 28012 - protein, 30 aa, Artificial Sequence
  Description of Artificial Sequence: Synthetic polypeptide
DEEEIRTTNPVSTEQYGSVSDTVELQQGNR

SEQ ID NO: 28013 - protein, 28 aa, Artificial Sequence
  Description of Artificial Sequence: Synthetic peptide
DEEEIYTTNPVATESYGSVSTNLQHGDS

SEQ ID NO: 28014 - protein, 30 aa, Artificial Sequence
  Description of Artificial Sequence: Synthetic polypeptide
DEEEIRTTNPVATEQYGSVSTNLEINGNDQ

SEQ ID NO: 28015 - protein, 28 aa, Artificial Sequence
  Description of Artificial Sequence: Synthetic peptide
DEEEIRTTNPVATQQYGSVSTNLEPGEP

SEQ ID NO: 28016 - protein, 30 aa, Artificial Sequence
  Description of Artificial Sequence: Synthetic polypeptide
DEEEIRTTNPVATECYGSVSTNNLEYNGNR

SEQ ID NO: 28017 - protein, 28 aa, Artificial Sequence
  Description of Artificial Sequence: Synthetic peptide
DEEEIRTVNPVATEQYGVVSTELQRGEM

SEQ ID NO: 28018 - protein, 28 aa, Artificial Sequence
  Description of Artificial Sequence: Synthetic peptide
MENEIRTTNPVATEQYGSVSTNPQNGQR

SEQ ID NO: 28019 - protein, 28 aa, Artificial Sequence
  Description of Artificial Sequence: Synthetic peptide
DEEEIRTTNPVATEQYGSVSENLDNGEN

SEQ ID NO: 28020 - protein, 30 aa, Artificial Sequence
  Description of Artificial Sequence: Synthetic polypeptide
DEEEIRTTNPVATEQYGSVSTNPQEHGNTQ

SEQ ID NO: 28021 - protein, 30 aa, Artificial Sequence
  Description of Artificial Sequence: Synthetic polypeptide
DEEEIATTNPVATEQYGSVSTMNLQNEGNV

SEQ ID NO: 28022 - protein, 28 aa, Artificial Sequence
  Description of Artificial Sequence: Synthetic peptide
DEEEIVTTNPVATEQYGSVSQNLQHGEH

SEQ ID NO: 28023 - protein, 29 aa, Artificial Sequence
  Description of Artificial Sequence: Synthetic peptide
DEEEIRTTNPVATEQWGSVSTNLMNQGNW

SEQ ID NO: 28024 - protein, 30 aa, Artificial Sequence
  Description of Artificial Sequence: Synthetic polypeptide
QEEEIRTTNPVATEQYGSVSVTNLWRGNDG

SEQ ID NO: 28025 - protein, 28 aa, Artificial Sequence
  Description of Artificial Sequence: Synthetic peptide
DEEEIATTNPVATEQYGSVSTDLQHGEN

SEQ ID NO: 28026 - protein, 32 aa, Artificial Sequence
  Description of Artificial Sequence: Synthetic polypeptide
DEEEIRTTNPVATEQYGSIVETNPLVQRGTNR

SEQ ID NO: 28027 - protein, 30 aa, Artificial Sequence
  Description of Artificial Sequence: Synthetic polypeptide
DEVEIRTTNPVATEQYGSVISENLQRGDNF

SEQ ID NO: 28028 - protein, 31 aa, Artificial Sequence
  Description of Artificial Sequence: Synthetic polypeptide
DEEEIRTTNPVATEQYGSVSTPNDQPGDNDR

SEQ ID NO: 28029 - protein, 28 aa, Artificial Sequence
  Description of Artificial Sequence: Synthetic peptide
DEEEIRTTNPVATEQYGCVSVALQLGPR

SEQ ID NO: 28030 - protein, 30 aa, Artificial Sequence
  Description of Artificial Sequence: Synthetic polypeptide
DEEEIRTTNPVATEQYGSVSTEPLQVIGNW

SEQ ID NO: 28031 - protein, 28 aa, Artificial Sequence
  Description of Artificial Sequence: Synthetic peptide
DEEEIRTTNPVATECYGDASTDLQRGER

SEQ ID NO: 28032 - protein, 28 aa, Artificial Sequence
  Description of Artificial Sequence: Synthetic peptide
DEEEIRTTNPVATECYGSVSTNLEIGEE

SEQ ID NO: 28033 - protein, 28 aa, Artificial Sequence
  Description of Artificial Sequence: Synthetic peptide
DEEEIRTTNPVATEQYGTVDTNDQHGNQ

SEQ ID NO: 28034 - protein, 28 aa, Artificial Sequence
  Description of Artificial Sequence: Synthetic peptide
DEEEIRSTNPVATEQYGSVSMNLQRLPQ

SEQ ID NO: 28035 - protein, 28 aa, Artificial Sequence
  Description of Artificial Sequence: Synthetic peptide
DEEEIRTTNPVATEQYGSVSTEPQQGEF

SEQ ID NO: 28036 - protein, 31 aa, Artificial Sequence
  Description of Artificial Sequence: Synthetic polypeptide
DEEEIRTTNPVATEQYGSVSCTMDLQRGNDS

SEQ ID NO: 28037 - protein, 28 aa, Artificial Sequence
  Description of Artificial Sequence: Synthetic peptide
DEVEIVTTNPVATENYGEVSENLQRGNR

SEQ ID NO: 28038 - protein, 28 aa, Artificial Sequence
  Description of Artificial Sequence: Synthetic peptide
DEEEISATNPVATEQFGSVSENEQRGNR

SEQ ID NO: 28039 - protein, 30 aa, Artificial Sequence
  Description of Artificial Sequence: Synthetic polypeptide
DEEEIVTTNPVATEQYGSVSTNLQEGNGNA

SEQ ID NO: 28040 - protein, 29 aa, Artificial Sequence
  Description of Artificial Sequence: Synthetic peptide
DEQEIRTVNPVATEQYGSVSAENLQRGGR

SEQ ID NO: 28041 - protein, 28 aa, Artificial Sequence
  Description of Artificial Sequence: Synthetic peptide
DEEEIRATNPVATEQYGSVSTDLQQGDS

SEQ ID NO: 28042 - protein, 28 aa, Artificial Sequence
  Description of Artificial Sequence: Synthetic peptide
SEEEIRTTNPVATEQWGSVSTALMRGNA

SEQ ID NO: 28043 - protein, 30 aa, Artificial Sequence
  Description of Artificial Sequence: Synthetic polypeptide
DEEEIRTTNPVATEQYGSVSTNLEDGENDF

SEQ ID NO: 28044 - protein, 28 aa, Artificial Sequence
  Description of Artificial Sequence: Synthetic peptide
DEQEIRTTNPVSTEQYGSYSTNLQTGNA

SEQ ID NO: 28045 - protein, 28 aa, Artificial Sequence
  Description of Artificial Sequence: Synthetic peptide
DEEEIRCTNPVATEVYGSMSTNLQQGER

SEQ ID NO: 28046 - protein, 29 aa, Artificial Sequence
  Description of Artificial Sequence: Synthetic peptide
DEEEIRTTNPVATEQYGEVSCQLQRSGQR

SEQ ID NO: 28047 - protein, 32 aa, Artificial Sequence
  Description of Artificial Sequence: Synthetic polypeptide
DEEEIRTTNPVATEQYGSVSETNGLQRGENDF

SEQ ID NO: 28048 - protein, 29 aa, Artificial Sequence
  Description of Artificial Sequence: Synthetic peptide
DEQEIRTTNPVATEQYGSVSTNLQEVGDN

SEQ ID NO: 28049 - protein, 28 aa, Artificial Sequence
  Description of Artificial Sequence: Synthetic peptide
DEDEIRTVNPVAYEQYGSVSTNLQVGNQ

SEQ ID NO: 28050 - protein, 28 aa, Artificial Sequence
  Description of Artificial Sequence: Synthetic peptide
DEEEIRQTNPVATEQYGSVSTDPQGGNL

SEQ ID NO: 28051 - protein, 28 aa, Artificial Sequence
  Description of Artificial Sequence: Synthetic peptide
LEEEIRGTNPVATEQYGEVSTNLQRLNV

SEQ ID NO: 28052 - protein, 28 aa, Artificial Sequence
  Description of Artificial Sequence: Synthetic peptide
DEEEIATTNPTATEQYGSVSTNPQIGNA

SEQ ID NO: 28053 - protein, 30 aa, Artificial Sequence
  Description of Artificial Sequence: Synthetic polypeptide
DEEEIRATNPVATEQYGSVSENLQDQGNDR

SEQ ID NO: 28054 - protein, 31 aa, Artificial Sequence
  Description of Artificial Sequence: Synthetic polypeptide
DEEEIRTTNPVATEQYGSVSDTNLELPKGNR

SEQ ID NO: 28055 - protein, 28 aa, Artificial Sequence
  Description of Artificial Sequence: Synthetic peptide
DEEEIRTTNPVATEHYGSVDTNLQWGEL

SEQ ID NO: 28056 - protein, 28 aa, Artificial Sequence
  Description of Artificial Sequence: Synthetic peptide
DEEEIRTTNPVATEQYGSVSTDLEAGET

SEQ ID NO: 28057 - protein, 28 aa, Artificial Sequence
  Description of Artificial Sequence: Synthetic peptide
DEEEIRTTNPVATEQYGSVSTPDQEGEI

SEQ ID NO: 28058 - protein, 28 aa, Artificial Sequence
  Description of Artificial Sequence: Synthetic peptide
DEEEIRTVNPVATEQYGSVSTDQQSGNH

SEQ ID NO: 28059 - protein, 31 aa, Artificial Sequence
  Description of Artificial Sequence: Synthetic polypeptide
DEEEIRTTNPVATEQYGSVSATDLQDREGER

SEQ ID NO: 28060 - protein, 28 aa, Artificial Sequence
  Description of Artificial Sequence: Synthetic peptide
MEEEIRTTNPVATEQYGWVSTNLQNGEL

SEQ ID NO: 28061 - protein, 31 aa, Artificial Sequence
  Description of Artificial Sequence: Synthetic polypeptide
MEEEIRTTNPVATEQYGSVSTNLQEREGNDM

SEQ ID NO: 28062 - protein, 28 aa, Artificial Sequence
  Description of Artificial Sequence: Synthetic peptide
DEEEIRATNPVATECYGSVSTDLQVGNM

SEQ ID NO: 28063 - protein, 28 aa, Artificial Sequence
  Description of Artificial Sequence: Synthetic peptide
DEEEIRTTNPVATECWGSVSTNEMRGNM

SEQ ID NO: 28064 - protein, 28 aa, Artificial Sequence
  Description of Artificial Sequence: Synthetic peptide
DEEEIRTTNPCATEQYGSVSTDEQTGNA

SEQ ID NO: 28065 - protein, 29 aa, Artificial Sequence
  Description of Artificial Sequence: Synthetic peptide
DEEEIRTTNPVATEQWGSVSNNEQMRGNA

SEQ ID NO: 28066 - protein, 30 aa, Artificial Sequence
  Description of Artificial Sequence: Synthetic polypeptide
DEEEIRTTNPVATEQYGSVDSTNDQREGDV

SEQ ID NO: 28067 - protein, 29 aa, Artificial Sequence
  Description of Artificial Sequence: Synthetic peptide
DEEEIRTTNPFATEQYGSVSTGPLQPGND

SEQ ID NO: 28068 - protein, 28 aa, Artificial Sequence
  Description of Artificial Sequence: Synthetic peptide
DEEEIRCTNPIATEHYGTVSTNLQRGPR

SEQ ID NO: 28069 - protein, 30 aa, Artificial Sequence
  Description of Artificial Sequence: Synthetic polypeptide
DEEEIRTTNPVATEQYGSVSTNPQEQGNTL

SEQ ID NO: 28070 - protein, 29 aa, Artificial Sequence
  Description of Artificial Sequence: Synthetic peptide
DEEEIRATNPVATEQYGSVSTELQREGDQ

SEQ ID NO: 28071 - protein, 28 aa, Artificial Sequence
  Description of Artificial Sequence: Synthetic peptide
DENEIRTTNPVATEQYGDVSTIEQRGNA

SEQ ID NO: 28072 - protein, 28 aa, Artificial Sequence
  Description of Artificial Sequence: Synthetic peptide
DEQEIRTTNPVATEIYGSVSTNLQFGDF

SEQ ID NO: 28073 - protein, 30 aa, Artificial Sequence
  Description of Artificial Sequence: Synthetic polypeptide
DEEEIRTTNPVATEQWGSVSTNEQYDGNDR

SEQ ID NO: 28074 - protein, 32 aa, Artificial Sequence
  Description of Artificial Sequence: Synthetic polypeptide
DEEEIRTTNPVATEQYGSVYSTNGEQLRGVNR

SEQ ID NO: 28075 - protein, 28 aa, Artificial Sequence
  Description of Artificial Sequence: Synthetic peptide
DEEEIRATNPVATECYGSVSTDLQQGNE

SEQ ID NO: 28076 - protein, 30 aa, Artificial Sequence
  Description of Artificial Sequence: Synthetic polypeptide
DEEEIRTTNPVCTEQYGSVCSTPGLQRGNV

SEQ ID NO: 28077 - protein, 29 aa, Artificial Sequence
  Description of Artificial Sequence: Synthetic peptide
DEEEIRTTNPVATEQYGSVSTEDQQNGNL

SEQ ID NO: 28078 - protein, 31 aa, Artificial Sequence
  Description of Artificial Sequence: Synthetic polypeptide
DEEEIRTTNPVATEQYGSVSTNLQDDNGNDF

SEQ ID NO: 28079 - protein, 32 aa, Artificial Sequence
  Description of Artificial Sequence: Synthetic polypeptide
DEEEIRTTNPVATEQYGSVDSDTNLEERGENR

SEQ ID NO: 28080 - protein, 28 aa, Artificial Sequence
  Description of Artificial Sequence: Synthetic peptide
DENEIRTTNPVSTEQYGDVSTNLERGER

SEQ ID NO: 28081 - protein, 29 aa, Artificial Sequence
  Description of Artificial Sequence: Synthetic peptide
DEEEIRTTNPVASECYGSVSTNLQQGNDY

SEQ ID NO: 28082 - protein, 28 aa, Artificial Sequence
  Description of Artificial Sequence: Synthetic peptide
DEEEIRTTNPVATECYGVVSTDLQLGNW

SEQ ID NO: 28083 - protein, 28 aa, Artificial Sequence
  Description of Artificial Sequence: Synthetic peptide
DEDEIRTTNPVATEQYGSVMTNLQYGED

SEQ ID NO: 28084 - protein, 28 aa, Artificial Sequence
  Description of Artificial Sequence: Synthetic peptide
DEQEIRTTNPVATEQYGSVSTPDDRGNS

SEQ ID NO: 28085 - protein, 30 aa, Artificial Sequence
  Description of Artificial Sequence: Synthetic polypeptide
SEEEIRTTNPVATEQYGSVTETNLQSPGNR

SEQ ID NO: 28086 - protein, 28 aa, Artificial Sequence
  Description of Artificial Sequence: Synthetic peptide
DEEEIRTTNPVATEQYGFVSENLFRENP

SEQ ID NO: 28087 - protein, 30 aa, Artificial Sequence
  Description of Artificial Sequence: Synthetic polypeptide
DEQEITTTNPVATEQYGSVSCEMNLQRGNR

SEQ ID NO: 28088 - protein, 28 aa, Artificial Sequence
  Description of Artificial Sequence: Synthetic peptide
DEEEIRTTNPVATEQYGNYSTALMTGNR

SEQ ID NO: 28089 - protein, 28 aa, Artificial Sequence
  Description of Artificial Sequence: Synthetic peptide
MENEIRTTNPVATEQYGSMSTNLQTGNQ

SEQ ID NO: 28090 - protein, 30 aa, Artificial Sequence
  Description of Artificial Sequence: Synthetic polypeptide
DEEEIRTTNPVATEMYGSVSTNLQDGEGNM

SEQ ID NO: 28091 - protein, 30 aa, Artificial Sequence
  Description of Artificial Sequence: Synthetic polypeptide
HEEEIRTTNPVAYEQYGSVSEMNLQRNGNR

SEQ ID NO: 28092 - protein, 28 aa, Artificial Sequence
  Description of Artificial Sequence: Synthetic peptide
DEEEIRTTNPVATEQYGSVSTEDEEGNV

SEQ ID NO: 28093 - protein, 30 aa, Artificial Sequence
  Description of Artificial Sequence: Synthetic polypeptide
GEEEIRTTNPVATEQYGSVSMNLQISNGNR

SEQ ID NO: 28094 - protein, 28 aa, Artificial Sequence
  Description of Artificial Sequence: Synthetic peptide
KEEEIRTTNPVATEQYGSVSTDLQGGEV

SEQ ID NO: 28095 - protein, 28 aa, Artificial Sequence
  Description of Artificial Sequence: Synthetic peptide
DEGEIRTTNPCATEQYGSVSTEDQRGNY

SEQ ID NO: 28096 - protein, 29 aa, Artificial Sequence
  Description of Artificial Sequence: Synthetic peptide
KEEEIRTTNPVATEQYGSVSTDLQQEGNT

SEQ ID NO: 28097 - protein, 28 aa, Artificial Sequence
  Description of Artificial Sequence: Synthetic peptide
DEEEISSTNPVATEQYGDVSTNLQNGNA

SEQ ID NO: 28098 - protein, 28 aa, Artificial Sequence
  Description of Artificial Sequence: Synthetic peptide
DEEEIRTTNPVATECWGSVSTNLMTGNF

SEQ ID NO: 28099 - protein, 32 aa, Artificial Sequence
  Description of Artificial Sequence: Synthetic polypeptide
DEEEIRTTNPVATEQYGSVSTPNPDQREGNPR

SEQ ID NO: 28100 - protein, 29 aa, Artificial Sequence
  Description of Artificial Sequence: Synthetic peptide
DESEITTTNPVATEQYGSVSTNLQETGNN

SEQ ID NO: 28101 - protein, 28 aa, Artificial Sequence
  Description of Artificial Sequence: Synthetic peptide
DEDEIRTTNPVATECYGSVSTNLQDGEP

SEQ ID NO: 28102 - protein, 28 aa, Artificial Sequence
  Description of Artificial Sequence: Synthetic peptide
DEEEIRTTNPVATECYGSVSTDLEIGNQ

SEQ ID NO: 28103 - protein, 28 aa, Artificial Sequence
  Description of Artificial Sequence: Synthetic peptide
DEEEIVTTNPVATEQYGSASTNLQHMQR

SEQ ID NO: 28104 - protein, 32 aa, Artificial Sequence
  Description of Artificial Sequence: Synthetic polypeptide
DEEEIRTTNPVATEQYGSVETNPLVQRGENDR

SEQ ID NO: 28105 - protein, 28 aa, Artificial Sequence
  Description of Artificial Sequence: Synthetic peptide
DEEEIRTTNPVATEQYGSVSTPPNRENE

SEQ ID NO: 28106 - protein, 28 aa, Artificial Sequence
  Description of Artificial Sequence: Synthetic peptide
SEEEIRTTNPAATEIYGSVSTNPQVGNR

SEQ ID NO: 28107 - protein, 31 aa, Artificial Sequence
  Description of Artificial Sequence: Synthetic polypeptide
DEEEIRTTNPVATEQYGSVCSAMNLQPGDNR

SEQ ID NO: 28108 - protein, 31 aa, Artificial Sequence
  Description of Artificial Sequence: Synthetic polypeptide
DEEEIRTTNPVATEQYGSVSTVGLTDERGNR

SEQ ID NO: 28109 - protein, 30 aa, Artificial Sequence
  Description of Artificial Sequence: Synthetic polypeptide
AEEEIRTTNPVATEQYGSVSTNLVERGNDD

SEQ ID NO: 28110 - protein, 28 aa, Artificial Sequence
  Description of Artificial Sequence: Synthetic peptide
DEEEIRTTNPVCTEQYGSVSTDDQMGNF

SEQ ID NO: 28111 - protein, 28 aa, Artificial Sequence
  Description of Artificial Sequence: Synthetic peptide
DEEEIRTTNPVATELWGSVSTNLMIGNQ

SEQ ID NO: 28112 - protein, 29 aa, Artificial Sequence
  Description of Artificial Sequence: Synthetic peptide
DEAEITTTNPVATEQYGSVSMGALQRGNR

SEQ ID NO: 28113 - protein, 28 aa, Artificial Sequence
  Description of Artificial Sequence: Synthetic peptide
DEEEIRPTNPVATEQYGWVSTGLQGGND

SEQ ID NO: 28114 - protein, 30 aa, Artificial Sequence
  Description of Artificial Sequence: Synthetic polypeptide
DEEEIRTTNPVATEQYGSVSDNPLDRGNIN

SEQ ID NO: 28115 - protein, 30 aa, Artificial Sequence
  Description of Artificial Sequence: Synthetic polypeptide
DEEEIRTTNPVATEQYGDVSATNLQNRGMT

SEQ ID NO: 28116 - protein, 31 aa, Artificial Sequence
  Description of Artificial Sequence: Synthetic polypeptide
DEEEIRTTNPVATEQYGESVTSDNLQPLGNR

SEQ ID NO: 28117 - protein, 29 aa, Artificial Sequence
  Description of Artificial Sequence: Synthetic peptide
DEEEIRTTNPVATELYGSVSTDLQYAGNI

SEQ ID NO: 28118 - protein, 31 aa, Artificial Sequence
  Description of Artificial Sequence: Synthetic polypeptide
DEEEIRTTNPVATEQYGSVSTNPLQVNDGNY

SEQ ID NO: 28119 - protein, 31 aa, Artificial Sequence
  Description of Artificial Sequence: Synthetic polypeptide
DEEEIRTTNPVATEQYGSVSATALQQAGNDR

SEQ ID NO: 28120 - protein, 28 aa, Artificial Sequence
  Description of Artificial Sequence: Synthetic peptide
KEQEIRQTNPVATEQYGSVSTNLQNGNT

SEQ ID NO: 28121 - protein, 28 aa, Artificial Sequence
  Description of Artificial Sequence: Synthetic peptide
DEEEIRTVNPVATEQYGEVSENLQHGNM

SEQ ID NO: 28122 - protein, 28 aa, Artificial Sequence
  Description of Artificial Sequence: Synthetic peptide
VESEIRTTNPVATEQYGAVSTELQRGER

SEQ ID NO: 28123 - protein, 28 aa, Artificial Sequence
  Description of Artificial Sequence: Synthetic peptide
DEEEIRTTNPVATEQYGSVETNDDSGNH

SEQ ID NO: 28124 - protein, 28 aa, Artificial Sequence
  Description of Artificial Sequence: Synthetic peptide
GEEEIGATNPVATEQYGTVSTVLQRGNR

SEQ ID NO: 28125 - protein, 30 aa, Artificial Sequence
  Description of Artificial Sequence: Synthetic polypeptide
DEVEIATTNPVATEQYGSVSTNLQQEGDNR

SEQ ID NO: 28126 - protein, 31 aa, Artificial Sequence
  Description of Artificial Sequence: Synthetic polypeptide
DEEEIRTTNPVATEQYGSVSTANLQIEGNDV

SEQ ID NO: 28127 - protein, 30 aa, Artificial Sequence
  Description of Artificial Sequence: Synthetic polypeptide
DEEEIRTTNPVATEQYGSVSTNPQEHGNTL

SEQ ID NO: 28128 - protein, 31 aa, Artificial Sequence
  Description of Artificial Sequence: Synthetic polypeptide
SEEEIRTTNPVATEQYGSVISTNLQERGNDA

SEQ ID NO: 28129 - protein, 28 aa, Artificial Sequence
  Description of Artificial Sequence: Synthetic peptide
HEEEIRTTNPVATEQYGSVSTPLQNGMA

SEQ ID NO: 28130 - protein, 30 aa, Artificial Sequence
  Description of Artificial Sequence: Synthetic polypeptide
DEQEIATTNPVATEQYGSVSTNLQRGENDI

SEQ ID NO: 28131 - protein, 28 aa, Artificial Sequence
  Description of Artificial Sequence: Synthetic peptide
DEEEIRTTNPVATEQYGSVSTELQAEEI

SEQ ID NO: 28132 - protein, 28 aa, Artificial Sequence
  Description of Artificial Sequence: Synthetic peptide
NEEEIRTTNPVCTEQYGAVATNLQRGPR

SEQ ID NO: 28133 - protein, 28 aa, Artificial Sequence
  Description of Artificial Sequence: Synthetic peptide
DEEEIRTTNPVASEQYGVVSTNDQNGDR

SEQ ID NO: 28134 - protein, 29 aa, Artificial Sequence
  Description of Artificial Sequence: Synthetic peptide
DENEIRTTNPVATEQYGSVSTDLQNGNDA

SEQ ID NO: 28135 - protein, 30 aa, Artificial Sequence
  Description of Artificial Sequence: Synthetic polypeptide
DEEEIRTTNPVATEQYGSVSETNLEDVGER

SEQ ID NO: 28136 - protein, 29 aa, Artificial Sequence
  Description of Artificial Sequence: Synthetic peptide
DEEEIRTTNPVATEQYGSVSTNEMNTGNI

SEQ ID NO: 28137 - protein, 31 aa, Artificial Sequence
  Description of Artificial Sequence: Synthetic polypeptide
DEEEIRTTNPVATEQYGSVSTNLQEREGEDF

SEQ ID NO: 28138 - protein, 30 aa, Artificial Sequence
  Description of Artificial Sequence: Synthetic polypeptide
DEEEIRTTNPVATEMYGSVSATDLQRGNDF

SEQ ID NO: 28139 - protein, 29 aa, Artificial Sequence
  Description of Artificial Sequence: Synthetic peptide
DENEIRTTNPVCTEQYGSVFTNLQQGNDR

SEQ ID NO: 28140 - protein, 28 aa, Artificial Sequence
  Description of Artificial Sequence: Synthetic peptide
KEEEICTTNPVATEQYGSVSTDLQRLNN

SEQ ID NO: 28141 - protein, 28 aa, Artificial Sequence
  Description of Artificial Sequence: Synthetic peptide
DEAEIRSTNPVATEPYGGVSTNLQRGQR

SEQ ID NO: 28142 - protein, 31 aa, Artificial Sequence
  Description of Artificial Sequence: Synthetic polypeptide
DEEEIRTTNPVATEQYGSVSTNLQDQEGNDF

SEQ ID NO: 28143 - protein, 31 aa, Artificial Sequence
  Description of Artificial Sequence: Synthetic polypeptide
DEEEIRTTNPDATEQYGSVSTTALQRGVNDR

SEQ ID NO: 28144 - protein, 30 aa, Artificial Sequence
  Description of Artificial Sequence: Synthetic polypeptide
DEEEIRTTNPVATEQYGSVSTEPLQVIGDR

SEQ ID NO: 28145 - protein, 28 aa, Artificial Sequence
  Description of Artificial Sequence: Synthetic peptide
DEEEILATNPVATEQYGSVSTGLQRSNF

SEQ ID NO: 28146 - protein, 28 aa, Artificial Sequence
  Description of Artificial Sequence: Synthetic peptide
DEEEIRTTNPVATESYGCVSTNDERGNN

SEQ ID NO: 28147 - protein, 28 aa, Artificial Sequence
  Description of Artificial Sequence: Synthetic peptide
KEQEIRTTNPVATEQYGSVSTDLQTGNM

SEQ ID NO: 28148 - protein, 29 aa, Artificial Sequence
  Description of Artificial Sequence: Synthetic peptide
DENEIRTTNPVCTEQYGSVSTMNEQRGND

SEQ ID NO: 28149 - protein, 28 aa, Artificial Sequence
  Description of Artificial Sequence: Synthetic peptide
HEEEIRTTNPVATEAYGSVSTTPQRGNH

SEQ ID NO: 28150 - protein, 30 aa, Artificial Sequence
  Description of Artificial Sequence: Synthetic polypeptide
DEQEIRTTNPVATEQYGSVSASNLQRGENF

SEQ ID NO: 28151 - protein, 30 aa, Artificial Sequence
  Description of Artificial Sequence: Synthetic polypeptide
DEQEIRTTNPVATEQYGSVSATDLERGNDR

SEQ ID NO: 28152 - protein, 31 aa, Artificial Sequence
  Description of Artificial Sequence: Synthetic polypeptide
HEEEIRTTNPVATEQYGSVISTNLQDRGDPR

SEQ ID NO: 28153 - protein, 28 aa, Artificial Sequence
  Description of Artificial Sequence: Synthetic peptide
DHEEIRTTNPVATEHYGSVSTGDQRGLR

SEQ ID NO: 28154 - protein, 28 aa, Artificial Sequence
  Description of Artificial Sequence: Synthetic peptide
DEHEIRTTNPVCTEQYGVVSTDLQRGNF

SEQ ID NO: 28155 - protein, 32 aa, Artificial Sequence
  Description of Artificial Sequence: Synthetic polypeptide
DEEEIRTTNPVATEQYGSVSTMDLQRKGVNDR

SEQ ID NO: 28156 - protein, 28 aa, Artificial Sequence
  Description of Artificial Sequence: Synthetic peptide
DEEEIRTTNPVATEQYGSVSTDDQNGEM

SEQ ID NO: 28157 - protein, 30 aa, Artificial Sequence
  Description of Artificial Sequence: Synthetic polypeptide
DENEIRTTNPVATEQYGSVSTNLMMRGNDF

SEQ ID NO: 28158 - protein, 28 aa, Artificial Sequence
  Description of Artificial Sequence: Synthetic peptide
DENEIRTTNPVATEQYGVVSTNLCHGNC

SEQ ID NO: 28159 - protein, 28 aa, Artificial Sequence
  Description of Artificial Sequence: Synthetic peptide
DEEEIRTTNPVATEQYGSVFENLCDGNC

SEQ ID NO: 28160 - protein, 28 aa, Artificial Sequence
  Description of Artificial Sequence: Synthetic peptide
DEEEITSTNPVATEQYGCVSTNLQRGEF

SEQ ID NO: 28161 - protein, 32 aa, Artificial Sequence
  Description of Artificial Sequence: Synthetic polypeptide
DEEEIRTTNPVATEQYGSVSITDGLQRKGNDR

SEQ ID NO: 28162 - protein, 28 aa, Artificial Sequence
  Description of Artificial Sequence: Synthetic peptide
KEEEIRTTNPVATEQYGFVSENLQRENN

SEQ ID NO: 28163 - protein, 28 aa, Artificial Sequence
  Description of Artificial Sequence: Synthetic peptide
DEEEIRSTNPCATEQYGTVSTELQRGNE

SEQ ID NO: 28164 - protein, 28 aa, Artificial Sequence
  Description of Artificial Sequence: Synthetic peptide
DEEEIATTNPVATEQYGQVSTNQQDGND

SEQ ID NO: 28165 - protein, 28 aa, Artificial Sequence
  Description of Artificial Sequence: Synthetic peptide
DEEEIITTNPVATEQYGEVSTNLQFGTF

SEQ ID NO: 28166 - protein, 29 aa, Artificial Sequence
  Description of Artificial Sequence: Synthetic peptide
DEEEIRCTNPVASEMYGSVSTDLQREGNR

SEQ ID NO: 28167 - protein, 30 aa, Artificial Sequence
  Description of Artificial Sequence: Synthetic polypeptide
DEEEIATTNPVATEQYGVVSTNLQDREGDR

SEQ ID NO: 28168 - protein, 28 aa, Artificial Sequence
  Description of Artificial Sequence: Synthetic peptide
DESEIRTTNPTATELYGSVSEDLQRGNR

SEQ ID NO: 28169 - protein, 28 aa, Artificial Sequence
  Description of Artificial Sequence: Synthetic peptide
DEEEIRATNPVATEQYGSVSTELELGNP

SEQ ID NO: 28170 - protein, 29 aa, Artificial Sequence
  Description of Artificial Sequence: Synthetic peptide
DEEEIRATNPVSTEMYGSVSADNLQRGNR

SEQ ID NO: 28171 - protein, 30 aa, Artificial Sequence
  Description of Artificial Sequence: Synthetic polypeptide
DEEEICTTNPVATEQYGSASENLQRGDNDR

SEQ ID NO: 28172 - protein, 28 aa, Artificial Sequence
  Description of Artificial Sequence: Synthetic peptide
DEEEIRATNPVATEQYGSVSTDLQLGES

SEQ ID NO: 28173 - protein, 28 aa, Artificial Sequence
  Description of Artificial Sequence: Synthetic peptide
SEEEIATTNPTATEQYGSVSTNLQHGDR

SEQ ID NO: 28174 - protein, 28 aa, Artificial Sequence
  Description of Artificial Sequence: Synthetic peptide
SEEEIRTTNPVATEQYGSVSTNEQVGTS

SEQ ID NO: 28175 - protein, 28 aa, Artificial Sequence
  Description of Artificial Sequence: Synthetic peptide
SEEEIRTTNPVSTEQYGIVSTNLQIGNA

SEQ ID NO: 28176 - protein, 28 aa, Artificial Sequence
  Description of Artificial Sequence: Synthetic peptide
DEEEIRTTNPVATEQYGSVSDNDEIGNI

SEQ ID NO: 28177 - protein, 31 aa, Artificial Sequence
  Description of Artificial Sequence: Synthetic polypeptide
DEEEIRTTNPVATEQYGSVSDTNLERNGNDG

SEQ ID NO: 28178 - protein, 31 aa, Artificial Sequence
  Description of Artificial Sequence: Synthetic polypeptide
DEEEIRTTNPVATEQYGSVISTMNEQRGDNG

SEQ ID NO: 28179 - protein, 28 aa, Artificial Sequence
  Description of Artificial Sequence: Synthetic peptide
DEEEIRTTNPVATEQYGSVSTALFQDNV

SEQ ID NO: 28180 - protein, 33 aa, Artificial Sequence
  Description of Artificial Sequence: Synthetic polypeptide
DEEEIRTTNPVATEQYGSVCSTENLQRKGENDR

SEQ ID NO: 28181 - protein, 31 aa, Artificial Sequence
  Description of Artificial Sequence: Synthetic polypeptide
DEEEIRTTNPVATEQYGSVSTVNEQEKGNIR

SEQ ID NO: 28182 - protein, 29 aa, Artificial Sequence
  Description of Artificial Sequence: Synthetic peptide
DEEEIATTNPVATELYGSVSENLQDRGNF

SEQ ID NO: 28183 - protein, 32 aa, Artificial Sequence
  Description of Artificial Sequence: Synthetic polypeptide
DEEEIRTTNPVATEQYGSVSTTDNLLRNGDNR

SEQ ID NO: 28184 - protein, 31 aa, Artificial Sequence
  Description of Artificial Sequence: Synthetic polypeptide
DEVEIRTTNPVATEQYGSVSATEELQRGNDR

SEQ ID NO: 28185 - protein, 28 aa, Artificial Sequence
  Description of Artificial Sequence: Synthetic peptide
DEEEIRTTNPVATEQYGDVSTNPQIGEY

SEQ ID NO: 28186 - protein, 28 aa, Artificial Sequence
  Description of Artificial Sequence: Synthetic peptide
DEVEIATTNPVATEQYGSVSTNPQQGNN

SEQ ID NO: 28187 - protein, 28 aa, Artificial Sequence
  Description of Artificial Sequence: Synthetic peptide
DEEEIRTTNPVATEQYGDVSEDLQVGNL

SEQ ID NO: 28188 - protein, 30 aa, Artificial Sequence
  Description of Artificial Sequence: Synthetic polypeptide
DEEEIATTNPVATEQYGSVSENLQERGEDR

SEQ ID NO: 28189 - protein, 29 aa, Artificial Sequence
  Description of Artificial Sequence: Synthetic peptide
DEEEIRTTNPVATEQYGIVSAENLQWGQR

SEQ ID NO: 28190 - protein, 29 aa, Artificial Sequence
  Description of Artificial Sequence: Synthetic peptide
MENEIRTTNPVATEQYGSVSTDLQERGNM

SEQ ID NO: 28191 - protein, 28 aa, Artificial Sequence
  Description of Artificial Sequence: Synthetic peptide
DEEEIRTTNPVAVECYGSVSTDLQYGER

SEQ ID NO: 28192 - protein, 30 aa, Artificial Sequence
  Description of Artificial Sequence: Synthetic polypeptide
QEEEISTTNPVATEQYGSVSMNLQQRGDNR

SEQ ID NO: 28193 - protein, 29 aa, Artificial Sequence
  Description of Artificial Sequence: Synthetic peptide
DEEEIRTTNPVATEQYGSVSENEMMRGNF

SEQ ID NO: 28194 - protein, 28 aa, Artificial Sequence
  Description of Artificial Sequence: Synthetic peptide
DEEEIRTTNPDATEQYGSVSTGGLRGER

SEQ ID NO: 28195 - protein, 28 aa, Artificial Sequence
  Description of Artificial Sequence: Synthetic peptide
DEEEIATTNPTATEQYGSVSTNEQIGNL

SEQ ID NO: 28196 - protein, 28 aa, Artificial Sequence
  Description of Artificial Sequence: Synthetic peptide
DEEEIRTTNPVATELYGSVSTNEMQGNS

SEQ ID NO: 28197 - protein, 28 aa, Artificial Sequence
  Description of Artificial Sequence: Synthetic peptide
DEEEIATTNPVATEQYGVVSENLERGER

SEQ ID NO: 28198 - protein, 28 aa, Artificial Sequence
  Description of Artificial Sequence: Synthetic peptide
QEMEISTTNPVATEQYGSVSTNLLRGND

SEQ ID NO: 28199 - protein, 30 aa, Artificial Sequence
  Description of Artificial Sequence: Synthetic polypeptide
SEEEIRTTNPVATEQYGSVSTNPQERGNDI

SEQ ID NO: 28200 - protein, 29 aa, Artificial Sequence
  Description of Artificial Sequence: Synthetic peptide
DEEEIRTTNPVATEQYGDVDCTNLQHGNA

SEQ ID NO: 28201 - protein, 28 aa, Artificial Sequence
  Description of Artificial Sequence: Synthetic peptide
DENEIRSTNPVATEQYGSVSEDLQNGNR

SEQ ID NO: 28202 - protein, 28 aa, Artificial Sequence
  Description of Artificial Sequence: Synthetic peptide
DEQEIATTNPVCTEQYGSVDTNLQHGNR

SEQ ID NO: 28203 - protein, 28 aa, Artificial Sequence
  Description of Artificial Sequence: Synthetic peptide
DEEEIRTTNPVSTELYGAVSTNLQLGNS

SEQ ID NO: 28204 - protein, 29 aa, Artificial Sequence
  Description of Artificial Sequence: Synthetic peptide
DENEIRTTNPVATEQYGSVSENLQNQGNF

SEQ ID NO: 28205 - protein, 28 aa, Artificial Sequence
  Description of Artificial Sequence: Synthetic peptide
SEEEIMTTNPVATEQYGSVSVNLQNGNL

SEQ ID NO: 28206 - protein, 30 aa, Artificial Sequence
  Description of Artificial Sequence: Synthetic polypeptide
DEIEIRTTNPVATEQYGSVSTMNDQMNGNR

SEQ ID NO: 28207 - protein, 31 aa, Artificial Sequence
  Description of Artificial Sequence: Synthetic polypeptide
DEEEIRTTNPVATEQYGSVSTTGLQRGENDE

SEQ ID NO: 28208 - protein, 28 aa, Artificial Sequence
  Description of Artificial Sequence: Synthetic peptide
DEEEIATTNPTATEQYGSVSTNLQNGDG

SEQ ID NO: 28209 - protein, 28 aa, Artificial Sequence
  Description of Artificial Sequence: Synthetic peptide
DEHEIRCTNPVATEQYGSVSTNLERGDD

SEQ ID NO: 28210 - protein, 28 aa, Artificial Sequence
  Description of Artificial Sequence: Synthetic peptide
DENEIATTNPVATEHYGSASTNLQRFNR

SEQ ID NO: 28211 - protein, 28 aa, Artificial Sequence
  Description of Artificial Sequence: Synthetic peptide
AEEEIRCTNPVATEQYGSVDTPLQRGER

SEQ ID NO: 28212 - protein, 28 aa, Artificial Sequence
  Description of Artificial Sequence: Synthetic peptide
DENEIRTTNPVATEQYGSVSTNDLRGEF

SEQ ID NO: 28213 - protein, 30 aa, Artificial Sequence
  Description of Artificial Sequence: Synthetic polypeptide
DEEEIRTTNPVATECYGSVSTDLEERKGNR

SEQ ID NO: 28214 - protein, 30 aa, Artificial Sequence
  Description of Artificial Sequence: Synthetic polypeptide
DEEEIRTTNPVATEQYGSVSTGNPQIEGNN

SEQ ID NO: 28215 - protein, 28 aa, Artificial Sequence
  Description of Artificial Sequence: Synthetic peptide
NEEEIRTTNPVAFAQYGSVSTGLQRGND

SEQ ID NO: 28216 - protein, 28 aa, Artificial Sequence
  Description of Artificial Sequence: Synthetic peptide
DEEEIRTTNPIATEQYGSVSTGDQGGNF

SEQ ID NO: 28217 - protein, 30 aa, Artificial Sequence
  Description of Artificial Sequence: Synthetic polypeptide
DEEEIRTTNPVATEQYGSVSTANEQNGNTQ

SEQ ID NO: 28218 - protein, 28 aa, Artificial Sequence
  Description of Artificial Sequence: Synthetic peptide
DEEEIRCTNPVATEQYGSVSTALEQGNH

SEQ ID NO: 28219 - protein, 28 aa, Artificial Sequence
  Description of Artificial Sequence: Synthetic peptide
DENEIATTNPVATEQYGSTSTNLQDGNA

SEQ ID NO: 28220 - protein, 28 aa, Artificial Sequence
  Description of Artificial Sequence: Synthetic peptide
DEECIRTTNPDAYEQYGSVSTNGQNGNR

SEQ ID NO: 28221 - protein, 28 aa, Artificial Sequence
  Description of Artificial Sequence: Synthetic peptide
SEEEIRTTNPVATEQFGSVSTNPQFGTR

SEQ ID NO: 28222 - protein, 29 aa, Artificial Sequence
  Description of Artificial Sequence: Synthetic peptide
DEEEIRTTNPVATECYGSVSTDLQHGNDD

SEQ ID NO: 28223 - protein, 29 aa, Artificial Sequence
  Description of Artificial Sequence: Synthetic peptide
DEEEIATTNPTATEQYGSVSTNEQRGDNL

SEQ ID NO: 28224 - protein, 31 aa, Artificial Sequence
  Description of Artificial Sequence: Synthetic polypeptide
DEEEIRTTNPVATEQYGSVISTNLQDRGTTF

SEQ ID NO: 28225 - protein, 29 aa, Artificial Sequence
  Description of Artificial Sequence: Synthetic peptide
DEEEIRTVNPVATECYGSVSTEPLQRGMR

SEQ ID NO: 28226 - protein, 28 aa, Artificial Sequence
  Description of Artificial Sequence: Synthetic peptide
MENEIRTTNPVATEQYGSVSTDLQAGNV

SEQ ID NO: 28227 - protein, 28 aa, Artificial Sequence
  Description of Artificial Sequence: Synthetic peptide
DDEEIRTTNPVATEQYGSVSTDLEDGNE

SEQ ID NO: 28228 - protein, 30 aa, Artificial Sequence
  Description of Artificial Sequence: Synthetic polypeptide
DEEEIRTVNPVATEQYGSVSTELQDREGER

SEQ ID NO: 28229 - protein, 29 aa, Artificial Sequence
  Description of Artificial Sequence: Synthetic peptide
DEEEIRTTNPVATEVYGGVSMNLERNGNR

SEQ ID NO: 28230 - protein, 28 aa, Artificial Sequence
  Description of Artificial Sequence: Synthetic peptide
DEQEIRTTNPVATEQYGSVETNLDRGED

SEQ ID NO: 28231 - protein, 30 aa, Artificial Sequence
  Description of Artificial Sequence: Synthetic polypeptide
DEEEIRTTNPVATECYGSVSATNLEHEGNR

SEQ ID NO: 28232 - protein, 30 aa, Artificial Sequence
  Description of Artificial Sequence: Synthetic polypeptide
DEEEIRTTNPVATEQYGSVSTNPQDHGNTS

SEQ ID NO: 28233 - protein, 29 aa, Artificial Sequence
  Description of Artificial Sequence: Synthetic peptide
KEEEIRTTNPVATEMYGVVSTNLQEFGNR

SEQ ID NO: 28234 - protein, 28 aa, Artificial Sequence
  Description of Artificial Sequence: Synthetic peptide
DESEIRTTNPVATEQYGSVSMDLQGGNE

SEQ ID NO: 28235 - protein, 28 aa, Artificial Sequence
  Description of Artificial Sequence: Synthetic peptide
DEEEIRTTNPVATEQYGSVAVNEQTGNF

SEQ ID NO: 28236 - protein, 30 aa, Artificial Sequence
  Description of Artificial Sequence: Synthetic polypeptide
DEEEIRTTNPVATEQYGSVSVTNEDRGLDR

SEQ ID NO: 28237 - protein, 28 aa, Artificial Sequence
  Description of Artificial Sequence: Synthetic peptide
DEEEIRTTNPVATEQYGIVSTEDMLGNR

SEQ ID NO: 28238 - protein, 30 aa, Artificial Sequence
  Description of Artificial Sequence: Synthetic polypeptide
DEEEIRCTNPVATEQYGSVSTMDEQRGNDR

SEQ ID NO: 28239 - protein, 29 aa, Artificial Sequence
  Description of Artificial Sequence: Synthetic peptide
DEEEIATTNPVATEQYGSVSTTNQERGER

SEQ ID NO: 28240 - protein, 31 aa, Artificial Sequence
  Description of Artificial Sequence: Synthetic polypeptide
DEEEIRTTNPVATEQYGSVSTNLQDQEGNDW

SEQ ID NO: 28241 - protein, 28 aa, Artificial Sequence
  Description of Artificial Sequence: Synthetic peptide
DEEEIATTNPVATECYGSVSTDLERGNL

SEQ ID NO: 28242 - protein, 28 aa, Artificial Sequence
  Description of Artificial Sequence: Synthetic peptide
DEEEIATTNPVATCCYGDVSTNLQRGNF

SEQ ID NO: 28243 - protein, 28 aa, Artificial Sequence
  Description of Artificial Sequence: Synthetic peptide
KEEEIRTTNPVATEQYGSVSENLQREEA

SEQ ID NO: 28244 - protein, 31 aa, Artificial Sequence
  Description of Artificial Sequence: Synthetic polypeptide
DEEEIRTTNPVATEQYGSVSTELQDREGNDD

SEQ ID NO: 28245 - protein, 30 aa, Artificial Sequence
  Description of Artificial Sequence: Synthetic polypeptide
DEEEIRTTNPVATEQYGSVSTNLEDRGEEE

SEQ ID NO: 28246 - protein, 28 aa, Artificial Sequence
  Description of Artificial Sequence: Synthetic peptide
DEEEIRTTNPVATEQYGSVSTAPDVGND

SEQ ID NO: 28247 - protein, 28 aa, Artificial Sequence
  Description of Artificial Sequence: Synthetic peptide
DEEEIRTTNPVATEQYGIVSQNLQMGLN

SEQ ID NO: 28248 - protein, 28 aa, Artificial Sequence
  Description of Artificial Sequence: Synthetic peptide
DEEEIVTTNPVASEQYGSVSTNDQAENR

SEQ ID NO: 28249 - protein, 30 aa, Artificial Sequence
  Description of Artificial Sequence: Synthetic polypeptide
DEEEIRTTNPVATENYGCVSTGNGLQNGNR

SEQ ID NO: 28250 - protein, 30 aa, Artificial Sequence
  Description of Artificial Sequence: Synthetic polypeptide
GEEEIRSTNPVATEQYGSVSTGNLQDRGDR

SEQ ID NO: 28251 - protein, 28 aa, Artificial Sequence
  Description of Artificial Sequence: Synthetic peptide
HEQEIRTTNPVATEQYGSVSTDLERGER

SEQ ID NO: 28252 - protein, 30 aa, Artificial Sequence
  Description of Artificial Sequence: Synthetic polypeptide
DETEIRTTNPVATEQYGSVSADNLQRGEND

SEQ ID NO: 28253 - protein, 28 aa, Artificial Sequence
  Description of Artificial Sequence: Synthetic peptide
DENEVRTTNPVATEQYGEASTNLQRGTR

SEQ ID NO: 28254 - protein, 28 aa, Artificial Sequence
  Description of Artificial Sequence: Synthetic peptide
DEEEIRATNPVATEQYGEVSTLLQRGDQ

SEQ ID NO: 28255 - protein, 31 aa, Artificial Sequence
  Description of Artificial Sequence: Synthetic polypeptide
DEEEIRTTNPVATEMYGSVSTNLPQVEGNTR

SEQ ID NO: 28256 - protein, 28 aa, Artificial Sequence
  Description of Artificial Sequence: Synthetic peptide
DEQEIAATNPVATENYGVVSTNLQRGNR

SEQ ID NO: 28257 - protein, 29 aa, Artificial Sequence
  Description of Artificial Sequence: Synthetic peptide
SEEEIRTTNPVATEQYGSVSTDDQQGNFR

SEQ ID NO: 28258 - protein, 31 aa, Artificial Sequence
  Description of Artificial Sequence: Synthetic polypeptide
DEEEIRTTNPVATEQYGSVSITPNLIQDDNR

SEQ ID NO: 28259 - protein, 29 aa, Artificial Sequence
  Description of Artificial Sequence: Synthetic peptide
DEDEIRTTNPVCTEQYGSVATINLQRENR

SEQ ID NO: 28260 - protein, 28 aa, Artificial Sequence
  Description of Artificial Sequence: Synthetic peptide
DEEEINATNPVATEQYGVVGTNLQRGGR

SEQ ID NO: 28261 - protein, 28 aa, Artificial Sequence
  Description of Artificial Sequence: Synthetic peptide
DEQEIRTTNPVATEIYGSVSTVLQHGMR

SEQ ID NO: 28262 - protein, 31 aa, Artificial Sequence
  Description of Artificial Sequence: Synthetic polypeptide
DEEEIRTTNPVATECYGSVDSATNLPQRGLR

SEQ ID NO: 28263 - protein, 28 aa, Artificial Sequence
  Description of Artificial Sequence: Synthetic peptide
DEEEIATTNPTATEQYGSVSTNEQHGNI

SEQ ID NO: 28264 - protein, 31 aa, Artificial Sequence
  Description of Artificial Sequence: Synthetic polypeptide
DEEEIRTTNPVATEQYGSVSTLNPDQRGEDR

SEQ ID NO: 28265 - protein, 30 aa, Artificial Sequence
  Description of Artificial Sequence: Synthetic polypeptide
DEEEIRTTNPVATECYGSVSTELERNGNDR

SEQ ID NO: 28266 - protein, 28 aa, Artificial Sequence
  Description of Artificial Sequence: Synthetic peptide
DEEEIATTNPVATEQYGSASTDLQHGNM

SEQ ID NO: 28267 - protein, 28 aa, Artificial Sequence
  Description of Artificial Sequence: Synthetic peptide
DEEEIRTTNPVATEQYGSVSTDLEGGEN

SEQ ID NO: 28268 - protein, 28 aa, Artificial Sequence
  Description of Artificial Sequence: Synthetic peptide
DEEEIRTTNPVATEMYGSVSTDLQQGEH

SEQ ID NO: 28269 - protein, 28 aa, Artificial Sequence
  Description of Artificial Sequence: Synthetic peptide
SEEEIRTTNPTATEQYGEVSTNLQRGDG

SEQ ID NO: 28270 - protein, 30 aa, Artificial Sequence
  Description of Artificial Sequence: Synthetic polypeptide
SEEEIRTTNPVATEQFGSVSTNLQLRGENH

SEQ ID NO: 28271 - protein, 30 aa, Artificial Sequence
  Description of Artificial Sequence: Synthetic polypeptide
DEEEIRTTNPVATEQYGSVSNYNLQEGPNW

SEQ ID NO: 28272 - protein, 28 aa, Artificial Sequence
  Description of Artificial Sequence: Synthetic peptide
REEEIRTTNPVATEQYGSVSTELEVGNM

SEQ ID NO: 28273 - protein, 29 aa, Artificial Sequence
  Description of Artificial Sequence: Synthetic peptide
AEQEIVTTNPVATEQYGSVSATNEQRGNR

SEQ ID NO: 28274 - protein, 28 aa, Artificial Sequence
  Description of Artificial Sequence: Synthetic peptide
DEQEIATTNPVATEQYGSVSTNLQPGEL

SEQ ID NO: 28275 - protein, 28 aa, Artificial Sequence
  Description of Artificial Sequence: Synthetic peptide
DEQEIRTTNPVATECYGSVSTDLQTGNS

SEQ ID NO: 28276 - protein, 31 aa, Artificial Sequence
  Description of Artificial Sequence: Synthetic polypeptide
DEEEIRTTNPVATEQYGSVSATNLQVNGNDD

SEQ ID NO: 28277 - protein, 28 aa, Artificial Sequence
  Description of Artificial Sequence: Synthetic peptide
DEIEIRTTNPVATEGYGSVSENLQDGGR

SEQ ID NO: 28278 - protein, 28 aa, Artificial Sequence
  Description of Artificial Sequence: Synthetic peptide
DENEIRTTNPVATEQYGDVSTILMRENR

SEQ ID NO: 28279 - protein, 30 aa, Artificial Sequence
  Description of Artificial Sequence: Synthetic polypeptide
DEEEIATTNPTATEQYGSVSTMNEQRGDNR

SEQ ID NO: 28280 - protein, 28 aa, Artificial Sequence
  Description of Artificial Sequence: Synthetic peptide
MESEIRTTNPVATEQYGSCATVLQRGNR

SEQ ID NO: 28281 - protein, 30 aa, Artificial Sequence
  Description of Artificial Sequence: Synthetic polypeptide
DEEEIRTTNPVATESYGSASTENIQRDGNR

SEQ ID NO: 28282 - protein, 30 aa, Artificial Sequence
  Description of Artificial Sequence: Synthetic polypeptide
MEEEIRTTNPVATEQYGSVSTNLQENGNDW

SEQ ID NO: 28283 - protein, 31 aa, Artificial Sequence
  Description of Artificial Sequence: Synthetic polypeptide
DEEEIRTTNPVATEQYGSVCSTGPLQRNGNW

SEQ ID NO: 28284 - protein, 31 aa, Artificial Sequence
  Description of Artificial Sequence: Synthetic polypeptide
DEEEIRTTNPVATEQYGCVSTGALQERGENR

SEQ ID NO: 28285 - protein, 28 aa, Artificial Sequence
  Description of Artificial Sequence: Synthetic peptide
DEEEIRTTNPFATEQYGSVSTGLIPGNP

SEQ ID NO: 28286 - protein, 29 aa, Artificial Sequence
  Description of Artificial Sequence: Synthetic peptide
MENEIRTTNPVATEQYGSVSTNLQYGNDT

SEQ ID NO: 28287 - protein, 29 aa, Artificial Sequence
  Description of Artificial Sequence: Synthetic peptide
DEEEIRTVNPVATEQYGSTGTNLQERGER

SEQ ID NO: 28288 - protein, 28 aa, Artificial Sequence
  Description of Artificial Sequence: Synthetic peptide
DEEEIRTTNPVSTEQYGLVSTALQNGNL

SEQ ID NO: 28289 - protein, 28 aa, Artificial Sequence
  Description of Artificial Sequence: Synthetic peptide
GEEEIRTTNPVATENYGSVGTNLQDGNA

SEQ ID NO: 28290 - protein, 31 aa, Artificial Sequence
  Description of Artificial Sequence: Synthetic polypeptide
DEEEIRTTNPVATEQYGSVSTGNNDDREGNR

SEQ ID NO: 28291 - protein, 28 aa, Artificial Sequence
  Description of Artificial Sequence: Synthetic peptide
DEEEIATTNPVATEQYGSVSTDLQTGEN

SEQ ID NO: 28292 - protein, 29 aa, Artificial Sequence
  Description of Artificial Sequence: Synthetic peptide
YETEIRTTNPVATEQYGSVSMNLQRAGNT

SEQ ID NO: 28293 - protein, 28 aa, Artificial Sequence
  Description of Artificial Sequence: Synthetic peptide
DENEIRQTNPVATEQYGSVSTDLQRGED

SEQ ID NO: 28294 - protein, 30 aa, Artificial Sequence
  Description of Artificial Sequence: Synthetic polypeptide
DEEEIRTTNPVATEQYGSVSTNLEEVGNDI

SEQ ID NO: 28295 - protein, 28 aa, Artificial Sequence
  Description of Artificial Sequence: Synthetic peptide
DEECIRTTNPVATEQYGSWSTNLQPGEP

SEQ ID NO: 28296 - protein, 30 aa, Artificial Sequence
  Description of Artificial Sequence: Synthetic polypeptide
DEHEIRTTNPVATEQYGDVSCENLQRGNDR

SEQ ID NO: 28297 - protein, 28 aa, Artificial Sequence
  Description of Artificial Sequence: Synthetic peptide
MEEEIRTTNPVATEQYGAVSTNPQYGND

SEQ ID NO: 28298 - protein, 28 aa, Artificial Sequence
  Description of Artificial Sequence: Synthetic peptide
DEECIRTTNPTATECYGSVSANLQNGNR

SEQ ID NO: 28299 - protein, 28 aa, Artificial Sequence
  Description of Artificial Sequence: Synthetic peptide
QEEEIATTNPVATECYGSVSTCLQRENR

SEQ ID NO: 28300 - protein, 32 aa, Artificial Sequence
  Description of Artificial Sequence: Synthetic polypeptide
DEEEIRTTNPVATEQYGSVDSTLEPLVQRGNR

SEQ ID NO: 28301 - protein, 30 aa, Artificial Sequence
  Description of Artificial Sequence: Synthetic polypeptide
DENEICTTNPVATEQYGSVSTNLPQMLGNR

SEQ ID NO: 28302 - protein, 29 aa, Artificial Sequence
  Description of Artificial Sequence: Synthetic peptide
DEEEIRTTNPVATEQYGSVSTNEMMQGNM

SEQ ID NO: 28303 - protein, 29 aa, Artificial Sequence
  Description of Artificial Sequence: Synthetic peptide
DEEEIRCTNPVSTEQWGSVSTNLQQGNDR

SEQ ID NO: 28304 - protein, 28 aa, Artificial Sequence
  Description of Artificial Sequence: Synthetic peptide
DEQEIRTTNPVATEQYGSVETEDQRGNA

SEQ ID NO: 28305 - protein, 30 aa, Artificial Sequence
  Description of Artificial Sequence: Synthetic polypeptide
DEEEIRTTNPVATEAYGSVSAENLQRTGNM

SEQ ID NO: 28306 - protein, 28 aa, Artificial Sequence
  Description of Artificial Sequence: Synthetic peptide
DEEEIATTNPTATEQYGSVSTNPQHGNV

SEQ ID NO: 28307 - protein, 28 aa, Artificial Sequence
  Description of Artificial Sequence: Synthetic peptide
DEEEIVATNPVATECYGSVSTNLQRGEQ

SEQ ID NO: 28308 - protein, 30 aa, Artificial Sequence
  Description of Artificial Sequence: Synthetic polypeptide
DEQEIRTTNPVATEVYGAVSATNLQREGNR

SEQ ID NO: 28309 - protein, 30 aa, Artificial Sequence
  Description of Artificial Sequence: Synthetic polypeptide
DEEEIRTTNPVATEQYGSVETNLQDPDGER

SEQ ID NO: 28310 - protein, 30 aa, Artificial Sequence
  Description of Artificial Sequence: Synthetic polypeptide
DEQEIRTTNPVATEQYGSVSTNEMMRGNDR

SEQ ID NO: 28311 - protein, 28 aa, Artificial Sequence
  Description of Artificial Sequence: Synthetic peptide
DENEIRTTNPVATEQYGVVSTELERGNW

SEQ ID NO: 28312 - protein, 28 aa, Artificial Sequence
  Description of Artificial Sequence: Synthetic peptide
DENEIRTTNPVATEQWGSVSTNEQIGNM

SEQ ID NO: 28313 - protein, 28 aa, Artificial Sequence
  Description of Artificial Sequence: Synthetic peptide
NEEEIRTTNPVACENYGFVSTNLQRGQR

SEQ ID NO: 28314 - protein, 29 aa, Artificial Sequence
  Description of Artificial Sequence: Synthetic peptide
DEEEIRTTNPVATEQYGSVSEVLISGNDR

SEQ ID NO: 28315 - protein, 28 aa, Artificial Sequence
  Description of Artificial Sequence: Synthetic peptide
DEEEIATTNPVATESYGWVSTNLQHGNF

SEQ ID NO: 28316 - protein, 28 aa, Artificial Sequence
  Description of Artificial Sequence: Synthetic peptide
DEEEIRTTNPVATEQYGSVSDNDWHGND

SEQ ID NO: 28317 - protein, 29 aa, Artificial Sequence
  Description of Artificial Sequence: Synthetic peptide
DEAEISTTNPVATEQYGSVSTGLQREGNF

SEQ ID NO: 28318 - protein, 28 aa, Artificial Sequence
  Description of Artificial Sequence: Synthetic peptide
DEEEIATTNPVATEQYGSVSTDLQQGEL

SEQ ID NO: 28319 - protein, 28 aa, Artificial Sequence
  Description of Artificial Sequence: Synthetic peptide
DESEIRATNPVATEQYGSVSTNLDIGER

SEQ ID NO: 28320 - protein, 29 aa, Artificial Sequence
  Description of Artificial Sequence: Synthetic peptide
MEEEIRTTNPVATEQYGSVSDVLQAAGNR

SEQ ID NO: 28321 - protein, 31 aa, Artificial Sequence
  Description of Artificial Sequence: Synthetic polypeptide
DEEEIRTTNPVATEQYGSVSTNLQNFEGTFR

SEQ ID NO: 28322 - protein, 30 aa, Artificial Sequence
  Description of Artificial Sequence: Synthetic polypeptide
DEEELRTTNPVATEQYGSVSTMNLQAGENY

SEQ ID NO: 28323 - protein, 28 aa, Artificial Sequence
  Description of Artificial Sequence: Synthetic peptide
DEEEIRTTNPVATEQYGSVSTDLEIGEV

SEQ ID NO: 28324 - protein, 28 aa, Artificial Sequence
  Description of Artificial Sequence: Synthetic peptide
DEEEIRTVNPVATEMYGVVSTELQRGNI

SEQ ID NO: 28325 - protein, 31 aa, Artificial Sequence
  Description of Artificial Sequence: Synthetic polypeptide
DEEEIRTTNPVATEQYGSVSETNLQEIKGNM

SEQ ID NO: 28326 - protein, 30 aa, Artificial Sequence
  Description of Artificial Sequence: Synthetic polypeptide
DEEEIRTTNPVATECYGSVSTNLQEVEGDR

SEQ ID NO: 28327 - protein, 28 aa, Artificial Sequence
  Description of Artificial Sequence: Synthetic peptide
DEEEIATTNPVATEQYGSVSTNQEVGNI

SEQ ID NO: 28328 - protein, 29 aa, Artificial Sequence
  Description of Artificial Sequence: Synthetic peptide
DEREIVATNPVSTEQYGSVSTNLQRGNDR

SEQ ID NO: 28329 - protein, 28 aa, Artificial Sequence
  Description of Artificial Sequence: Synthetic peptide
DEEEIRATNPVAVEQYGSVSTELQRGEW

SEQ ID NO: 28330 - protein, 29 aa, Artificial Sequence
  Description of Artificial Sequence: Synthetic peptide
DEEEICTTNPVATEQYGGVSTVIQSRGNR

SEQ ID NO: 28331 - protein, 31 aa, Artificial Sequence
  Description of Artificial Sequence: Synthetic polypeptide
DEEEIRTTNPVATEQYGSVSATNLQERGDEH

SEQ ID NO: 28332 - protein, 31 aa, Artificial Sequence
  Description of Artificial Sequence: Synthetic polypeptide
DEEEIRTTNPVATEQYGSVSTNLPEQEGNEP

SEQ ID NO: 28333 - protein, 28 aa, Artificial Sequence
  Description of Artificial Sequence: Synthetic peptide
DEEEIVTTNPVATEIYGVVSTNLETGNR

SEQ ID NO: 28334 - protein, 28 aa, Artificial Sequence
  Description of Artificial Sequence: Synthetic peptide
DEEEIRTTNPVATEQYGSVSTGDQIGEL

SEQ ID NO: 28335 - protein, 29 aa, Artificial Sequence
  Description of Artificial Sequence: Synthetic peptide
SEEEIRATNPVATEQYGSVSTNLQVGTWR

SEQ ID NO: 28336 - protein, 28 aa, Artificial Sequence
  Description of Artificial Sequence: Synthetic peptide
DEQEIRTTNPVATEQYGSVSENEQIGNW

SEQ ID NO: 28337 - protein, 29 aa, Artificial Sequence
  Description of Artificial Sequence: Synthetic peptide
DEEEIRTTNPVATEQYGEVSTMNLQIGDA

SEQ ID NO: 28338 - protein, 28 aa, Artificial Sequence
  Description of Artificial Sequence: Synthetic peptide
DEQEIRTTNPVATEQYGSVDTAQQRGNL

SEQ ID NO: 28339 - protein, 31 aa, Artificial Sequence
  Description of Artificial Sequence: Synthetic polypeptide
DEEEIRTTNPVATEQYGSVSVTNLEEGGNER

SEQ ID NO: 28340 - protein, 28 aa, Artificial Sequence
  Description of Artificial Sequence: Synthetic peptide
DEQEIRTTNPVATEQWGSVSTNEMRGNP

SEQ ID NO: 28341 - protein, 28 aa, Artificial Sequence
  Description of Artificial Sequence: Synthetic peptide
DEEEIRTTNPVATEQYGSVSTEDEAGNF

SEQ ID NO: 28342 - protein, 28 aa, Artificial Sequence
  Description of Artificial Sequence: Synthetic peptide
DEEEIRTTNPVATECYGSVSTDLQNGDS

SEQ ID NO: 28343 - protein, 28 aa, Artificial Sequence
  Description of Artificial Sequence: Synthetic peptide
QEEEIRTTNPVATEQYGSVSTVLQHGEK

SEQ ID NO: 28344 - protein, 28 aa, Artificial Sequence
  Description of Artificial Sequence: Synthetic peptide
DEEEVATVNPVATEQYGAVSTNLQRPNR

SEQ ID NO: 28345 - protein, 29 aa, Artificial Sequence
  Description of Artificial Sequence: Synthetic peptide
QEEEIATTNPVATEQYGSVSENLQRGEDR

SEQ ID NO: 28346 - protein, 29 aa, Artificial Sequence
  Description of Artificial Sequence: Synthetic peptide
DEEEIRTTNPVATEQYGSVSTDLQVGEDM

SEQ ID NO: 28347 - protein, 28 aa, Artificial Sequence
  Description of Artificial Sequence: Synthetic peptide
DEEEIATTNPVATEQYGSVSTDLQIGET

SEQ ID NO: 28348 - protein, 28 aa, Artificial Sequence
  Description of Artificial Sequence: Synthetic peptide
DEEEIRTTNPVATEVYGNVSTEEQRGNA

SEQ ID NO: 28349 - protein, 31 aa, Artificial Sequence
  Description of Artificial Sequence: Synthetic polypeptide
DEEEIRTTNPVATEQYGSVPFTNNLQRGDNH

SEQ ID NO: 28350 - protein, 30 aa, Artificial Sequence
  Description of Artificial Sequence: Synthetic polypeptide
DEEEIRTTNPTATEQYGSVSTANLQRGVTL

SEQ ID NO: 28351 - protein, 30 aa, Artificial Sequence
  Description of Artificial Sequence: Synthetic polypeptide
DEEEIRTTNPVATEQYGSVSTNPQEIGNTQ

SEQ ID NO: 28352 - protein, 28 aa, Artificial Sequence
  Description of Artificial Sequence: Synthetic peptide
DEEEIRVTNPVSTEQYGEVSTNLQQGNV

SEQ ID NO: 28353 - protein, 32 aa, Artificial Sequence
  Description of Artificial Sequence: Synthetic polypeptide
DEEEIRTTNPVATEQYGSVYSTENGLQQGVNR

SEQ ID NO: 28354 - protein, 28 aa, Artificial Sequence
  Description of Artificial Sequence: Synthetic peptide
DETEIRTTNPVATEQYGSVSTNPEFGNF

SEQ ID NO: 28355 - protein, 30 aa, Artificial Sequence
  Description of Artificial Sequence: Synthetic polypeptide
DEEEIRTTNPVATEQYGSVSTEPLQITGNV

SEQ ID NO: 28356 - protein, 31 aa, Artificial Sequence
  Description of Artificial Sequence: Synthetic polypeptide
DEEEIRTTNPVATEQYGSVSTMNLQDQGNTF

SEQ ID NO: 28357 - protein, 30 aa, Artificial Sequence
  Description of Artificial Sequence: Synthetic polypeptide
DEQEIATTNPVATEQYGSVSATNLQDRGNM

SEQ ID NO: 28358 - protein, 29 aa, Artificial Sequence
  Description of Artificial Sequence: Synthetic peptide
GEEEIRTTNPVATEQYGSVSTNLEPGNDQ

SEQ ID NO: 28359 - protein, 28 aa, Artificial Sequence
  Description of Artificial Sequence: Synthetic peptide
DEEEIRTTNPVATEQYGSVSEDLQIGEM

SEQ ID NO: 28360 - protein, 29 aa, Artificial Sequence
  Description of Artificial Sequence: Synthetic peptide
QEEEIRTTNPVATEQYGSVSTDLQDNGND

SEQ ID NO: 28361 - protein, 30 aa, Artificial Sequence
  Description of Artificial Sequence: Synthetic polypeptide
GEEEISTTNPVATEQYGSVCSTNLQERGNP

SEQ ID NO: 28362 - protein, 31 aa, Artificial Sequence
  Description of Artificial Sequence: Synthetic polypeptide
DEEEIRTTNPVATEQYGSVCSTVNLVDIGNR

SEQ ID NO: 28363 - protein, 29 aa, Artificial Sequence
  Description of Artificial Sequence: Synthetic peptide
DEEEIRTTNPVATEQYGSVSAENEQQGNF

SEQ ID NO: 28364 - protein, 31 aa, Artificial Sequence
  Description of Artificial Sequence: Synthetic polypeptide
DEEEIRTTNPVATEQYGSVSTNLQLVNGNDE

SEQ ID NO: 28365 - protein, 32 aa, Artificial Sequence
  Description of Artificial Sequence: Synthetic polypeptide
DEEEIRTTNPVATEQYGSVESTDNGDQRGNPR

SEQ ID NO: 28366 - protein, 29 aa, Artificial Sequence
  Description of Artificial Sequence: Synthetic peptide
DEDEIRTTNPVATEQYGSVSTNLQIDGDY

SEQ ID NO: 28367 - protein, 32 aa, Artificial Sequence
  Description of Artificial Sequence: Synthetic polypeptide
DEEEIRTTNPVATEVYGSVSTNLQQDRNGNDR

SEQ ID NO: 28368 - protein, 30 aa, Artificial Sequence
  Description of Artificial Sequence: Synthetic polypeptide
DEEEIRTTNPVATEQYGSVSTANDSQTGNM

SEQ ID NO: 28369 - protein, 31 aa, Artificial Sequence
  Description of Artificial Sequence: Synthetic polypeptide
DEEEIRTTNPVATEQYGSVSTNLQEVEGNDN

SEQ ID NO: 28370 - protein, 28 aa, Artificial Sequence
  Description of Artificial Sequence: Synthetic peptide
DEQEIRTTNPVATELYGSVSTNEQIGNM

SEQ ID NO: 28371 - protein, 30 aa, Artificial Sequence
  Description of Artificial Sequence: Synthetic polypeptide
DEEEIRTTNPVATEQYGESVSITPEQIGNR

SEQ ID NO: 28372 - protein, 30 aa, Artificial Sequence
  Description of Artificial Sequence: Synthetic polypeptide
DEEEIRTTNPVATEQYGDVSENLQRQGEDR

SEQ ID NO: 28373 - protein, 28 aa, Artificial Sequence
  Description of Artificial Sequence: Synthetic peptide
DEEEIRTTNPVATEQYGSVSELDDEGNR

SEQ ID NO: 28374 - protein, 29 aa, Artificial Sequence
  Description of Artificial Sequence: Synthetic peptide
DEQEIATTNPVATEQYGSVSATDLQRGNL

SEQ ID NO: 28375 - protein, 29 aa, Artificial Sequence
  Description of Artificial Sequence: Synthetic peptide
DEEEIRSTNPVATECYGSVSTNLQVGNDN

SEQ ID NO: 28376 - protein, 30 aa, Artificial Sequence
  Description of Artificial Sequence: Synthetic polypeptide
DEQEIRTTNPVATEQYGSVSTENLNRTGNA

SEQ ID NO: 28377 - protein, 28 aa, Artificial Sequence
  Description of Artificial Sequence: Synthetic peptide
DEEEICTTNPVSTEQYGEVSTNLQEGNF

SEQ ID NO: 28378 - protein, 29 aa, Artificial Sequence
  Description of Artificial Sequence: Synthetic peptide
DEEEISTTNPVATEQYGSVSEELQTGENR

SEQ ID NO: 28379 - protein, 31 aa, Artificial Sequence
  Description of Artificial Sequence: Synthetic polypeptide
DEEEIRTTNPVATEQYGSVSETNLTERGENP

SEQ ID NO: 28380 - protein, 29 aa, Artificial Sequence
  Description of Artificial Sequence: Synthetic peptide
QEEEIRTTNPVATEVYGSVATNLERGNER

SEQ ID NO: 28381 - protein, 31 aa, Artificial Sequence
  Description of Artificial Sequence: Synthetic polypeptide
DEEEIRTTNPVATEQYGSVSCTMELQRGNDQ

SEQ ID NO: 28382 - protein, 28 aa, Artificial Sequence
  Description of Artificial Sequence: Synthetic peptide
DEEEIRTTNPVAIEQYGSVSTNEERVIR

SEQ ID NO: 28383 - protein, 30 aa, Artificial Sequence
  Description of Artificial Sequence: Synthetic polypeptide
DEVEIRTTNPVATEQYGSVSTGNLQDRPNH

SEQ ID NO: 28384 - protein, 30 aa, Artificial Sequence
  Description of Artificial Sequence: Synthetic polypeptide
MEEEIRTTNPVATEQYGSVSTNLQHEGNDA

SEQ ID NO: 28385 - protein, 28 aa, Artificial Sequence
  Description of Artificial Sequence: Synthetic peptide
DEEQIRTTNPVATEQYGSVSTHELRGNT

SEQ ID NO: 28386 - protein, 30 aa, Artificial Sequence
  Description of Artificial Sequence: Synthetic polypeptide
DEEEIRTTNPVATEQYGSVSTELQVRKGEN

SEQ ID NO: 28387 - protein, 30 aa, Artificial Sequence
  Description of Artificial Sequence: Synthetic polypeptide
DEQEIRTTNPVATEQYGSVSDTNLQLGMER

SEQ ID NO: 28388 - protein, 28 aa, Artificial Sequence
  Description of Artificial Sequence: Synthetic peptide
SEEEIRTTNPVSTEQYGIVSTNEQRGTR

SEQ ID NO: 28389 - protein, 29 aa, Artificial Sequence
  Description of Artificial Sequence: Synthetic peptide
DEEEIRTTNPTATEQYGSVSTNEQNGDNF

SEQ ID NO: 28390 - protein, 28 aa, Artificial Sequence
  Description of Artificial Sequence: Synthetic peptide
DEEEIRATNPVATECYGSVSTNLERGEE

SEQ ID NO: 28391 - protein, 28 aa, Artificial Sequence
  Description of Artificial Sequence: Synthetic peptide
DEEEIRTTNPVATECYGSVSTDLQHGEL

SEQ ID NO: 28392 - protein, 30 aa, Artificial Sequence
  Description of Artificial Sequence: Synthetic polypeptide
DEEEIITTNPVATEQYGSVSTTLQDRGPNS

SEQ ID NO: 28393 - protein, 28 aa, Artificial Sequence
  Description of Artificial Sequence: Synthetic peptide
DEEEIRTTNPVATEQWGSVSTNLELGTQ

SEQ ID NO: 28394 - protein, 32 aa, Artificial Sequence
  Description of Artificial Sequence: Synthetic polypeptide
DEEEIRTTNPVATEQYGSVTSTNLQMGKGNDR

SEQ ID NO: 28395 - protein, 29 aa, Artificial Sequence
  Description of Artificial Sequence: Synthetic peptide
DEQEIRTTNPVATEQYGSVSTNLQDNENS

SEQ ID NO: 28396 - protein, 28 aa, Artificial Sequence
  Description of Artificial Sequence: Synthetic peptide
DDEEIRTTNPVATECYGSCSTNLESGNR

SEQ ID NO: 28397 - protein, 30 aa, Artificial Sequence
  Description of Artificial Sequence: Synthetic polypeptide
DEEEIRTTNPVATEVYGSVTTNLQDGDNHR

SEQ ID NO: 28398 - protein, 29 aa, Artificial Sequence
  Description of Artificial Sequence: Synthetic peptide
DEEEIATTNPVATEQYGSVSITNPDRGNS

SEQ ID NO: 28399 - protein, 28 aa, Artificial Sequence
  Description of Artificial Sequence: Synthetic peptide
DEEEIRATNPVATEQYGSVSTELQGGES

SEQ ID NO: 28400 - protein, 28 aa, Artificial Sequence
  Description of Artificial Sequence: Synthetic peptide
DEEEIRTTNPVATEQYGDVSENLQHGEM

SEQ ID NO: 28401 - protein, 28 aa, Artificial Sequence
  Description of Artificial Sequence: Synthetic peptide
DEEEIRTTNPVATELWGSVSTNLMIGNA

SEQ ID NO: 28402 - protein, 28 aa, Artificial Sequence
  Description of Artificial Sequence: Synthetic peptide
DEEEIRTTNPVATEQYGSVSENPQFGDI

SEQ ID NO: 28403 - protein, 31 aa, Artificial Sequence
  Description of Artificial Sequence: Synthetic polypeptide
DEEEIRTTNPVATEQYGSVSCTMDLQRGNDQ

SEQ ID NO: 28404 - protein, 28 aa, Artificial Sequence
  Description of Artificial Sequence: Synthetic peptide
DEEEIRTTNPVAYEQYGSVEHNLQRLND

SEQ ID NO: 28405 - protein, 30 aa, Artificial Sequence
  Description of Artificial Sequence: Synthetic polypeptide
DSEEIRTTNPVASEQYGSVFSTNLEQIGNR

SEQ ID NO: 28406 - protein, 28 aa, Artificial Sequence
  Description of Artificial Sequence: Synthetic peptide
DENEIATTNPVATEQYGVVSTNLQRGED

SEQ ID NO: 28407 - protein, 28 aa, Artificial Sequence
  Description of Artificial Sequence: Synthetic peptide
DEQEITTTNPVATEQYGSVSTELQDGNL

SEQ ID NO: 28408 - protein, 29 aa, Artificial Sequence
  Description of Artificial Sequence: Synthetic peptide
DEEEIRTTNPVATEQWGSVSTNLQLLGDL

SEQ ID NO: 28409 - protein, 30 aa, Artificial Sequence
  Description of Artificial Sequence: Synthetic polypeptide
DEQEVRTTNPVATEQYGSVSAMNLQREGNR

SEQ ID NO: 28410 - protein, 32 aa, Artificial Sequence
  Description of Artificial Sequence: Synthetic polypeptide
DEEEIRTTNPVATEQYGSVETNLVQREGENDR

SEQ ID NO: 28411 - protein, 31 aa, Artificial Sequence
  Description of Artificial Sequence: Synthetic polypeptide
DEEEIRTTNPVATEQYGSVSTANEQERGNTF

SEQ ID NO: 28412 - protein, 30 aa, Artificial Sequence
  Description of Artificial Sequence: Synthetic polypeptide
SEEEIRTTNPVATEQYGSVSTMNLQVGDTR

SEQ ID NO: 28413 - protein, 28 aa, Artificial Sequence
  Description of Artificial Sequence: Synthetic peptide
DEQEIRTTNPVATEIWGSVSTNLMRGNF

SEQ ID NO: 28414 - protein, 31 aa, Artificial Sequence
  Description of Artificial Sequence: Synthetic polypeptide
DEEEIRTTNPVATEQYGSVASTDNLQTRLNM

SEQ ID NO: 28415 - protein, 28 aa, Artificial Sequence
  Description of Artificial Sequence: Synthetic peptide
DEEEIRTTNPVATEQWGSVSENEMQGNR

SEQ ID NO: 28416 - protein, 30 aa, Artificial Sequence
  Description of Artificial Sequence: Synthetic polypeptide
QEEEIRTTNPVATEQYGSVSTNLQVTGNDN

SEQ ID NO: 28417 - protein, 32 aa, Artificial Sequence
  Description of Artificial Sequence: Synthetic polypeptide
DEEEIRTTNPVATEQYGSVSITPNPLQIRGER

SEQ ID NO: 28418 - protein, 31 aa, Artificial Sequence
  Description of Artificial Sequence: Synthetic polypeptide
DEEEIRTTNPVATEQYGSYVEPNLQREGNDR

SEQ ID NO: 28419 - protein, 30 aa, Artificial Sequence
  Description of Artificial Sequence: Synthetic polypeptide
DEEEIRTTNPVATEQYGSVSCTDLQYGNDD

SEQ ID NO: 28420 - protein, 29 aa, Artificial Sequence
  Description of Artificial Sequence: Synthetic peptide
GEEEIRATNPVATEQYGSVSTELQRGNDS

SEQ ID NO: 28421 - protein, 30 aa, Artificial Sequence
  Description of Artificial Sequence: Synthetic polypeptide
DEEEIRTTNPVATEQYGSVSTGDQIRGDNY

SEQ ID NO: 28422 - protein, 28 aa, Artificial Sequence
  Description of Artificial Sequence: Synthetic peptide
DEEEIRTTNPVSTEMYGAVANNLQRGNR

SEQ ID NO: 28423 - protein, 28 aa, Artificial Sequence
  Description of Artificial Sequence: Synthetic peptide
DEQEIRTTNPVATEQYGSVSTDLEHGER

SEQ ID NO: 28424 - protein, 28 aa, Artificial Sequence
  Description of Artificial Sequence: Synthetic peptide
DEQEIRTTNPVATEQYGSASEDLQRGER

SEQ ID NO: 28425 - protein, 28 aa, Artificial Sequence
  Description of Artificial Sequence: Synthetic peptide
DEEEITTTNPVATEQYGSVSTNLEPGEN

SEQ ID NO: 28426 - protein, 28 aa, Artificial Sequence
  Description of Artificial Sequence: Synthetic peptide
AEGEIRTTNPVATEQYGGVSENLQMGNR

SEQ ID NO: 28427 - protein, 29 aa, Artificial Sequence
  Description of Artificial Sequence: Synthetic peptide
QENEIVTTNPVATEQYGSVSTNLQDRGNQ

SEQ ID NO: 28428 - protein, 28 aa, Artificial Sequence
  Description of Artificial Sequence: Synthetic peptide
DEEEIRTTNPVATECYGSVSDELQAGNF

SEQ ID NO: 28429 - protein, 30 aa, Artificial Sequence
  Description of Artificial Sequence: Synthetic polypeptide
DEQEIRTTNPVATEQYGSVEDTNLQRNGDR

SEQ ID NO: 28430 - protein, 28 aa, Artificial Sequence
  Description of Artificial Sequence: Synthetic peptide
DEVEIRTTNPVATEMYGSVSENEQRGNF

SEQ ID NO: 28431 - protein, 28 aa, Artificial Sequence
  Description of Artificial Sequence: Synthetic peptide
DEEEIRTTNPVATEVYGSVSTELQIGDT

SEQ ID NO: 28432 - protein, 33 aa, Artificial Sequence
  Description of Artificial Sequence: Synthetic polypeptide
DEEEIRTTNPVATEQYGSVSSLTMNLVQRGENR

SEQ ID NO: 28433 - protein, 28 aa, Artificial Sequence
  Description of Artificial Sequence: Synthetic peptide
GEEEIRTVNPVATEQYGVVSTNLQRGEY

SEQ ID NO: 28434 - protein, 30 aa, Artificial Sequence
  Description of Artificial Sequence: Synthetic polypeptide
DEQEIRTTNPVATEQYGSVSATNLQHGEDR

SEQ ID NO: 28435 - protein, 28 aa, Artificial Sequence
  Description of Artificial Sequence: Synthetic peptide
AEEEIRTTNPVATEQYGVVSTDLQIGNL

SEQ ID NO: 28436 - protein, 29 aa, Artificial Sequence
  Description of Artificial Sequence: Synthetic peptide
DEEEIRTTNPAATEQYGSVSTDEPQGGNR

SEQ ID NO: 28437 - protein, 30 aa, Artificial Sequence
  Description of Artificial Sequence: Synthetic polypeptide
DEEEIRCTNPVATEQYGSYSTNLQGAGENR

SEQ ID NO: 28438 - protein, 28 aa, Artificial Sequence
  Description of Artificial Sequence: Synthetic peptide
AEEEIRTTNPLATEQYGSVSTNLQNGTE

SEQ ID NO: 28439 - protein, 30 aa, Artificial Sequence
  Description of Artificial Sequence: Synthetic polypeptide
DENEIRTTNPVATEQYGSVSTNLQDGENDI

SEQ ID NO: 28440 - protein, 28 aa, Artificial Sequence
  Description of Artificial Sequence: Synthetic peptide
KEEEIRSTNPVATEQYGSVSTNLEDGNN

SEQ ID NO: 28441 - protein, 31 aa, Artificial Sequence
  Description of Artificial Sequence: Synthetic polypeptide
DEEEIRTTNPVATEQYGSVSTNLQEVNGNDD

SEQ ID NO: 28442 - protein, 28 aa, Artificial Sequence
  Description of Artificial Sequence: Synthetic peptide
DEEEIRSTNPVATEVYGGVSTELNRGNR

SEQ ID NO: 28443 - protein, 28 aa, Artificial Sequence
  Description of Artificial Sequence: Synthetic peptide
DEEEIRTTNPVATEQYGSVDTNDETGNM

SEQ ID NO: 28444 - protein, 29 aa, Artificial Sequence
  Description of Artificial Sequence: Synthetic peptide
KEEEIRTTNPVATEQYGVVSTNLQDHGNS

SEQ ID NO: 28445 - protein, 30 aa, Artificial Sequence
  Description of Artificial Sequence: Synthetic polypeptide
DEEEIRTTNPVATEQYGSVSTMDLQCQGNC

SEQ ID NO: 28446 - protein, 31 aa, Artificial Sequence
  Description of Artificial Sequence: Synthetic polypeptide
MEEEIRTTNPVATEQYGSVSTNLQEREGNDA

SEQ ID NO: 28447 - protein, 31 aa, Artificial Sequence
  Description of Artificial Sequence: Synthetic polypeptide
DEEEIRTTNPVATEQYGSVSTNLELREGNDT

SEQ ID NO: 28448 - protein, 28 aa, Artificial Sequence
  Description of Artificial Sequence: Synthetic peptide
AEQEIVTTNPVATEIYGVVSTNLQRGNR

SEQ ID NO: 28449 - protein, 28 aa, Artificial Sequence
  Description of Artificial Sequence: Synthetic peptide
DEEEIRTTNPVATECYGSVSTELEMGNS

SEQ ID NO: 28450 - protein, 30 aa, Artificial Sequence
  Description of Artificial Sequence: Synthetic polypeptide
DEEEIRTTNPVATEQYGSVSTMDLQQGNDA

SEQ ID NO: 28451 - protein, 28 aa, Artificial Sequence
  Description of Artificial Sequence: Synthetic peptide
DEEEIRGTNPVATEQYGSVSENWERGND

SEQ ID NO: 28452 - protein, 29 aa, Artificial Sequence
  Description of Artificial Sequence: Synthetic peptide
IEEEIRTTNPVATEQYGLVSTNGQRGDNG

SEQ ID NO: 28453 - protein, 28 aa, Artificial Sequence
  Description of Artificial Sequence: Synthetic peptide
YEEEITTTNPCATEQYGSVSTNLQGGNA

SEQ ID NO: 28454 - protein, 31 aa, Artificial Sequence
  Description of Artificial Sequence: Synthetic polypeptide
DEEEIRTTNPVATEQYGSVSTGNDERNGENR

SEQ ID NO: 28455 - protein, 28 aa, Artificial Sequence
  Description of Artificial Sequence: Synthetic peptide
DEYEIRTTNPVATEQYGFASTNLQQGNK

SEQ ID NO: 28456 - protein, 28 aa, Artificial Sequence
  Description of Artificial Sequence: Synthetic peptide
NEEEITTTNPVATESYGSASTNLQHGNR

SEQ ID NO: 28457 - protein, 29 aa, Artificial Sequence
  Description of Artificial Sequence: Synthetic peptide
MEEEIRTTNPVATEMYGSVSTNLQDAGNN

SEQ ID NO: 28458 - protein, 28 aa, Artificial Sequence
  Description of Artificial Sequence: Synthetic peptide
DEEEIATTNPVATEQYGSVSTNQELGNT

SEQ ID NO: 28459 - protein, 31 aa, Artificial Sequence
  Description of Artificial Sequence: Synthetic polypeptide
DEEEIRTTNPVATEQYGSVSTNEQIREGNDW

SEQ ID NO: 28460 - protein, 29 aa, Artificial Sequence
  Description of Artificial Sequence: Synthetic peptide
DEEEIRTTNPVATEQYGSVTSTDLPYGNT

SEQ ID NO: 28461 - protein, 28 aa, Artificial Sequence
  Description of Artificial Sequence: Synthetic peptide
DESEIRATNPVASEQYGSVSTNLQGGDR

SEQ ID NO: 28462 - protein, 30 aa, Artificial Sequence
  Description of Artificial Sequence: Synthetic polypeptide
DEEEIRTTNPEATEQYGSVSTNLQREGEPG

SEQ ID NO: 28463 - protein, 28 aa, Artificial Sequence
  Description of Artificial Sequence: Synthetic peptide
DEQEIRTTNPVATEQYGSVSTELEMGNA

SEQ ID NO: 28464 - protein, 32 aa, Artificial Sequence
  Description of Artificial Sequence: Synthetic polypeptide
DEEEIRTTNPVATEQYGSMVSTHNLMLRGNER

SEQ ID NO: 28465 - protein, 31 aa, Artificial Sequence
  Description of Artificial Sequence: Synthetic polypeptide
DEEEIRTTNPVATEQYGSVSDTWLYQRSQNR

SEQ ID NO: 28466 - protein, 32 aa, Artificial Sequence
  Description of Artificial Sequence: Synthetic polypeptide
DEEEIRTTNPVATEQYGSVSTMNLQLREGDNF

SEQ ID NO: 28467 - protein, 30 aa, Artificial Sequence
  Description of Artificial Sequence: Synthetic polypeptide
DEEEIRTTNPCATEQYGAVSTPLQRKGNDR

SEQ ID NO: 28468 - protein, 28 aa, Artificial Sequence
  Description of Artificial Sequence: Synthetic peptide
DEEEIATTNPVATEQYGWVSENLTWGNR

SEQ ID NO: 28469 - protein, 29 aa, Artificial Sequence
  Description of Artificial Sequence: Synthetic peptide
AEEEIRTTNPVATEQYGWVSTNLQRGDEN

SEQ ID NO: 28470 - protein, 32 aa, Artificial Sequence
  Description of Artificial Sequence: Synthetic polypeptide
DEEEIRTTNPVATEQYGSVDSTNGLQSTGNDR

SEQ ID NO: 28471 - protein, 28 aa, Artificial Sequence
  Description of Artificial Sequence: Synthetic peptide
DEEEIAATNPVATEQYGQVCTNLQRGTR

SEQ ID NO: 28472 - protein, 28 aa, Artificial Sequence
  Description of Artificial Sequence: Synthetic peptide
DEEEIRTTNPVATEQYGDVWTTDQRGNA

SEQ ID NO: 28473 - protein, 28 aa, Artificial Sequence
  Description of Artificial Sequence: Synthetic peptide
DEEEIRTTNPVATEQYGSNSTNLVDGLG

SEQ ID NO: 28474 - protein, 28 aa, Artificial Sequence
  Description of Artificial Sequence: Synthetic peptide
YEEEIRTTNPVATEQYGSVSDELQRGMA

SEQ ID NO: 28475 - protein, 28 aa, Artificial Sequence
  Description of Artificial Sequence: Synthetic peptide
DEEEIRTTNPVATEQYGSVDTALGQGND

SEQ ID NO: 28476 - protein, 29 aa, Artificial Sequence
  Description of Artificial Sequence: Synthetic peptide
DEQEIATTNPVATECYGSVSTNLQDRGNT

SEQ ID NO: 28477 - protein, 28 aa, Artificial Sequence
  Description of Artificial Sequence: Synthetic peptide
DEEEIRTTNPVATEQYGSVSTPDDTGNG

SEQ ID NO: 28478 - protein, 28 aa, Artificial Sequence
  Description of Artificial Sequence: Synthetic peptide
DEEEIRTTNPVATEQYGSVDTNDMVGNF

SEQ ID NO: 28479 - protein, 28 aa, Artificial Sequence
  Description of Artificial Sequence: Synthetic peptide
HEEEITTTNPVATEQYGSVSTNLITGNT

SEQ ID NO: 28480 - protein, 31 aa, Artificial Sequence
  Description of Artificial Sequence: Synthetic polypeptide
DEEEIRTTNPVATEQYGSVSCTDLQCRGNDD

SEQ ID NO: 28481 - protein, 28 aa, Artificial Sequence
  Description of Artificial Sequence: Synthetic peptide
DEEEIRTTNPVATEQYGSVSTALNIENE

SEQ ID NO: 28482 - protein, 28 aa, Artificial Sequence
  Description of Artificial Sequence: Synthetic peptide
DENEIRTTNPVATEQYGSVSENEQQGNS

SEQ ID NO: 28483 - protein, 32 aa, Artificial Sequence
  Description of Artificial Sequence: Synthetic polypeptide
DEEEIRTTNPVATEQYGSVSDTNLERNGENDR

SEQ ID NO: 28484 - protein, 28 aa, Artificial Sequence
  Description of Artificial Sequence: Synthetic peptide
HEEEIRTTNPVATECYGSVSTELQRGEH

SEQ ID NO: 28485 - protein, 28 aa, Artificial Sequence
  Description of Artificial Sequence: Synthetic peptide
DEEEIRTTNPDATEQYGSVSTGDDRGER

SEQ ID NO: 28486 - protein, 28 aa, Artificial Sequence
  Description of Artificial Sequence: Synthetic peptide
DEEEIRTTNPFATEQYGSVSTNEDFGND

SEQ ID NO: 28487 - protein, 28 aa, Artificial Sequence
  Description of Artificial Sequence: Synthetic peptide
AEEEIRTTNPVATEVYGNVSENLQRGMR

SEQ ID NO: 28488 - protein, 31 aa, Artificial Sequence
  Description of Artificial Sequence: Synthetic polypeptide
DEEEIRTTNPVATEQYGSVSCEMDLQRGNDR

SEQ ID NO: 28489 - protein, 28 aa, Artificial Sequence
  Description of Artificial Sequence: Synthetic peptide
DDNEIRTTNPVATEHYGEVSTNLQRGNF

SEQ ID NO: 28490 - protein, 28 aa, Artificial Sequence
  Description of Artificial Sequence: Synthetic peptide
SEEEIRTTNPVATEWWGSVSENLQRGNF

SEQ ID NO: 28491 - protein, 29 aa, Artificial Sequence
  Description of Artificial Sequence: Synthetic peptide
MENEIRTTNPVATEQYGSVSTNLQNGEDR

SEQ ID NO: 28492 - protein, 28 aa, Artificial Sequence
  Description of Artificial Sequence: Synthetic peptide
DEEEIATTNPVATECYGSVSTCEQRGNN

SEQ ID NO: 28493 - protein, 30 aa, Artificial Sequence
  Description of Artificial Sequence: Synthetic polypeptide
DEEEISTTNPVATEQYGSVSENLQERSGNS

SEQ ID NO: 28494 - protein, 28 aa, Artificial Sequence
  Description of Artificial Sequence: Synthetic peptide
DEEEIATTNPVATEQYGSVSTDLQVGEI

SEQ ID NO: 28495 - protein, 30 aa, Artificial Sequence
  Description of Artificial Sequence: Synthetic polypeptide
DENEIRTTNPVATEQYGVVDSTNGQQRGNR

SEQ ID NO: 28496 - protein, 28 aa, Artificial Sequence
  Description of Artificial Sequence: Synthetic peptide
DENEIRTTNPVATELWGSVSENLMRGNR

SEQ ID NO: 28497 - protein, 28 aa, Artificial Sequence
  Description of Artificial Sequence: Synthetic peptide
DEEEIRTTNPVASEIYGCVATNLERGNR

SEQ ID NO: 28498 - protein, 28 aa, Artificial Sequence
  Description of Artificial Sequence: Synthetic peptide
DEEEIRTTNPVATEQYGDVSEDLQYGNM

SEQ ID NO: 28499 - protein, 30 aa, Artificial Sequence
  Description of Artificial Sequence: Synthetic polypeptide
DEMEISPTNPVATEQYGSVSTNLQRNGNLR

SEQ ID NO: 28500 - protein, 30 aa, Artificial Sequence
  Description of Artificial Sequence: Synthetic polypeptide
DEEEIRTTNPVAYEQYGSVSIHNPDQRGNR

SEQ ID NO: 28501 - protein, 30 aa, Artificial Sequence
  Description of Artificial Sequence: Synthetic polypeptide
DEQEIRATNPVATEQYGSVSTNLQEDGNDR

SEQ ID NO: 28502 - protein, 28 aa, Artificial Sequence
  Description of Artificial Sequence: Synthetic peptide
DEEEIRTTNPVATEQYGSVSTNDDPGEA

SEQ ID NO: 28503 - protein, 28 aa, Artificial Sequence
  Description of Artificial Sequence: Synthetic peptide
SEEEIRTTNPVATEWYGIYSTNLQIGNR

SEQ ID NO: 28504 - protein, 28 aa, Artificial Sequence
  Description of Artificial Sequence: Synthetic peptide
DEHEIRTTNPVATEQYGDVSEELQRGNH

SEQ ID NO: 28505 - protein, 28 aa, Artificial Sequence
  Description of Artificial Sequence: Synthetic peptide
DENEIAQTNPVATEQYGSVSTNQERGNR

SEQ ID NO: 28506 - protein, 30 aa, Artificial Sequence
  Description of Artificial Sequence: Synthetic polypeptide
DEEEIRTTNPFATEQYGSVSTGALNRNGNR

SEQ ID NO: 28507 - protein, 28 aa, Artificial Sequence
  Description of Artificial Sequence: Synthetic peptide
DEEEIRTTNPVSTEVYGSVSTNPQHGNG

SEQ ID NO: 28508 - protein, 30 aa, Artificial Sequence
  Description of Artificial Sequence: Synthetic polypeptide
DEEEITTTNPVATEQYGSVSTGNPQIRGNF

SEQ ID NO: 28509 - protein, 28 aa, Artificial Sequence
  Description of Artificial Sequence: Synthetic peptide
DEQEIRTTNPVATEQYGSVSTEDERGNL

SEQ ID NO: 28510 - protein, 28 aa, Artificial Sequence
  Description of Artificial Sequence: Synthetic peptide
DEEEIRTTNPVATEMYGSVSTLLQQGDF

SEQ ID NO: 28511 - protein, 30 aa, Artificial Sequence
  Description of Artificial Sequence: Synthetic polypeptide
DEEEIRTTNPMATEQYGSVSTMLQERGNEA

SEQ ID NO: 28512 - protein, 28 aa, Artificial Sequence
  Description of Artificial Sequence: Synthetic peptide
DEQEIRTTNPVATEQYGSVSTNDEIGER

SEQ ID NO: 28513 - protein, 31 aa, Artificial Sequence
  Description of Artificial Sequence: Synthetic polypeptide
DEEEIRTTNPVATEQYGNVPSTNNLQLDGNR

SEQ ID NO: 28514 - protein, 28 aa, Artificial Sequence
  Description of Artificial Sequence: Synthetic peptide
DEEEIRTTNPVATECYGTMSENLQRGNH

SEQ ID NO: 28515 - protein, 29 aa, Artificial Sequence
  Description of Artificial Sequence: Synthetic peptide
DEQEIRTTNPVATEQYGDVSEELQRGNDR

SEQ ID NO: 28516 - protein, 28 aa, Artificial Sequence
  Description of Artificial Sequence: Synthetic peptide
DEEEIRCTNPVSTETYGVVATNLQRGNR

SEQ ID NO: 28517 - protein, 31 aa, Artificial Sequence
  Description of Artificial Sequence: Synthetic polypeptide
AEEEIRTTNPVATEQYGSVSTMNNLQDHGNR

SEQ ID NO: 28518 - protein, 30 aa, Artificial Sequence
  Description of Artificial Sequence: Synthetic polypeptide
DEEEIRTTNPVATEQYGSVSTMNEQDIGNF

SEQ ID NO: 28519 - protein, 30 aa, Artificial Sequence
  Description of Artificial Sequence: Synthetic polypeptide
DEEEIRTTNPVATECYGSVSATNLEREGER

SEQ ID NO: 28520 - protein, 30 aa, Artificial Sequence
  Description of Artificial Sequence: Synthetic polypeptide
DEEEIRTTNPVATETYGSVSTNLQQRKGDN

SEQ ID NO: 28521 - protein, 29 aa, Artificial Sequence
  Description of Artificial Sequence: Synthetic peptide
DEEEIATTNPVATECYGSVSTNLERGNDL

SEQ ID NO: 28522 - protein, 28 aa, Artificial Sequence
  Description of Artificial Sequence: Synthetic peptide
AEEEIAQTNPVATEQYGSVSTGLERGNR

SEQ ID NO: 28523 - protein, 28 aa, Artificial Sequence
  Description of Artificial Sequence: Synthetic peptide
DEEEIRTTNPVATEQYGSVSTNGLAGEA

SEQ ID NO: 28524 - protein, 29 aa, Artificial Sequence
  Description of Artificial Sequence: Synthetic peptide
DENEIRTTNPVATEQYGSVSTNLEDHGER

SEQ ID NO: 28525 - protein, 28 aa, Artificial Sequence
  Description of Artificial Sequence: Synthetic peptide
DEEEIRCTNPVATEQYGSVSANLQLGDQ

SEQ ID NO: 28526 - protein, 28 aa, Artificial Sequence
  Description of Artificial Sequence: Synthetic peptide
DEEEIRTTNPVATEQYGSVSTDLEYGEY

SEQ ID NO: 28527 - protein, 28 aa, Artificial Sequence
  Description of Artificial Sequence: Synthetic peptide
DEEEIRTTNPVATEQYGSVSTEDEIGNG

SEQ ID NO: 28528 - protein, 28 aa, Artificial Sequence
  Description of Artificial Sequence: Synthetic peptide
DEEEIRTVNPVATEQYGSMSEDLQNGNR

SEQ ID NO: 28529 - protein, 28 aa, Artificial Sequence
  Description of Artificial Sequence: Synthetic peptide
DENEIRTTNPVATEQWGSVSENEMRGNR

SEQ ID NO: 28530 - protein, 31 aa, Artificial Sequence
  Description of Artificial Sequence: Synthetic polypeptide
DEEEIRTTNPVATEQYGSVSTEPVQRKGDNR

SEQ ID NO: 28531 - protein, 28 aa, Artificial Sequence
  Description of Artificial Sequence: Synthetic peptide
DENEISSTNPVCTEQYGSVSTNLQRGTR

SEQ ID NO: 28532 - protein, 30 aa, Artificial Sequence
  Description of Artificial Sequence: Synthetic polypeptide
DEQEIRTTNPVATEQYGSVSETDPLQRENR

SEQ ID NO: 28533 - protein, 30 aa, Artificial Sequence
  Description of Artificial Sequence: Synthetic polypeptide
DEEEIRTTNPVATEQYGSVSTNLEDRGEDH

SEQ ID NO: 28534 - protein, 28 aa, Artificial Sequence
  Description of Artificial Sequence: Synthetic peptide
DEEEIRTVNPCATEQYGSVSDNLQRGTT

SEQ ID NO: 28535 - protein, 31 aa, Artificial Sequence
  Description of Artificial Sequence: Synthetic polypeptide
DEEEIRTTNPVATEQYGSVDTVNDQMRGVNR

SEQ ID NO: 28536 - protein, 29 aa, Artificial Sequence
  Description of Artificial Sequence: Synthetic peptide
DEEEIRTTNPVATENWGSVSTNLQSNGAR

SEQ ID NO: 28537 - protein, 28 aa, Artificial Sequence
  Description of Artificial Sequence: Synthetic peptide
DESEIRATNPVATENYGVVSNNLQRGNR

SEQ ID NO: 28538 - protein, 28 aa, Artificial Sequence
  Description of Artificial Sequence: Synthetic peptide
DEHEIRTTNPVATEHYGSCSTNLQHGNM

SEQ ID NO: 28539 - protein, 28 aa, Artificial Sequence
  Description of Artificial Sequence: Synthetic peptide
CEQEIRTTNPVATEGYGSISENLQRGNR

SEQ ID NO: 28540 - protein, 31 aa, Artificial Sequence
  Description of Artificial Sequence: Synthetic polypeptide
DEEEIRTTNPVATEQYGSVSTNPLDEREGND

SEQ ID NO: 28541 - protein, 28 aa, Artificial Sequence
  Description of Artificial Sequence: Synthetic peptide
DEVEIATTNPTATEQYGDVSTLLQRGNR

SEQ ID NO: 28542 - protein, 30 aa, Artificial Sequence
  Description of Artificial Sequence: Synthetic polypeptide
DEEEIATTNPVATEQYGSVSTNLQDVGEDR

SEQ ID NO: 28543 - protein, 29 aa, Artificial Sequence
  Description of Artificial Sequence: Synthetic peptide
MEEEIRTTNPVATECYGSVSTDLQENGNR

SEQ ID NO: 28544 - protein, 28 aa, Artificial Sequence
  Description of Artificial Sequence: Synthetic peptide
DEEEIRTTNPVATEIYGSVSTELERGEH

SEQ ID NO: 28545 - protein, 32 aa, Artificial Sequence
  Description of Artificial Sequence: Synthetic polypeptide
DEEEIRTTNPVATEQYGSVSVTPLVQRGDNPR

SEQ ID NO: 28546 - protein, 30 aa, Artificial Sequence
  Description of Artificial Sequence: Synthetic polypeptide
DEEEIRTTNPCATEQYGSVTSTNPLQYGND

SEQ ID NO: 28547 - protein, 29 aa, Artificial Sequence
  Description of Artificial Sequence: Synthetic peptide
DEEEIRTTNPVATEQYGSVSTNQLRNEER

SEQ ID NO: 28548 - protein, 28 aa, Artificial Sequence
  Description of Artificial Sequence: Synthetic peptide
SEEEIRTTNPAATEQYGCVSANLQRGTR

SEQ ID NO: 28549 - protein, 28 aa, Artificial Sequence
  Description of Artificial Sequence: Synthetic peptide
DEEEIATTNPVATEQYGAVSTNLISGNE

SEQ ID NO: 28550 - protein, 28 aa, Artificial Sequence
  Description of Artificial Sequence: Synthetic peptide
DEEEIRQTNPVATEQYGSASTGLEVGNR

SEQ ID NO: 28551 - protein, 28 aa, Artificial Sequence
  Description of Artificial Sequence: Synthetic peptide
DEEEIRTTNPVATEQYGSVGYNLMRGPI

SEQ ID NO: 28552 - protein, 28 aa, Artificial Sequence
  Description of Artificial Sequence: Synthetic peptide
DEVEISTTNPVATFQYGSVSTNLQQGNF

SEQ ID NO: 28553 - protein, 28 aa, Artificial Sequence
  Description of Artificial Sequence: Synthetic peptide
DEEEIATTNPTATEQYGSVSTNEQQGNQ

SEQ ID NO: 28554 - protein, 30 aa, Artificial Sequence
  Description of Artificial Sequence: Synthetic polypeptide
DEEEIRTTNPVATEQYGSVSTNEQEIGNTF

SEQ ID NO: 28555 - protein, 29 aa, Artificial Sequence
  Description of Artificial Sequence: Synthetic peptide
DEEEIRTTNPVATEMYGSVSTELQDIGNM

SEQ ID NO: 28556 - protein, 28 aa, Artificial Sequence
  Description of Artificial Sequence: Synthetic peptide
DEEEIRTTNPVATEQYGSVSTALIAGDF

SEQ ID NO: 28557 - protein, 28 aa, Artificial Sequence
  Description of Artificial Sequence: Synthetic peptide
DEEEIRTTNPVATEQYGSVSTDLEIGEF

SEQ ID NO: 28558 - protein, 28 aa, Artificial Sequence
  Description of Artificial Sequence: Synthetic peptide
DEEEIRTTNPVATEQYGSVSTEDEDGNN

SEQ ID NO: 28559 - protein, 28 aa, Artificial Sequence
  Description of Artificial Sequence: Synthetic peptide
DEEEIATTNPVATECYGSVSTNLQHGEN

SEQ ID NO: 28560 - protein, 28 aa, Artificial Sequence
  Description of Artificial Sequence: Synthetic peptide
DEEEIRTTNPVATEQYGSCSENLERGEG

SEQ ID NO: 28561 - protein, 31 aa, Artificial Sequence
  Description of Artificial Sequence: Synthetic polypeptide
DEEEIRTTNPVATEQYGSVSCTMDLQNGNDR

SEQ ID NO: 28562 - protein, 30 aa, Artificial Sequence
  Description of Artificial Sequence: Synthetic polypeptide
DEEEIRTTNPVATECYGSVSTDLQERKGNS

SEQ ID NO: 28563 - protein, 29 aa, Artificial Sequence
  Description of Artificial Sequence: Synthetic peptide
DEEEIAATNPVATEQYGGVSTNLPQQGNR

SEQ ID NO: 28564 - protein, 28 aa, Artificial Sequence
  Description of Artificial Sequence: Synthetic peptide
DEEHIRTTNPVATEQYGSVSTEDQIGNT

SEQ ID NO: 28565 - protein, 28 aa, Artificial Sequence
  Description of Artificial Sequence: Synthetic peptide
KEEEIRTTNPVCTEVYGSVSSNLQDGNR

SEQ ID NO: 28566 - protein, 29 aa, Artificial Sequence
  Description of Artificial Sequence: Synthetic peptide
DEEEIRTTNPVATEQYGSVETNLQVYGEP

SEQ ID NO: 28567 - protein, 30 aa, Artificial Sequence
  Description of Artificial Sequence: Synthetic polypeptide
DEEEIRTTNPVATEQYGSVDCTMNLQHGND

SEQ ID NO: 28568 - protein, 30 aa, Artificial Sequence
  Description of Artificial Sequence: Synthetic polypeptide
DEEEIRTTNPVATEQYGSVISENLQRGDTF

SEQ ID NO: 28569 - protein, 28 aa, Artificial Sequence
  Description of Artificial Sequence: Synthetic peptide
NENECRTTNPVATEQYGSVSTNLQMGNE

SEQ ID NO: 28570 - protein, 28 aa, Artificial Sequence
  Description of Artificial Sequence: Synthetic peptide
DEEEIRTTNPEATETYGEVSTNLQIGNQ

SEQ ID NO: 28571 - protein, 28 aa, Artificial Sequence
  Description of Artificial Sequence: Synthetic peptide
DEQEIRTTNPVSTEQYGSVSTNIEFGNR

SEQ ID NO: 28572 - protein, 28 aa, Artificial Sequence
  Description of Artificial Sequence: Synthetic peptide
DENEIATTNPVATEQYGSVSTNLQVGEL

SEQ ID NO: 28573 - protein, 30 aa, Artificial Sequence
  Description of Artificial Sequence: Synthetic polypeptide
DENEIRTTNPVATEQYGSSVSSENLTRGNR

SEQ ID NO: 28574 - protein, 28 aa, Artificial Sequence
  Description of Artificial Sequence: Synthetic peptide
DDTEITATNPVATEQYGSVSTNLQRGNH

SEQ ID NO: 28575 - protein, 31 aa, Artificial Sequence
  Description of Artificial Sequence: Synthetic polypeptide
DEEEIRTTNPVATENYGSVADTNLQREGVNR

SEQ ID NO: 28576 - protein, 29 aa, Artificial Sequence
  Description of Artificial Sequence: Synthetic peptide
DEEEIRCTNPIATEQYGSVSTNLQRGIDN

SEQ ID NO: 28577 - protein, 29 aa, Artificial Sequence
  Description of Artificial Sequence: Synthetic peptide
DEEEIRSTNPVATEQYGSVSTDLQSEGNS

SEQ ID NO: 28578 - protein, 28 aa, Artificial Sequence
  Description of Artificial Sequence: Synthetic peptide
SEEEIRTTNPIATEQYGSVSTNLQHELR

SEQ ID NO: 28579 - protein, 31 aa, Artificial Sequence
  Description of Artificial Sequence: Synthetic polypeptide
DEEEIRTTNPVATEQYGSASTGNLQIHGNDR

SEQ ID NO: 28580 - protein, 30 aa, Artificial Sequence
  Description of Artificial Sequence: Synthetic polypeptide
DEVEIRTTNPVATEQYGSVSTNEQLRGNSL

SEQ ID NO: 28581 - protein, 28 aa, Artificial Sequence
  Description of Artificial Sequence: Synthetic peptide
KEQEIRTTNPVATECYGSVSTNLQSGNS

SEQ ID NO: 28582 - protein, 29 aa, Artificial Sequence
  Description of Artificial Sequence: Synthetic peptide
DEEEIRTTNPVATEQYGGASTNLQEHGNA

SEQ ID NO: 28583 - protein, 28 aa, Artificial Sequence
  Description of Artificial Sequence: Synthetic peptide
DEEEIRATNPVATEQYGSVAMNLQGGDR

SEQ ID NO: 28584 - protein, 31 aa, Artificial Sequence
  Description of Artificial Sequence: Synthetic polypeptide
DEEEIRTTNPVATEQYGSVSTNLQEVEGNDT

SEQ ID NO: 28585 - protein, 28 aa, Artificial Sequence
  Description of Artificial Sequence: Synthetic peptide
DEEEIRTTNPVATEQYGSVSTDLEMGEI

SEQ ID NO: 28586 - protein, 30 aa, Artificial Sequence
  Description of Artificial Sequence: Synthetic polypeptide
DEEEIRTTNPVCYEQYGSVSTMNLQRGNDN

SEQ ID NO: 28587 - protein, 29 aa, Artificial Sequence
  Description of Artificial Sequence: Synthetic peptide
SEEEIRTTNPVATEQYGSVDTALQRGENT

SEQ ID NO: 28588 - protein, 30 aa, Artificial Sequence
  Description of Artificial Sequence: Synthetic polypeptide
MENEIRTTNPVATEQYGSVSTNLQNEGNDR

SEQ ID NO: 28589 - protein, 31 aa, Artificial Sequence
  Description of Artificial Sequence: Synthetic polypeptide
DEEEIRTTNPVATEQYGSVSETNLEDPGNDR

SEQ ID NO: 28590 - protein, 28 aa, Artificial Sequence
  Description of Artificial Sequence: Synthetic peptide
DEEEIATTNPVATEQYGSVSTNLQQETY

SEQ ID NO: 28591 - protein, 30 aa, Artificial Sequence
  Description of Artificial Sequence: Synthetic polypeptide
DEEEIRTTNPVATEQYGSVSTNPQENGNTF

SEQ ID NO: 28592 - protein, 28 aa, Artificial Sequence
  Description of Artificial Sequence: Synthetic peptide
DEAEIRTTNPVAWEQYGSVSTPLQRGLF

SEQ ID NO: 28593 - protein, 28 aa, Artificial Sequence
  Description of Artificial Sequence: Synthetic peptide
SEEEIRTTNPAATEMYGSVSTNWQTGNR

SEQ ID NO: 28594 - protein, 30 aa, Artificial Sequence
  Description of Artificial Sequence: Synthetic polypeptide
DEQEIATTNPVATEQYGSVSTNLQDHGNDR

SEQ ID NO: 28595 - protein, 30 aa, Artificial Sequence
  Description of Artificial Sequence: Synthetic polypeptide
DEQEIRTTNPVATEIYGAVSATNLQREGNR

SEQ ID NO: 28596 - protein, 30 aa, Artificial Sequence
  Description of Artificial Sequence: Synthetic polypeptide
DEEEIRTTNPVATECYGSVSTNLQTKGEDR

SEQ ID NO: 28597 - protein, 32 aa, Artificial Sequence
  Description of Artificial Sequence: Synthetic polypeptide
DEEEIRTTNPVATEQYGSVSATNLQDRGENDL

SEQ ID NO: 28598 - protein, 29 aa, Artificial Sequence
  Description of Artificial Sequence: Synthetic peptide
REHEIVTTNPVATEQYGSVSTNLQRGDDR

SEQ ID NO: 28599 - protein, 31 aa, Artificial Sequence
  Description of Artificial Sequence: Synthetic polypeptide
DEEEIRTTNPVATEQYGSVSTNLQEQEGNDF

SEQ ID NO: 28600 - protein, 28 aa, Artificial Sequence
  Description of Artificial Sequence: Synthetic peptide
KEEEIRTTNPCATEQYGSVGANLQRGNT

SEQ ID NO: 28601 - protein, 28 aa, Artificial Sequence
  Description of Artificial Sequence: Synthetic peptide
DENEIAATNPVATEQYGSVSTNLQDGNQ

SEQ ID NO: 28602 - protein, 28 aa, Artificial Sequence
  Description of Artificial Sequence: Synthetic peptide
MEEEIRTTNPVATEQYGSVSEDLQNGNA

SEQ ID NO: 28603 - protein, 29 aa, Artificial Sequence
  Description of Artificial Sequence: Synthetic peptide
DENEIRTVNPVATEQYGSVSTNLQENGND

SEQ ID NO: 28604 - protein, 30 aa, Artificial Sequence
  Description of Artificial Sequence: Synthetic polypeptide
DEEEIRTTNPVATEQYGSVETGNEQEKGNR

SEQ ID NO: 28605 - protein, 30 aa, Artificial Sequence
  Description of Artificial Sequence: Synthetic polypeptide
DEEEIRTTNPIATEQYGAVSAENLQRGNYR

SEQ ID NO: 28606 - protein, 28 aa, Artificial Sequence
  Description of Artificial Sequence: Synthetic peptide
DENEIRTTNPVATEQYGSVDTELQNGNT

SEQ ID NO: 28607 - protein, 31 aa, Artificial Sequence
  Description of Artificial Sequence: Synthetic polypeptide
DEEEIRTTNPVATEQYGSVSTTNLQDGENDF

SEQ ID NO: 28608 - protein, 29 aa, Artificial Sequence
  Description of Artificial Sequence: Synthetic peptide
SEEEIRTTNPVATEQFGSVSTNEPQRGTR

SEQ ID NO: 28609 - protein, 31 aa, Artificial Sequence
  Description of Artificial Sequence: Synthetic polypeptide
DEEEIRTTNPVATEQYGSVSTANEQDRGDNL

SEQ ID NO: 28610 - protein, 28 aa, Artificial Sequence
  Description of Artificial Sequence: Synthetic peptide
DEHEIRTTNPVATEQYGSASENEQRGNI

SEQ ID NO: 28611 - protein, 28 aa, Artificial Sequence
  Description of Artificial Sequence: Synthetic peptide
SEEMIRTTNPVATEQYGSVSHNDQPGNR

SEQ ID NO: 28612 - protein, 28 aa, Artificial Sequence
  Description of Artificial Sequence: Synthetic peptide
DEEEIRTTNPVSTEQYGSVSTDEQHGDR

SEQ ID NO: 28613 - protein, 29 aa, Artificial Sequence
  Description of Artificial Sequence: Synthetic peptide
SEEEIAATNPVATEQYGSVSTNLQDRGTR

SEQ ID NO: 28614 - protein, 31 aa, Artificial Sequence
  Description of Artificial Sequence: Synthetic polypeptide
DEVEIRTTNPVATEQYGSVSTGNLQERGNDI

SEQ ID NO: 28615 - protein, 30 aa, Artificial Sequence
  Description of Artificial Sequence: Synthetic polypeptide
DEEEIRTTNPVATEQYGSVSTDLQRNGEEI

SEQ ID NO: 28616 - protein, 28 aa, Artificial Sequence
  Description of Artificial Sequence: Synthetic peptide
DEEEIRTTNPVATEQYGSVSTDLEHGEF

SEQ ID NO: 28617 - protein, 30 aa, Artificial Sequence
  Description of Artificial Sequence: Synthetic polypeptide
DEEEIRTTNPVATECYGSVSTNLQEAGNDF

SEQ ID NO: 28618 - protein, 28 aa, Artificial Sequence
  Description of Artificial Sequence: Synthetic peptide
DEEEIRTTNPVATELYGSVSTNLMLGDM

SEQ ID NO: 28619 - protein, 31 aa, Artificial Sequence
  Description of Artificial Sequence: Synthetic polypeptide
DEEEIRTTNPVATEMYGSVSENLPQRGDNTR

SEQ ID NO: 28620 - protein, 28 aa, Artificial Sequence
  Description of Artificial Sequence: Synthetic peptide
DEQEIVATNPVATEVYGWVSTNLQRGNR

SEQ ID NO: 28621 - protein, 28 aa, Artificial Sequence
  Description of Artificial Sequence: Synthetic peptide
DEEEIRTTNPVATEIYGVVSTDLERGNL

SEQ ID NO: 28622 - protein, 31 aa, Artificial Sequence
  Description of Artificial Sequence: Synthetic polypeptide
DEEEIRTTNPVATEQYGSVSITMNLQAGENV

SEQ ID NO: 28623 - protein, 31 aa, Artificial Sequence
  Description of Artificial Sequence: Synthetic polypeptide
DEEEIRTTNPVATEQYGSVSTNLQVSGENKM

SEQ ID NO: 28624 - protein, 29 aa, Artificial Sequence
  Description of Artificial Sequence: Synthetic peptide
MEEEIRTTNPVATEQYGSVSTDLQEHGNW

SEQ ID NO: 28625 - protein, 30 aa, Artificial Sequence
  Description of Artificial Sequence: Synthetic polypeptide
DEEEIRTTNPVATEQYGSVSTEPLQELGNF

SEQ ID NO: 28626 - protein, 30 aa, Artificial Sequence
  Description of Artificial Sequence: Synthetic polypeptide
DENEIRQTNPVATEQYGSVSTNLQEVGNDR

SEQ ID NO: 28627 - protein, 29 aa, Artificial Sequence
  Description of Artificial Sequence: Synthetic peptide
DEEEIRTTNPVATEMYGSVSTNLQDIGDM

SEQ ID NO: 28628 - protein, 28 aa, Artificial Sequence
  Description of Artificial Sequence: Synthetic peptide
DEEEIRTTNPVATEQYGIVPTELQYGNL

SEQ ID NO: 28629 - protein, 28 aa, Artificial Sequence
  Description of Artificial Sequence: Synthetic peptide
DEEEIATTNPVATEIYGSVSTNLQYGET

SEQ ID NO: 28630 - protein, 30 aa, Artificial Sequence
  Description of Artificial Sequence: Synthetic polypeptide
DEEEIRTTNPVATEQYGGVSTGNLPQQGDR

SEQ ID NO: 28631 - protein, 30 aa, Artificial Sequence
  Description of Artificial Sequence: Synthetic polypeptide
DEEEIRTTNPVATEQYGSVSTNLPQINENM

SEQ ID NO: 28632 - protein, 28 aa, Artificial Sequence
  Description of Artificial Sequence: Synthetic peptide
DENEIRATNPVATEQYGSVSYNLQRDNA

SEQ ID NO: 28633 - protein, 29 aa, Artificial Sequence
  Description of Artificial Sequence: Synthetic peptide
QEEEIRTTNPVATECYGSVPTALQRGDNR

SEQ ID NO: 28634 - protein, 28 aa, Artificial Sequence
  Description of Artificial Sequence: Synthetic peptide
DEEEIRTTNPVATEQWGSVSENLMRENA

SEQ ID NO: 28635 - protein, 28 aa, Artificial Sequence
  Description of Artificial Sequence: Synthetic peptide
DEEEIRSTNPVATEMYGCVSTNLQSGER

SEQ ID NO: 28636 - protein, 30 aa, Artificial Sequence
  Description of Artificial Sequence: Synthetic polypeptide
DEEEIRTTNPVATEQYGSVSVNGLQVGNWS

SEQ ID NO: 28637 - protein, 28 aa, Artificial Sequence
  Description of Artificial Sequence: Synthetic peptide
NDEEIRTTNPVATEIYGVVSTNLQRLNR

SEQ ID NO: 28638 - protein, 28 aa, Artificial Sequence
  Description of Artificial Sequence: Synthetic peptide
DEEEIRCTNPVATEQYGAVDTNWERGNR

SEQ ID NO: 28639 - protein, 28 aa, Artificial Sequence
  Description of Artificial Sequence: Synthetic peptide
DEEEIRTTNPVATEQYGSVSTTVLIGNH

SEQ ID NO: 28640 - protein, 28 aa, Artificial Sequence
  Description of Artificial Sequence: Synthetic peptide
DEEEIRTTNPVCTEQYGVVSENEQAGNR

SEQ ID NO: 28641 - protein, 28 aa, Artificial Sequence
  Description of Artificial Sequence: Synthetic peptide
SEQEIRATNPVATEQYGSVSTNLQNGNM

SEQ ID NO: 28642 - protein, 29 aa, Artificial Sequence
  Description of Artificial Sequence: Synthetic peptide
DEEEIRTTNPVATEQYGTVSAEVLQRGGR

SEQ ID NO: 28643 - protein, 29 aa, Artificial Sequence
  Description of Artificial Sequence: Synthetic peptide
DEQEIATTNPVATEQYGDVSAENLQRGNR

SEQ ID NO: 28644 - protein, 28 aa, Artificial Sequence
  Description of Artificial Sequence: Synthetic peptide
SEQEIRTTNPVATEQYGSVATNDQWGNR

SEQ ID NO: 28645 - protein, 31 aa, Artificial Sequence
  Description of Artificial Sequence: Synthetic polypeptide
DEEEIRTTNPVATEQYGSVSTNGLQDQGVNG

SEQ ID NO: 28646 - protein, 28 aa, Artificial Sequence
  Description of Artificial Sequence: Synthetic peptide
QEEEIRTTNPVATECYGSVSTELERGNS

SEQ ID NO: 28647 - protein, 28 aa, Artificial Sequence
  Description of Artificial Sequence: Synthetic peptide
QEEEIWTTNPVATEQYGSVSENPQRGNF

SEQ ID NO: 28648 - protein, 28 aa, Artificial Sequence
  Description of Artificial Sequence: Synthetic peptide
NEQEIRTTNPVATEQYGDVSCNLQRGNS

SEQ ID NO: 28649 - protein, 29 aa, Artificial Sequence
  Description of Artificial Sequence: Synthetic peptide
DEEEIRTTNPVATEQYGSVSTNLMWQGTA

SEQ ID NO: 28650 - protein, 31 aa, Artificial Sequence
  Description of Artificial Sequence: Synthetic polypeptide
DEEEITTTNPVATEQYGSVSTDNLQPFGENR

SEQ ID NO: 28651 - protein, 28 aa, Artificial Sequence
  Description of Artificial Sequence: Synthetic peptide
DEEEIRTTNPVATEQWGSVSRNLEIGER

SEQ ID NO: 28652 - protein, 28 aa, Artificial Sequence
  Description of Artificial Sequence: Synthetic peptide
SEEEIRTTNPTATEQFGSVSTNLQNGTR

SEQ ID NO: 28653 - protein, 28 aa, Artificial Sequence
  Description of Artificial Sequence: Synthetic peptide
DEEEIRATNPVATEQFGSVSTNLQQGTS

SEQ ID NO: 28654 - protein, 30 aa, Artificial Sequence
  Description of Artificial Sequence: Synthetic polypeptide
DEEEVRTTNPVATEQYGAVSANNLQREGNR

SEQ ID NO: 28655 - protein, 28 aa, Artificial Sequence
  Description of Artificial Sequence: Synthetic peptide
DEVEIRTTNPTATEQYGSVSTNEQQGNF

SEQ ID NO: 28656 - protein, 28 aa, Artificial Sequence
  Description of Artificial Sequence: Synthetic peptide
DEAEIATTNPVATEMYGSVSCNLQRGNY

SEQ ID NO: 28657 - protein, 29 aa, Artificial Sequence
  Description of Artificial Sequence: Synthetic peptide
DEEEIRTTNPVATEQYGSVDSTNLQGEDN

SEQ ID NO: 28658 - protein, 28 aa, Artificial Sequence
  Description of Artificial Sequence: Synthetic peptide
DEEEIRTTNPVATEQYGSVSDNEEHGND

SEQ ID NO: 28659 - protein, 28 aa, Artificial Sequence
  Description of Artificial Sequence: Synthetic peptide
DSEEIRTTNPVGTEQWGMVSTNLQRGVR

SEQ ID NO: 28660 - protein, 28 aa, Artificial Sequence
  Description of Artificial Sequence: Synthetic peptide
DEDEIRSTNPVASEQYGSVSTNLQVGNV

SEQ ID NO: 28661 - protein, 28 aa, Artificial Sequence
  Description of Artificial Sequence: Synthetic peptide
DEQEIRTTNPVATEWWGSVSENLQRGNM

SEQ ID NO: 28662 - protein, 28 aa, Artificial Sequence
  Description of Artificial Sequence: Synthetic peptide
DEEEIASTNPVATEMYGEVSTNLQRGGR

SEQ ID NO: 28663 - protein, 29 aa, Artificial Sequence
  Description of Artificial Sequence: Synthetic peptide
DEDEIRTTNPVATEQYGSASTNLQNDGNN

SEQ ID NO: 28664 - protein, 28 aa, Artificial Sequence
  Description of Artificial Sequence: Synthetic peptide
DEEEIRATNPVSTEHYGVVGTNLQRGNR

SEQ ID NO: 28665 - protein, 28 aa, Artificial Sequence
  Description of Artificial Sequence: Synthetic peptide
DEEEVRTTNPIAYEMYGSVSTNLQRGPR

SEQ ID NO: 28666 - protein, 30 aa, Artificial Sequence
  Description of Artificial Sequence: Synthetic polypeptide
GEEEIRTTNPVATECYGVVSTNLQRGENDR

SEQ ID NO: 28667 - protein, 30 aa, Artificial Sequence
  Description of Artificial Sequence: Synthetic polypeptide
DEEEIRTTNPVATEQYGSVSLTALEVGGNR

SEQ ID NO: 28668 - protein, 30 aa, Artificial Sequence
  Description of Artificial Sequence: Synthetic polypeptide
DEEEIRTTNPVATEQYGSVSTEPLQVEGNW

SEQ ID NO: 28669 - protein, 31 aa, Artificial Sequence
  Description of Artificial Sequence: Synthetic polypeptide
DEEEIRTTNPVATEQYGSVSCTDLQCRGNDQ

SEQ ID NO: 28670 - protein, 28 aa, Artificial Sequence
  Description of Artificial Sequence: Synthetic peptide
DEEEIRTTNPVATEQYGSVETNLDQGDW

SEQ ID NO: 28671 - protein, 28 aa, Artificial Sequence
  Description of Artificial Sequence: Synthetic peptide
DEEEIRTTNPVATELWGSVSTNLMIGNS

SEQ ID NO: 28672 - protein, 28 aa, Artificial Sequence
  Description of Artificial Sequence: Synthetic peptide
SEEEIRTTNPVAYELFGSVSTNEQRGNR

SEQ ID NO: 28673 - protein, 28 aa, Artificial Sequence
  Description of Artificial Sequence: Synthetic peptide
DEELIRTTNPVATEQYGSVSTNLIQGTS

SEQ ID NO: 28674 - protein, 28 aa, Artificial Sequence
  Description of Artificial Sequence: Synthetic peptide
DEEEIRTTNPVATEQYGSVSTDDERGEM

SEQ ID NO: 28675 - protein, 28 aa, Artificial Sequence
  Description of Artificial Sequence: Synthetic peptide
SEEEIRTTNPVATELYGSVSDNLQRLTR

SEQ ID NO: 28676 - protein, 31 aa, Artificial Sequence
  Description of Artificial Sequence: Synthetic polypeptide
DEEEIRTTNPVATEQYGSVSTLNPDQDRGER

SEQ ID NO: 28677 - protein, 30 aa, Artificial Sequence
  Description of Artificial Sequence: Synthetic polypeptide
SEEEIRTTNPVATEQYGSVTATNLIRGDNR

SEQ ID NO: 28678 - protein, 28 aa, Artificial Sequence
  Description of Artificial Sequence: Synthetic peptide
DEEEIRTTNPEATEQFGSVSTNLQSGLF

SEQ ID NO: 28679 - protein, 30 aa, Artificial Sequence
  Description of Artificial Sequence: Synthetic polypeptide
DEVEIRTTNPVATEQYGEVSTNGLQNGENR

SEQ ID NO: 28680 - protein, 28 aa, Artificial Sequence
  Description of Artificial Sequence: Synthetic peptide
DEEEIRTTNPTATEQFGSVSTNWQQGNN

SEQ ID NO: 28681 - protein, 28 aa, Artificial Sequence
  Description of Artificial Sequence: Synthetic peptide
DEEEIRTTNPCATEQYGSVSTAEQWGNE

SEQ ID NO: 28682 - protein, 28 aa, Artificial Sequence
  Description of Artificial Sequence: Synthetic peptide
DEIEIASTNPVATEQYGSVSTNGQRGNL

SEQ ID NO: 28683 - protein, 31 aa, Artificial Sequence
  Description of Artificial Sequence: Synthetic polypeptide
DEEEIRTTNPVATEQYGVVSTDNLVQVGNDR

SEQ ID NO: 28684 - protein, 28 aa, Artificial Sequence
  Description of Artificial Sequence: Synthetic peptide
DEEEIVTTNPVATEHYGSVSENLQRGQQ

SEQ ID NO: 28685 - protein, 28 aa, Artificial Sequence
  Description of Artificial Sequence: Synthetic peptide
DEEEIRTTNPVATDQYGSVSENVQHMNR

SEQ ID NO: 28686 - protein, 28 aa, Artificial Sequence
  Description of Artificial Sequence: Synthetic peptide
MEQEIRTTNPVATEQYGVVSTNLQNGNH

SEQ ID NO: 28687 - protein, 28 aa, Artificial Sequence
  Description of Artificial Sequence: Synthetic peptide
DEEEIRTTNPVATEWWGSVSTNLMRGTM

SEQ ID NO: 28688 - protein, 28 aa, Artificial Sequence
  Description of Artificial Sequence: Synthetic peptide
DEEEIATTNPVSTEQYGWVSTNEQRGNV

SEQ ID NO: 28689 - protein, 30 aa, Artificial Sequence
  Description of Artificial Sequence: Synthetic polypeptide
DEEEIRTTNPVCTEVYGSVSTMDLQRAGNR

SEQ ID NO: 28690 - protein, 28 aa, Artificial Sequence
  Description of Artificial Sequence: Synthetic peptide
DEQEIVCTNPVATEVYGVVSTNLQRGNR

SEQ ID NO: 28691 - protein, 28 aa, Artificial Sequence
  Description of Artificial Sequence: Synthetic peptide
FEEEIRTTNPVATEQYGDVSTCLQSGKR

SEQ ID NO: 28692 - protein, 30 aa, Artificial Sequence
  Description of Artificial Sequence: Synthetic polypeptide
NEEEIRTTNPCATEVYGSVSTMNLQRGNDR

SEQ ID NO: 28693 - protein, 28 aa, Artificial Sequence
  Description of Artificial Sequence: Synthetic peptide
DEEEIRTTNPTATEMYGCVSTNDQRGPR

SEQ ID NO: 28694 - protein, 30 aa, Artificial Sequence
  Description of Artificial Sequence: Synthetic polypeptide
DEEEIRSTNPVATEQYGSVCSENLVQNGNR

SEQ ID NO: 28695 - protein, 28 aa, Artificial Sequence
  Description of Artificial Sequence: Synthetic peptide
QEQEIATTNPVATEQYGDVSDNLQRGNR

SEQ ID NO: 28696 - protein, 28 aa, Artificial Sequence
  Description of Artificial Sequence: Synthetic peptide
VEEEIRSTNPVATEQYGSVAMNLQRGNQ

SEQ ID NO: 28697 - protein, 32 aa, Artificial Sequence
  Description of Artificial Sequence: Synthetic polypeptide
DEEEIRTTNPVATEQYGSVTSETNNLTQRGER

SEQ ID NO: 28698 - protein, 30 aa, Artificial Sequence
  Description of Artificial Sequence: Synthetic polypeptide
DEEEIRTTNPVATEQYGEVISTNLQENGNQ

SEQ ID NO: 28699 - protein, 28 aa, Artificial Sequence
  Description of Artificial Sequence: Synthetic peptide
DEEEIRTTNPVASEGYGSVATNLQWGNL

SEQ ID NO: 28700 - protein, 28 aa, Artificial Sequence
  Description of Artificial Sequence: Synthetic peptide
DEEEIRTTNPVATEIYGVVSTDLQDGND

SEQ ID NO: 28701 - protein, 29 aa, Artificial Sequence
  Description of Artificial Sequence: Synthetic peptide
DENEIRTTNPVATEQWGSVSTNEQNRGNW

SEQ ID NO: 28702 - protein, 28 aa, Artificial Sequence
  Description of Artificial Sequence: Synthetic peptide
KEEEIRTTNPVATECYGSCSENLQNGNR

SEQ ID NO: 28703 - protein, 28 aa, Artificial Sequence
  Description of Artificial Sequence: Synthetic peptide
SEEEIRTTNPTATEQYGTVSTDDQRGNR

SEQ ID NO: 28704 - protein, 28 aa, Artificial Sequence
  Description of Artificial Sequence: Synthetic peptide
DEEEIRTTNPVATECYGDVSTLLQHENR

SEQ ID NO: 28705 - protein, 28 aa, Artificial Sequence
  Description of Artificial Sequence: Synthetic peptide
DEGEISTTNPVATEVYGSASENLQRGNR

SEQ ID NO: 28706 - protein, 29 aa, Artificial Sequence
  Description of Artificial Sequence: Synthetic peptide
DEEEIRTTNPVATEQYGDVSEANLQHGNI

SEQ ID NO: 28707 - protein, 28 aa, Artificial Sequence
  Description of Artificial Sequence: Synthetic peptide
DEQEIACTNPVATEVYGVVSTNLQRGNR

SEQ ID NO: 28708 - protein, 28 aa, Artificial Sequence
  Description of Artificial Sequence: Synthetic peptide
SEEEIRTTNPVATEQYGEVSTNEQRGTI

SEQ ID NO: 28709 - protein, 30 aa, Artificial Sequence
  Description of Artificial Sequence: Synthetic polypeptide
DEDEIRTTNPAATEQYGSVSTGNLPQLGNR

SEQ ID NO: 28710 - protein, 28 aa, Artificial Sequence
  Description of Artificial Sequence: Synthetic peptide
DEEEIRTTNPVATEQYGTMSTDLQNGNY

SEQ ID NO: 28711 - protein, 28 aa, Artificial Sequence
  Description of Artificial Sequence: Synthetic peptide
DEVEIRTTNPVATEIYGSVSTNEQRGDF

SEQ ID NO: 28712 - protein, 30 aa, Artificial Sequence
  Description of Artificial Sequence: Synthetic polypeptide
DEEEIRTTNPVATECYGSVSTDLEERGNDR

SEQ ID NO: 28713 - protein, 28 aa, Artificial Sequence
  Description of Artificial Sequence: Synthetic peptide
DEEEIRTTNPVATEQYGNVSTNLNMGEI

SEQ ID NO: 28714 - protein, 30 aa, Artificial Sequence
  Description of Artificial Sequence: Synthetic polypeptide
DEEEIRTTNPVATEQYGESVSTNLQEIEER

SEQ ID NO: 28715 - protein, 28 aa, Artificial Sequence
  Description of Artificial Sequence: Synthetic peptide
DECEIRGTNPVATEGYGVVSMNLQRGNR

SEQ ID NO: 28716 - protein, 29 aa, Artificial Sequence
  Description of Artificial Sequence: Synthetic peptide
DEEEIRTTNPVATEQYGSVDTNEQLVGNA

SEQ ID NO: 28717 - protein, 31 aa, Artificial Sequence
  Description of Artificial Sequence: Synthetic polypeptide
DEEEIRTTNPVATEQYGSVSDTNQVQRGNDF

SEQ ID NO: 28718 - protein, 28 aa, Artificial Sequence
  Description of Artificial Sequence: Synthetic peptide
QEEEIGTTNPVATEQFGSVSTNLQAGTR

SEQ ID NO: 28719 - protein, 29 aa, Artificial Sequence
  Description of Artificial Sequence: Synthetic peptide
DENEIRTTNPVATEQWGSVSTNEQMQGNR

SEQ ID NO: 28720 - protein, 32 aa, Artificial Sequence
  Description of Artificial Sequence: Synthetic polypeptide
DEEEIRTTNPVATEQYGSVDCTMNLQRGENDR

SEQ ID NO: 28721 - protein, 28 aa, Artificial Sequence
  Description of Artificial Sequence: Synthetic peptide
SEEEIRTTNPVSTECYGSVSNNDQRGNR

SEQ ID NO: 28722 - protein, 30 aa, Artificial Sequence
  Description of Artificial Sequence: Synthetic polypeptide
DEEEIRTTNPVATECYGSVSENLQENGNDR

SEQ ID NO: 28723 - protein, 28 aa, Artificial Sequence
  Description of Artificial Sequence: Synthetic peptide
DEEEIVTTNPVATEQYGSVSMDLQQGNY

SEQ ID NO: 28724 - protein, 32 aa, Artificial Sequence
  Description of Artificial Sequence: Synthetic polypeptide
DEEEIRTTNPVATEQYGSVSETLNGLPQRGER

SEQ ID NO: 28725 - protein, 28 aa, Artificial Sequence
  Description of Artificial Sequence: Synthetic peptide
KEEEIRTTNPVATEQYGSVSTGLEEGNM

SEQ ID NO: 28726 - protein, 28 aa, Artificial Sequence
  Description of Artificial Sequence: Synthetic peptide
DEQEIRTTNPVATECYGSVSTNLEHGER

SEQ ID NO: 28727 - protein, 29 aa, Artificial Sequence
  Description of Artificial Sequence: Synthetic peptide
HEEEIRTTNPVATEIYGSVSTANLQHGNF

SEQ ID NO: 28728 - protein, 29 aa, Artificial Sequence
  Description of Artificial Sequence: Synthetic peptide
DENEIRTTNPVATEMYGSVSTGGLQVGNR

SEQ ID NO: 28729 - protein, 30 aa, Artificial Sequence
  Description of Artificial Sequence: Synthetic polypeptide
DEEEIRTTNPVATEQYGSVDTMNDQQRGNF

SEQ ID NO: 28730 - protein, 28 aa, Artificial Sequence
  Description of Artificial Sequence: Synthetic peptide
DEEEIRTTNPVATEQFGSVSTDLQSGLL

SEQ ID NO: 28731 - protein, 28 aa, Artificial Sequence
  Description of Artificial Sequence: Synthetic peptide
DEEEIRATNPTSTEQYGSVSTNLQSGNA

SEQ ID NO: 28732 - protein, 28 aa, Artificial Sequence
  Description of Artificial Sequence: Synthetic peptide
DEEEIRCTNPVATEVWGSVSTNLQQGTR

SEQ ID NO: 28733 - protein, 28 aa, Artificial Sequence
  Description of Artificial Sequence: Synthetic peptide
DEEELRTTNPVATEQYGSVATNLNRFNS

SEQ ID NO: 28734 - protein, 28 aa, Artificial Sequence
  Description of Artificial Sequence: Synthetic peptide
DENEIRTTNPVATEQWGSVSENLMRGNA

SEQ ID NO: 28735 - protein, 31 aa, Artificial Sequence
  Description of Artificial Sequence: Synthetic polypeptide
DEQEIRTTNPVATEQYGSVSCTMDLQQRGNR

SEQ ID NO: 28736 - protein, 30 aa, Artificial Sequence
  Description of Artificial Sequence: Synthetic polypeptide
DEEEIRTTNPVATECYGVVSTNLQVEGENR

SEQ ID NO: 28737 - protein, 29 aa, Artificial Sequence
  Description of Artificial Sequence: Synthetic peptide
DEEEIRTTNPFATEQYGSVSTNLTQFGDP

SEQ ID NO: 28738 - protein, 32 aa, Artificial Sequence
  Description of Artificial Sequence: Synthetic polypeptide
DEEEIRTTNPVATEQYGSVSETNLEDREGNER

SEQ ID NO: 28739 - protein, 28 aa, Artificial Sequence
  Description of Artificial Sequence: Synthetic peptide
DENEIRTTNPVATEQWGNVSTNEQRGNA

SEQ ID NO: 28740 - protein, 29 aa, Artificial Sequence
  Description of Artificial Sequence: Synthetic peptide
DPEEIRTTNPVATEQYGSVSTNLQIDGEP

SEQ ID NO: 28741 - protein, 30 aa, Artificial Sequence
  Description of Artificial Sequence: Synthetic polypeptide
DEEEIRTTNPVATELYGSVSTNLQQNGNDF

SEQ ID NO: 28742 - protein, 28 aa, Artificial Sequence
  Description of Artificial Sequence: Synthetic peptide
DEEEITTTNPVATEQYGSVSTNPQEGEW

SEQ ID NO: 28743 - protein, 28 aa, Artificial Sequence
  Description of Artificial Sequence: Synthetic peptide
DEEEIRTTNPVATEIFGSVSANVQRGNH

SEQ ID NO: 28744 - protein, 28 aa, Artificial Sequence
  Description of Artificial Sequence: Synthetic peptide
SEEEIRTTNPTATEQFGGVSTNLQRGTR

SEQ ID NO: 28745 - protein, 28 aa, Artificial Sequence
  Description of Artificial Sequence: Synthetic peptide
DEEEIRTTNPVATEQYGSVSTNDDADNW

SEQ ID NO: 28746 - protein, 28 aa, Artificial Sequence
  Description of Artificial Sequence: Synthetic peptide
KEEEIATTNPVATEMYGIVSTNLQRGER

SEQ ID NO: 28747 - protein, 28 aa, Artificial Sequence
  Description of Artificial Sequence: Synthetic peptide
DEEEIRTTNPVASECYGWTSTNLQRGNV

SEQ ID NO: 28748 - protein, 28 aa, Artificial Sequence
  Description of Artificial Sequence: Synthetic peptide
SEEEIRTTNPVSTEQYGIVSTNLQTGNI

SEQ ID NO: 28749 - protein, 28 aa, Artificial Sequence
  Description of Artificial Sequence: Synthetic peptide
DEGEIRTTNPVGTEQYGSVGTNLMRMNR

SEQ ID NO: 28750 - protein, 28 aa, Artificial Sequence
  Description of Artificial Sequence: Synthetic peptide
MEEEIRTTNPVATECYGSCATNLQRGGR

SEQ ID NO: 28751 - protein, 28 aa, Artificial Sequence
  Description of Artificial Sequence: Synthetic peptide
SEEEIRTTNPTATEQFGSVSTNWQRGNF

SEQ ID NO: 28752 - protein, 31 aa, Artificial Sequence
  Description of Artificial Sequence: Synthetic polypeptide
DEEEIRTTNPVATEQYGVVDDTTNGLQRGNR

SEQ ID NO: 28753 - protein, 28 aa, Artificial Sequence
  Description of Artificial Sequence: Synthetic peptide
DENEIVTTNPVATECYGSVSTDLQRGNT

SEQ ID NO: 28754 - protein, 29 aa, Artificial Sequence
  Description of Artificial Sequence: Synthetic peptide
DEQEIRTTNPVATEWYGSVSENLQNQGNR

SEQ ID NO: 28755 - protein, 28 aa, Artificial Sequence
  Description of Artificial Sequence: Synthetic peptide
DEAEIRTTNPVATEQYGSTSDNIQRGNE

SEQ ID NO: 28756 - protein, 28 aa, Artificial Sequence
  Description of Artificial Sequence: Synthetic peptide
DEQEIATTNPVSTEVYGVVSTNLQRGNR

SEQ ID NO: 28757 - protein, 30 aa, Artificial Sequence
  Description of Artificial Sequence: Synthetic polypeptide
DEQEIRTTNPVATEQYGSVSTNDQREGNDF

SEQ ID NO: 28758 - protein, 28 aa, Artificial Sequence
  Description of Artificial Sequence: Synthetic peptide
DEGEIRSTNPVATEQYGSVSENLQRGTA

SEQ ID NO: 28759 - protein, 28 aa, Artificial Sequence
  Description of Artificial Sequence: Synthetic peptide
DEEEIRTTNPVATECWGIVSTNLQLGNF

SEQ ID NO: 28760 - protein, 28 aa, Artificial Sequence
  Description of Artificial Sequence: Synthetic peptide
DEQEIATTNPVATEQYGEVSTNLQLGNL

SEQ ID NO: 28761 - protein, 30 aa, Artificial Sequence
  Description of Artificial Sequence: Synthetic polypeptide
DEEEIRTTNPVATEVYGSASTNLQQQYGNR

SEQ ID NO: 28762 - protein, 28 aa, Artificial Sequence
  Description of Artificial Sequence: Synthetic peptide
DDEEIATTNPVATEMYGSVSTNLMRGNS

SEQ ID NO: 28763 - protein, 28 aa, Artificial Sequence
  Description of Artificial Sequence: Synthetic peptide
DESEIRTVNPVATEQYGDVSTNVQRGPR

SEQ ID NO: 28764 - protein, 28 aa, Artificial Sequence
  Description of Artificial Sequence: Synthetic peptide
SEEEIRTTNPVATEQYGCVSTDLQVGPR

SEQ ID NO: 28765 - protein, 28 aa, Artificial Sequence
  Description of Artificial Sequence: Synthetic peptide
AEHEISTTNPVATEQYGEVSENLQRGNR

SEQ ID NO: 28766 - protein, 28 aa, Artificial Sequence
  Description of Artificial Sequence: Synthetic peptide
DENEIATTNPVATEQYGSVSTELQHGER

SEQ ID NO: 28767 - protein, 28 aa, Artificial Sequence
  Description of Artificial Sequence: Synthetic peptide
DEQEIVCTNPVATEVYGWVSTNLQRGNR

SEQ ID NO: 28768 - protein, 30 aa, Artificial Sequence
  Description of Artificial Sequence: Synthetic polypeptide
MEEEIRTTNPVATEQYGSVSTNLQDTGNDS

SEQ ID NO: 28769 - protein, 28 aa, Artificial Sequence
  Description of Artificial Sequence: Synthetic peptide
DEEEIRTTNPVATEQYGSVGEELQGGNE

SEQ ID NO: 28770 - protein, 28 aa, Artificial Sequence
  Description of Artificial Sequence: Synthetic peptide
DEEEIRTTNPVATECYGDASTNLQHGER

SEQ ID NO: 28771 - protein, 31 aa, Artificial Sequence
  Description of Artificial Sequence: Synthetic polypeptide
AEEEIRTTNPVATEQYGSVSCTNLQCHGNDR

SEQ ID NO: 28772 - protein, 30 aa, Artificial Sequence
  Description of Artificial Sequence: Synthetic polypeptide
DEEEIRTTNPVASEQYGSVAATNLERNGNR

SEQ ID NO: 28773 - protein, 28 aa, Artificial Sequence
  Description of Artificial Sequence: Synthetic peptide
DEEEIRTTNPVATEQYGSASTDLQHGDQ

SEQ ID NO: 28774 - protein, 29 aa, Artificial Sequence
  Description of Artificial Sequence: Synthetic peptide
AEEEIVTTNPVATEQYGDVSTNLQRTGNY

SEQ ID NO: 28775 - protein, 29 aa, Artificial Sequence
  Description of Artificial Sequence: Synthetic peptide
DEEEIRTTNPEATEGYGSVSTNPLQSGNH

SEQ ID NO: 28776 - protein, 28 aa, Artificial Sequence
  Description of Artificial Sequence: Synthetic peptide
DEEEIRTTNPVATECWGSVSTNEQTGNF

SEQ ID NO: 28777 - protein, 28 aa, Artificial Sequence
  Description of Artificial Sequence: Synthetic peptide
KEEEIATTNPVATEQYGWVSEELQRGNR

SEQ ID NO: 28778 - protein, 29 aa, Artificial Sequence
  Description of Artificial Sequence: Synthetic peptide
DENEIRTTNPVATEQYGSVSTELQYKGNV

SEQ ID NO: 28779 - protein, 30 aa, Artificial Sequence
  Description of Artificial Sequence: Synthetic polypeptide
DEEEIRTTNPVATECYGSVSTENLEVQGNR

SEQ ID NO: 28780 - protein, 28 aa, Artificial Sequence
  Description of Artificial Sequence: Synthetic peptide
QEEEIATTNPVATEQYGIVSTNLQSGTR

SEQ ID NO: 28781 - protein, 28 aa, Artificial Sequence
  Description of Artificial Sequence: Synthetic peptide
SEEEIRTTNPAATEQYGSVSTNLQLGDT

SEQ ID NO: 28782 - protein, 28 aa, Artificial Sequence
  Description of Artificial Sequence: Synthetic peptide
DETEIRTTNPVATESYGTVSTNLQHGNI

SEQ ID NO: 28783 - protein, 29 aa, Artificial Sequence
  Description of Artificial Sequence: Synthetic peptide
DEQEIRTTNPVATEQYGSVSENEQNRGNW

SEQ ID NO: 28784 - protein, 28 aa, Artificial Sequence
  Description of Artificial Sequence: Synthetic peptide
DEEEIRTTNPVATECYGSVSTDLEHGER

SEQ ID NO: 28785 - protein, 31 aa, Artificial Sequence
  Description of Artificial Sequence: Synthetic polypeptide
DEEEIRTTNPVATEQYGSVSTNLQDVNGNDF

SEQ ID NO: 28786 - protein, 28 aa, Artificial Sequence
  Description of Artificial Sequence: Synthetic peptide
DEDEIAATNPVATEQWGDVSTNLQRGNR

SEQ ID NO: 28787 - protein, 29 aa, Artificial Sequence
  Description of Artificial Sequence: Synthetic peptide
DEEEIRTTNPVATEQYGSVSTIEMRGLDR

SEQ ID NO: 28788 - protein, 28 aa, Artificial Sequence
  Description of Artificial Sequence: Synthetic peptide
LEEEIRTTNPVATECYGSVSENLQRPQR

SEQ ID NO: 28789 - protein, 28 aa, Artificial Sequence
  Description of Artificial Sequence: Synthetic peptide
DEEEIRATNPVATECYGSVSANLQRGLF

SEQ ID NO: 28790 - protein, 28 aa, Artificial Sequence
  Description of Artificial Sequence: Synthetic peptide
DEDEIRTTNPVATEQYGTVSTNIQVGNA

SEQ ID NO: 28791 - protein, 32 aa, Artificial Sequence
  Description of Artificial Sequence: Synthetic polypeptide
DEEEIRTTNPVATEQYGESVSETDGLVQRGNR

SEQ ID NO: 28792 - protein, 30 aa, Artificial Sequence
  Description of Artificial Sequence: Synthetic polypeptide
QEEEIRTTNPVATEQYGSVSDTNLEHGNDR

SEQ ID NO: 28793 - protein, 28 aa, Artificial Sequence
  Description of Artificial Sequence: Synthetic peptide
AEGEITTTNPVATEQYGEVSTNLQRGER

SEQ ID NO: 28794 - protein, 29 aa, Artificial Sequence
  Description of Artificial Sequence: Synthetic peptide
NEVEIRTTNPVATEQYGSVSENLDRGNDR

SEQ ID NO: 28795 - protein, 28 aa, Artificial Sequence
  Description of Artificial Sequence: Synthetic peptide
DEEEIRTTNPVATEWWGSVSENLQRGDY

SEQ ID NO: 28796 - protein, 28 aa, Artificial Sequence
  Description of Artificial Sequence: Synthetic peptide
DEEEIRTTNPVATECYGSVSTNEMIGNL

SEQ ID NO: 28797 - protein, 30 aa, Artificial Sequence
  Description of Artificial Sequence: Synthetic polypeptide
SEEEIRATNPVATEQYGSVSENLQDRGNTR

SEQ ID NO: 28798 - protein, 28 aa, Artificial Sequence
  Description of Artificial Sequence: Synthetic peptide
SEEEIRATNPVAYEQFGSVSTDLQRGNR

SEQ ID NO: 28799 - protein, 28 aa, Artificial Sequence
  Description of Artificial Sequence: Synthetic peptide
DEREIRTTNPTATEQYGCVSTNLQRENF

SEQ ID NO: 28800 - protein, 28 aa, Artificial Sequence
  Description of Artificial Sequence: Synthetic peptide
DEAEIATTNPVATEMYGSASTVLQRGNR

SEQ ID NO: 28801 - protein, 28 aa, Artificial Sequence
  Description of Artificial Sequence: Synthetic peptide
DEEEIRTTNPVATECYGSVSTNLMLGTA

SEQ ID NO: 28802 - protein, 28 aa, Artificial Sequence
  Description of Artificial Sequence: Synthetic peptide
DEEEITTTNPVATEQWGSVSENLDFGNR

SEQ ID NO: 28803 - protein, 28 aa, Artificial Sequence
  Description of Artificial Sequence: Synthetic peptide
DESEIRTTNPVATEVYGSVSTNEQTGNA

SEQ ID NO: 28804 - protein, 29 aa, Artificial Sequence
  Description of Artificial Sequence: Synthetic peptide
DEQEIRTTNPVATEQYGSVSMNLQSNGNF

SEQ ID NO: 28805 - protein, 31 aa, Artificial Sequence
  Description of Artificial Sequence: Synthetic polypeptide
DENEIRTTNPVATEQYGSVSATNLEIRGNDR

SEQ ID NO: 28806 - protein, 29 aa, Artificial Sequence
  Description of Artificial Sequence: Synthetic peptide
DEMEISTTNPVATEQYGSVSTNLQNNGNA

SEQ ID NO: 28807 - protein, 30 aa, Artificial Sequence
  Description of Artificial Sequence: Synthetic polypeptide
DESEIRTTNPVATEQYGSVESTTPLQRGNS

SEQ ID NO: 28808 - protein, 28 aa, Artificial Sequence
  Description of Artificial Sequence: Synthetic peptide
DEDEIRTTNPVATECYGGVSTNPQHGNR

SEQ ID NO: 28809 - protein, 28 aa, Artificial Sequence
  Description of Artificial Sequence: Synthetic peptide
DEEEIATTNPTATEQYGSVSTNPQHGNI

SEQ ID NO: 28810 - protein, 29 aa, Artificial Sequence
  Description of Artificial Sequence: Synthetic peptide
DESEIRTTNPVATEQYGTVSTNLQQHGNN

SEQ ID NO: 28811 - protein, 28 aa, Artificial Sequence
  Description of Artificial Sequence: Synthetic peptide
DEEEIRAVNPVATEGYGEVSTNHQRGNR

SEQ ID NO: 28812 - protein, 28 aa, Artificial Sequence
  Description of Artificial Sequence: Synthetic peptide
DEEEIRTTNPTCTEQYGVVSANLQNGNR

SEQ ID NO: 28813 - protein, 28 aa, Artificial Sequence
  Description of Artificial Sequence: Synthetic peptide
DEEEIRTTNPFATEQYGSVSEDQQRGND

SEQ ID NO: 28814 - protein, 29 aa, Artificial Sequence
  Description of Artificial Sequence: Synthetic peptide
DEEEIRTVNPVAYEPYGGVSTNLQREGNR

SEQ ID NO: 28815 - protein, 30 aa, Artificial Sequence
  Description of Artificial Sequence: Synthetic polypeptide
DEEEIRTTNPVATEQYGSVSTTDEQRGNLN

SEQ ID NO: 28816 - protein, 29 aa, Artificial Sequence
  Description of Artificial Sequence: Synthetic peptide
DEEEIRTTNPVATECYGSVSTDLQEGGNV

SEQ ID NO: 28817 - protein, 30 aa, Artificial Sequence
  Description of Artificial Sequence: Synthetic polypeptide
DEEEIRTTNPVATEQYGSVDLTALDDRGNR

SEQ ID NO: 28818 - protein, 28 aa, Artificial Sequence
  Description of Artificial Sequence: Synthetic peptide
DEQEIRTTNPVATEQYGSVSTNLEQENH

SEQ ID NO: 28819 - protein, 30 aa, Artificial Sequence
  Description of Artificial Sequence: Synthetic polypeptide
DEEEIRTTNPEATEQYGSVSTNLQSKGNPG

SEQ ID NO: 28820 - protein, 28 aa, Artificial Sequence
  Description of Artificial Sequence: Synthetic peptide
DENEIRTTNPVATEQYGDVSTDEQHGNR

SEQ ID NO: 28821 - protein, 28 aa, Artificial Sequence
  Description of Artificial Sequence: Synthetic peptide
DENEIATTNPVATEQYGDASENLQRGNR

SEQ ID NO: 28822 - protein, 30 aa, Artificial Sequence
  Description of Artificial Sequence: Synthetic polypeptide
DEEEIRTVNPVATEQYGEVSTNLQSRAGGR

SEQ ID NO: 28823 - protein, 30 aa, Artificial Sequence
  Description of Artificial Sequence: Synthetic polypeptide
DEVEIRTTNPVATEQYGGVSTMNLQQEGNR

SEQ ID NO: 28824 - protein, 28 aa, Artificial Sequence
  Description of Artificial Sequence: Synthetic peptide
QEHEIATTNPVATWQYGSVSTNLQMGNR

SEQ ID NO: 28825 - protein, 30 aa, Artificial Sequence
  Description of Artificial Sequence: Synthetic polypeptide
DEEVIRTTNPVATEQYGSVSTNLRDNGQNR

SEQ ID NO: 28826 - protein, 28 aa, Artificial Sequence
  Description of Artificial Sequence: Synthetic peptide
DEEEIRTTNPVATEQYGNWSHNDQRGND

SEQ ID NO: 28827 - protein, 29 aa, Artificial Sequence
  Description of Artificial Sequence: Synthetic peptide
QEEEIATTNPVATEQYGSVSTNLQHGNDL

SEQ ID NO: 28828 - protein, 28 aa, Artificial Sequence
  Description of Artificial Sequence: Synthetic peptide
DENEIRATNPVATEQYGDVSINLQRGER

SEQ ID NO: 28829 - protein, 28 aa, Artificial Sequence
  Description of Artificial Sequence: Synthetic peptide
DEEEIRATNPVATEQYGEVSTNEQRGPA

SEQ ID NO: 28830 - protein, 28 aa, Artificial Sequence
  Description of Artificial Sequence: Synthetic peptide
DENEIATVNPVATEQYGSVSTELQIGNR

SEQ ID NO: 28831 - protein, 30 aa, Artificial Sequence
  Description of Artificial Sequence: Synthetic polypeptide
DEEEIRTTNPVATEQYGSVSTEPLQIEGNN

SEQ ID NO: 28832 - protein, 28 aa, Artificial Sequence
  Description of Artificial Sequence: Synthetic peptide
GEEEIRATNPVATECYGSVSTNLERGND

SEQ ID NO: 28833 - protein, 28 aa, Artificial Sequence
  Description of Artificial Sequence: Synthetic peptide
MEEEIRTVNPVATEQYGSVATNLQTGNA

SEQ ID NO: 28834 - protein, 28 aa, Artificial Sequence
  Description of Artificial Sequence: Synthetic peptide
DEEEIRSTNPVSTEIYGCVATNLQRGNR

SEQ ID NO: 28835 - protein, 28 aa, Artificial Sequence
  Description of Artificial Sequence: Synthetic peptide
DENEIRTTNPVATECWGSVSTNLMIGNR

SEQ ID NO: 28836 - protein, 28 aa, Artificial Sequence
  Description of Artificial Sequence: Synthetic peptide
DEVEIKTTNPVATEGYGSVSENLQRGNL

SEQ ID NO: 28837 - protein, 28 aa, Artificial Sequence
  Description of Artificial Sequence: Synthetic peptide
DEEEICTTNPVATEQYGWVPTGLQRGPR

SEQ ID NO: 28838 - protein, 29 aa, Artificial Sequence
  Description of Artificial Sequence: Synthetic peptide
DENEIRTTNPVATEQYGSVSENLMMRGNF

SEQ ID NO: 28839 - protein, 28 aa, Artificial Sequence
  Description of Artificial Sequence: Synthetic peptide
DEQEIATTNPVATEQYGEVSENLQRGGR

SEQ ID NO: 28840 - protein, 28 aa, Artificial Sequence
  Description of Artificial Sequence: Synthetic peptide
SEEEIRTTNPVATEQYGSVSEMEQRGNF

SEQ ID NO: 28841 - protein, 28 aa, Artificial Sequence
  Description of Artificial Sequence: Synthetic peptide
QEEEIATTNPVATEQYGSVSQNLQRGEN

SEQ ID NO: 28842 - protein, 28 aa, Artificial Sequence
  Description of Artificial Sequence: Synthetic peptide
DEEEIRCTNPVATEQYGVVSSNLQFGNY

SEQ ID NO: 28843 - protein, 29 aa, Artificial Sequence
  Description of Artificial Sequence: Synthetic peptide
DEEEIRTTNPVATEQWGSVSENLQMRGTM

SEQ ID NO: 28844 - protein, 31 aa, Artificial Sequence
  Description of Artificial Sequence: Synthetic polypeptide
MEEEIRTTNPVATEQYGSVSTDLQEREGNDR

SEQ ID NO: 28845 - protein, 32 aa, Artificial Sequence
  Description of Artificial Sequence: Synthetic polypeptide
DSEEIRTTNPVATEQYGSQVSDTNLSQRGQNR

SEQ ID NO: 28846 - protein, 28 aa, Artificial Sequence
  Description of Artificial Sequence: Synthetic peptide
DETEIRTTNPVATEQYGDCSCNLQQGNR

SEQ ID NO: 28847 - protein, 28 aa, Artificial Sequence
  Description of Artificial Sequence: Synthetic peptide
DESEIETTNPVATEQYGGVSTNLQQGNS

SEQ ID NO: 28848 - protein, 30 aa, Artificial Sequence
  Description of Artificial Sequence: Synthetic polypeptide
DDEEIRTTNPVATEQYGSVAVENLQRGANR

SEQ ID NO: 28849 - protein, 28 aa, Artificial Sequence
  Description of Artificial Sequence: Synthetic peptide
DEQEIATTNPVATECYGSVSTDLERGNR

SEQ ID NO: 28850 - protein, 28 aa, Artificial Sequence
  Description of Artificial Sequence: Synthetic peptide
KEEEIATTNPVATEQYGSVSEDLQRENR

SEQ ID NO: 28851 - protein, 30 aa, Artificial Sequence
  Description of Artificial Sequence: Synthetic polypeptide
NEEEIRTTNPVATEVYGSVSETNLQVNGNR

SEQ ID NO: 28852 - protein, 28 aa, Artificial Sequence
  Description of Artificial Sequence: Synthetic peptide
DEEEIRTTNPESTEQYGSVSTNGQSGNI

SEQ ID NO: 28853 - protein, 29 aa, Artificial Sequence
  Description of Artificial Sequence: Synthetic peptide
DEGEIRTVNPVATEQYGSVSATVLQHGNR

SEQ ID NO: 28854 - protein, 28 aa, Artificial Sequence
  Description of Artificial Sequence: Synthetic peptide
DEEEIRTTNPVATEQWGAVSTNQQGGND

SEQ ID NO: 28855 - protein, 29 aa, Artificial Sequence
  Description of Artificial Sequence: Synthetic peptide
DENEIRTTNPVATEQWGSVSENLQMRGDR

SEQ ID NO: 28856 - protein, 28 aa, Artificial Sequence
  Description of Artificial Sequence: Synthetic peptide
DEVEIGTTNPVATEQYGDVSENLQRGGR

SEQ ID NO: 28857 - protein, 28 aa, Artificial Sequence
  Description of Artificial Sequence: Synthetic peptide
DEEEIRTTNPVCTEQYGDASTALQDGNR

SEQ ID NO: 28858 - protein, 29 aa, Artificial Sequence
  Description of Artificial Sequence: Synthetic peptide
DESEIRTTNPCATEQYGSVSENLQTVGNR

SEQ ID NO: 28859 - protein, 28 aa, Artificial Sequence
  Description of Artificial Sequence: Synthetic peptide
GEEEIAATNPVSTEVYGSVSTNLQRGNR

SEQ ID NO: 28860 - protein, 28 aa, Artificial Sequence
  Description of Artificial Sequence: Synthetic peptide
DESEIASTNPVATELYGSVATNLQRGNR

SEQ ID NO: 28861 - protein, 30 aa, Artificial Sequence
  Description of Artificial Sequence: Synthetic polypeptide
DEEEIRATNPVATEQFGSVSTGNLQQGNDR

SEQ ID NO: 28862 - protein, 28 aa, Artificial Sequence
  Description of Artificial Sequence: Synthetic peptide
DEEEIRQTNPVATEVYGEVSTNLQHGGR

SEQ ID NO: 28863 - protein, 28 aa, Artificial Sequence
  Description of Artificial Sequence: Synthetic peptide
NEEEIRATNPVATEPYGSVSTNLQRGTQ

SEQ ID NO: 28864 - protein, 29 aa, Artificial Sequence
  Description of Artificial Sequence: Synthetic peptide
DEEEISTTNPVATEQYGSVSDALQARYNR

SEQ ID NO: 28865 - protein, 32 aa, Artificial Sequence
  Description of Artificial Sequence: Synthetic polypeptide
DEEEIRTTNPVATEQYGSYVTSTNPLQRGDNP

SEQ ID NO: 28866 - protein, 31 aa, Artificial Sequence
  Description of Artificial Sequence: Synthetic polypeptide
DEEEIRTTNPVASEQYGSVSTTNLTLDRGNR

SEQ ID NO: 28867 - protein, 28 aa, Artificial Sequence
  Description of Artificial Sequence: Synthetic peptide
DENEIRTTNPVATEQWGSVSENEQRGNA

SEQ ID NO: 28868 - protein, 29 aa, Artificial Sequence
  Description of Artificial Sequence: Synthetic peptide
SEEEIRTTNPVATEQYGSVSEDGLQRGPR

SEQ ID NO: 28869 - protein, 28 aa, Artificial Sequence
  Description of Artificial Sequence: Synthetic peptide
DEEEIRTTNPVATEPYGDVATNLQGGNA

SEQ ID NO: 28870 - protein, 29 aa, Artificial Sequence
  Description of Artificial Sequence: Synthetic peptide
DEVEIATTNPVATEQYGSVSEDLQRGDNR

SEQ ID NO: 28871 - protein, 32 aa, Artificial Sequence
  Description of Artificial Sequence: Synthetic polypeptide
DEEEIRTTNPVATEQYGSVSTENLQEREGNDD

SEQ ID NO: 28872 - protein, 30 aa, Artificial Sequence
  Description of Artificial Sequence: Synthetic polypeptide
KEEEIRTTNPVATECYGSVSTNLQERGNDE

SEQ ID NO: 28873 - protein, 28 aa, Artificial Sequence
  Description of Artificial Sequence: Synthetic peptide
DENEIVTTNPVATEQYGSVSTGLQVGNQ

SEQ ID NO: 28874 - protein, 28 aa, Artificial Sequence
  Description of Artificial Sequence: Synthetic peptide
DEEEIRTTNPTATEQYGEVSENEQNGNR

SEQ ID NO: 28875 - protein, 28 aa, Artificial Sequence
  Description of Artificial Sequence: Synthetic peptide
DEEEVRSTNPVASEHYGSVSTNLQRGNQ

SEQ ID NO: 28876 - protein, 29 aa, Artificial Sequence
  Description of Artificial Sequence: Synthetic peptide
SEEEIRTTNPVATEQYGSVSTNPQRGPTQ

SEQ ID NO: 28877 - protein, 30 aa, Artificial Sequence
  Description of Artificial Sequence: Synthetic polypeptide
DEEEIRTTNPVATEIYGGVSANNLQREGNR

SEQ ID NO: 28878 - protein, 28 aa, Artificial Sequence
  Description of Artificial Sequence: Synthetic peptide
DEEEIRTTNPVATEQYGSVSTDLEAGEE

SEQ ID NO: 28879 - protein, 28 aa, Artificial Sequence
  Description of Artificial Sequence: Synthetic peptide
AETEIRTTNPVATEQYGWVSENLQRGGR

SEQ ID NO: 28880 - protein, 31 aa, Artificial Sequence
  Description of Artificial Sequence: Synthetic polypeptide
DEEEIRTTNPVATEQYGSVSTNLQLDNGNDD

SEQ ID NO: 28881 - protein, 31 aa, Artificial Sequence
  Description of Artificial Sequence: Synthetic polypeptide
DEEEIRTVNPVATEQFGSVSTNGLQSREGNR

SEQ ID NO: 28882 - protein, 28 aa, Artificial Sequence
  Description of Artificial Sequence: Synthetic peptide
DEEEIVTTNPVATEWYGSVSENLQQQNR

SEQ ID NO: 28883 - protein, 28 aa, Artificial Sequence
  Description of Artificial Sequence: Synthetic peptide
DEEEIRTTNPVATEQYGSASEVLQHGGR

SEQ ID NO: 28884 - protein, 28 aa, Artificial Sequence
  Description of Artificial Sequence: Synthetic peptide
AENEIATTNPVATEQYGIVSENLQRGNR

SEQ ID NO: 28885 - protein, 30 aa, Artificial Sequence
  Description of Artificial Sequence: Synthetic polypeptide
DEEEIRTTNPVATEQYGSVSYNVTQSRGNN

SEQ ID NO: 28886 - protein, 29 aa, Artificial Sequence
  Description of Artificial Sequence: Synthetic peptide
DEEEIRTTNPVATEQYGSVDTNDQQSGNA

SEQ ID NO: 28887 - protein, 28 aa, Artificial Sequence
  Description of Artificial Sequence: Synthetic peptide
DEQEIMTTNPVATEQYGSVSENLQQGNA

SEQ ID NO: 28888 - protein, 29 aa, Artificial Sequence
  Description of Artificial Sequence: Synthetic peptide
DEQEIRCTNPVATETYGCVSTNLQREGNR

SEQ ID NO: 28889 - protein, 28 aa, Artificial Sequence
  Description of Artificial Sequence: Synthetic peptide
DEEEINTTNPVATETYGDASTNLQAGNR

SEQ ID NO: 28890 - protein, 28 aa, Artificial Sequence
  Description of Artificial Sequence: Synthetic peptide
DDEELRTTNPVATLQWGSVSTNLQRGNE

SEQ ID NO: 28891 - protein, 28 aa, Artificial Sequence
  Description of Artificial Sequence: Synthetic peptide
SEEEIRTTNPVATEMYGGVSENLQRGNF

SEQ ID NO: 28892 - protein, 30 aa, Artificial Sequence
  Description of Artificial Sequence: Synthetic polypeptide
KEEEIRTTNPVATEQYGSVSTELQENEGNR

SEQ ID NO: 28893 - protein, 28 aa, Artificial Sequence
  Description of Artificial Sequence: Synthetic peptide
DEQEIACTNPVATENYGVVSTNLQRGNR

SEQ ID NO: 28894 - protein, 28 aa, Artificial Sequence
  Description of Artificial Sequence: Synthetic peptide
DEQEISTTNPVATECYGSVSTNWQRGNQ

SEQ ID NO: 28895 - protein, 28 aa, Artificial Sequence
  Description of Artificial Sequence: Synthetic peptide
DEVEIATTNPTATEQYGSVSTNPQRGNL

SEQ ID NO: 28896 - protein, 31 aa, Artificial Sequence
  Description of Artificial Sequence: Synthetic polypeptide
DEEEIRTTNPVATEQYGSVSTNLQENEGNDL

SEQ ID NO: 28897 - protein, 28 aa, Artificial Sequence
  Description of Artificial Sequence: Synthetic peptide
DEEEIRTTNPVATEQWGSVSTNEMRGTS

SEQ ID NO: 28898 - protein, 28 aa, Artificial Sequence
  Description of Artificial Sequence: Synthetic peptide
DEQEIASTNPVSTEQYGWVSTNLQRGNR

SEQ ID NO: 28899 - protein, 28 aa, Artificial Sequence
  Description of Artificial Sequence: Synthetic peptide
DEEEIRTTNPVATEQYGDVSEDLQHGNV

SEQ ID NO: 28900 - protein, 30 aa, Artificial Sequence
  Description of Artificial Sequence: Synthetic polypeptide
DEEEIRTTNPEATEQYGSVSTEPLQRGEDR

SEQ ID NO: 28901 - protein, 30 aa, Artificial Sequence
  Description of Artificial Sequence: Synthetic polypeptide
DEEEIRTTNPVATEQYGSVSTNPLQVKGEE

SEQ ID NO: 28902 - protein, 28 aa, Artificial Sequence
  Description of Artificial Sequence: Synthetic peptide
DEEEIRTTNPEATEQYGSVSTDEQNGNE

SEQ ID NO: 28903 - protein, 28 aa, Artificial Sequence
  Description of Artificial Sequence: Synthetic peptide
DEEEIATTNPVATEQYGVVSTNLQNNNA

SEQ ID NO: 28904 - protein, 28 aa, Artificial Sequence
  Description of Artificial Sequence: Synthetic peptide
DEEEIRTTNPEATEQYGSVSTDLERGEA

SEQ ID NO: 28905 - protein, 28 aa, Artificial Sequence
  Description of Artificial Sequence: Synthetic peptide
DEEEIRTTNPAATELFGSVSTNEQNGNR

SEQ ID NO: 28906 - protein, 28 aa, Artificial Sequence
  Description of Artificial Sequence: Synthetic peptide
DEEEIRTTNPVATECYGSVSENLMVGDR

SEQ ID NO: 28907 - protein, 28 aa, Artificial Sequence
  Description of Artificial Sequence: Synthetic peptide
DDAEIRTTNPVATEQYGEVSNVLQRGNR

SEQ ID NO: 28908 - protein, 31 aa, Artificial Sequence
  Description of Artificial Sequence: Synthetic polypeptide
DEEEIRTTNPVATEQYGSVSTNLQEREGEEI

SEQ ID NO: 28909 - protein, 28 aa, Artificial Sequence
  Description of Artificial Sequence: Synthetic peptide
DENEIRTTNPVATECWGSVATNLQRGNF

SEQ ID NO: 28910 - protein, 28 aa, Artificial Sequence
  Description of Artificial Sequence: Synthetic peptide
DEEEIRTTNPVAYECYGNVSTEEQRGNR

SEQ ID NO: 28911 - protein, 28 aa, Artificial Sequence
  Description of Artificial Sequence: Synthetic peptide
AEEEIRTTNPVATEQYGVVSELLQRGGR

SEQ ID NO: 28912 - protein, 28 aa, Artificial Sequence
  Description of Artificial Sequence: Synthetic peptide
DEEEIRTTNPVATEQYGSVGYNLQILNH

SEQ ID NO: 28913 - protein, 29 aa, Artificial Sequence
  Description of Artificial Sequence: Synthetic peptide
DEEEIRTTNPVATEQYGSVSEELQDLGNH

SEQ ID NO: 28914 - protein, 29 aa, Artificial Sequence
  Description of Artificial Sequence: Synthetic peptide
DEEEIATTNPVASEQYGSASTNLQRAGNA

SEQ ID NO: 28915 - protein, 28 aa, Artificial Sequence
  Description of Artificial Sequence: Synthetic peptide
DEEEIRTVNPTATEQYGSVSTNLQRMGH

SEQ ID NO: 28916 - protein, 28 aa, Artificial Sequence
  Description of Artificial Sequence: Synthetic peptide
DEEEIRTTNPVATEQYGSISTPLINGNS

SEQ ID NO: 28917 - protein, 29 aa, Artificial Sequence
  Description of Artificial Sequence: Synthetic peptide
DEEAIRTTNPTATEQYGSVHTDLQSRGNR

SEQ ID NO: 28918 - protein, 28 aa, Artificial Sequence
  Description of Artificial Sequence: Synthetic peptide
DEQEIAAVNPVATEQYGVVSTNLQRGNR

SEQ ID NO: 28919 - protein, 28 aa, Artificial Sequence
  Description of Artificial Sequence: Synthetic peptide
DEEEIRSTNPVATEQYGSVSDCLQGFNR

SEQ ID NO: 28920 - protein, 28 aa, Artificial Sequence
  Description of Artificial Sequence: Synthetic peptide
DEQEIAPTNPVATEQYGWMSTNLQRGNR

SEQ ID NO: 28921 - protein, 28 aa, Artificial Sequence
  Description of Artificial Sequence: Synthetic peptide
DEEEIRTTNPVATEQYGSVETEDEPGNR

SEQ ID NO: 28922 - protein, 30 aa, Artificial Sequence
  Description of Artificial Sequence: Synthetic polypeptide
DEEEIRTTNPVATEQYGSVSTNEQDIGDNG

SEQ ID NO: 28923 - protein, 28 aa, Artificial Sequence
  Description of Artificial Sequence: Synthetic peptide
DEVEIMTTNPVATEQYGSVSENLQHGNC

SEQ ID NO: 28924 - protein, 28 aa, Artificial Sequence
  Description of Artificial Sequence: Synthetic peptide
DETEIRTTNPVATELYGCVSDNVQRGNR

SEQ ID NO: 28925 - protein, 28 aa, Artificial Sequence
  Description of Artificial Sequence: Synthetic peptide
DEVEIRATNPVATEQYGGVSTDLQQGNR

SEQ ID NO: 28926 - protein, 30 aa, Artificial Sequence
  Description of Artificial Sequence: Synthetic polypeptide
DEEEIRTTNPVATEQYGSVSTNLEDREGEI

SEQ ID NO: 28927 - protein, 30 aa, Artificial Sequence
  Description of Artificial Sequence: Synthetic polypeptide
DEESIRTTNPVATEQYGNSVSTENLQRFNT

SEQ ID NO: 28928 - protein, 30 aa, Artificial Sequence
  Description of Artificial Sequence: Synthetic polypeptide
DEEEIATTNPVATEQYGSASTNLQRAGEDR

SEQ ID NO: 28929 - protein, 29 aa, Artificial Sequence
  Description of Artificial Sequence: Synthetic peptide
DEVEIRTTNPVATEQYGDVSTELQRGNDM

SEQ ID NO: 28930 - protein, 28 aa, Artificial Sequence
  Description of Artificial Sequence: Synthetic peptide
DEEEIATTNPVATEQYGLVSWNTQRGMR

SEQ ID NO: 28931 - protein, 29 aa, Artificial Sequence
  Description of Artificial Sequence: Synthetic peptide
DEQEIRTTNPIAYEQYGVVSATNLQRGNR

SEQ ID NO: 28932 - protein, 28 aa, Artificial Sequence
  Description of Artificial Sequence: Synthetic peptide
YECEIKTTNPVATEQYGSVSDNLQRGER

SEQ ID NO: 28933 - protein, 28 aa, Artificial Sequence
  Description of Artificial Sequence: Synthetic peptide
DEEEIATTNPVATEWYGFVSDNLQRGGR

SEQ ID NO: 28934 - protein, 28 aa, Artificial Sequence
  Description of Artificial Sequence: Synthetic peptide
DEIEIRTTNPVATEQYGSVNENLQSGNF

SEQ ID NO: 28935 - protein, 28 aa, Artificial Sequence
  Description of Artificial Sequence: Synthetic peptide
DEHEITPTNPVATEQYGSVSENLQRLNR

SEQ ID NO: 28936 - protein, 29 aa, Artificial Sequence
  Description of Artificial Sequence: Synthetic peptide
DEGEIRCTNPVATEQYGSVSTNLQRGITH

SEQ ID NO: 28937 - protein, 28 aa, Artificial Sequence
  Description of Artificial Sequence: Synthetic peptide
DEEEIRTTNPVATECYGSVSTNLEDGEA

SEQ ID NO: 28938 - protein, 29 aa, Artificial Sequence
  Description of Artificial Sequence: Synthetic peptide
SEEEIRTTNPVSTEQWGSVSTNLQWRGDR

SEQ ID NO: 28939 - protein, 29 aa, Artificial Sequence
  Description of Artificial Sequence: Synthetic peptide
QEEEIRTVNPVATEQYGSVSDNLQSIGNR

SEQ ID NO: 28940 - protein, 28 aa, Artificial Sequence
  Description of Artificial Sequence: Synthetic peptide
SDEEIRTTNPVATEQYGSVSTNEMRGNS

SEQ ID NO: 28941 - protein, 28 aa, Artificial Sequence
  Description of Artificial Sequence: Synthetic peptide
DEEEIRTTNPVATEQYGSVETNLDNGDF

SEQ ID NO: 28942 - protein, 30 aa, Artificial Sequence
  Description of Artificial Sequence: Synthetic polypeptide
DEQEIRTTNPVATEQYGSVDTMDLQDRGNR

SEQ ID NO: 28943 - protein, 28 aa, Artificial Sequence
  Description of Artificial Sequence: Synthetic peptide
DEQEIAATNPVATENYGWVSTNLQRGNR

SEQ ID NO: 28944 - protein, 28 aa, Artificial Sequence
  Description of Artificial Sequence: Synthetic peptide
DEEEIRCTNPVASEQYGDVGTNLQQGNR

SEQ ID NO: 28945 - protein, 29 aa, Artificial Sequence
  Description of Artificial Sequence: Synthetic peptide
DEEEIRTTNPVATECYGSVSENLQWLGNQ

SEQ ID NO: 28946 - protein, 28 aa, Artificial Sequence
  Description of Artificial Sequence: Synthetic peptide
DENEIVTTNPVATECYGSVSTELQTGNR

SEQ ID NO: 28947 - protein, 28 aa, Artificial Sequence
  Description of Artificial Sequence: Synthetic peptide
DEEEIRTTNPTCTEQYGCVSTAVQRGNR

SEQ ID NO: 28948 - protein, 28 aa, Artificial Sequence
  Description of Artificial Sequence: Synthetic peptide
DEQEIATTNPVATEQYGSVSTDLQHGER

SEQ ID NO: 28949 - protein, 30 aa, Artificial Sequence
  Description of Artificial Sequence: Synthetic polypeptide
DEEEIRTTNPVATEQYGDASCTDLQQRGNR

SEQ ID NO: 28950 - protein, 28 aa, Artificial Sequence
  Description of Artificial Sequence: Synthetic peptide
QEEEIAQTNPVATEQYGSASTNLQHGNR

SEQ ID NO: 28951 - protein, 28 aa, Artificial Sequence
  Description of Artificial Sequence: Synthetic peptide
DEEEIATTNPVATEQYGDASTNLQHGNQ

SEQ ID NO: 28952 - protein, 29 aa, Artificial Sequence
  Description of Artificial Sequence: Synthetic peptide
QEQEIATTNPVATEQYGEVSTNLQRAGNR

SEQ ID NO: 28953 - protein, 29 aa, Artificial Sequence
  Description of Artificial Sequence: Synthetic peptide
SEEEIRTTNPVATEQYGSVSTNEQEQGTR

SEQ ID NO: 28954 - protein, 30 aa, Artificial Sequence
  Description of Artificial Sequence: Synthetic polypeptide
DEEEIRTTNPEATEQYGSVSTLNLENKGNR

SEQ ID NO: 28955 - protein, 28 aa, Artificial Sequence
  Description of Artificial Sequence: Synthetic peptide
QETEIATTNPVATEQCGSVSTNLQRGGR

SEQ ID NO: 28956 - protein, 30 aa, Artificial Sequence
  Description of Artificial Sequence: Synthetic polypeptide
DENEIRTTNPVATEQYGNVSTNLQNRGNDM

SEQ ID NO: 28957 - protein, 32 aa, Artificial Sequence
  Description of Artificial Sequence: Synthetic polypeptide
DEEEIRTTNPVATEQYGSWSLTNLQIREGNDR

SEQ ID NO: 28958 - protein, 28 aa, Artificial Sequence
  Description of Artificial Sequence: Synthetic peptide
DEEEIRATNPTATEQYGSVSTNPQNGNF

SEQ ID NO: 28959 - protein, 28 aa, Artificial Sequence
  Description of Artificial Sequence: Synthetic peptide
DENEIRTTNPVATECYGSVSTDLQTGNT

SEQ ID NO: 28960 - protein, 30 aa, Artificial Sequence
  Description of Artificial Sequence: Synthetic polypeptide
DEEEIRTTNPVATEQYGSVDTNEPQVDGNR

SEQ ID NO: 28961 - protein, 28 aa, Artificial Sequence
  Description of Artificial Sequence: Synthetic peptide
DEEEIRTTNPEATEQYGSVSTDLQHENN

SEQ ID NO: 28962 - protein, 32 aa, Artificial Sequence
  Description of Artificial Sequence: Synthetic polypeptide
DEEEIRTTNPVATEQYGSVSETNLEERGENER

SEQ ID NO: 28963 - protein, 28 aa, Artificial Sequence
  Description of Artificial Sequence: Synthetic peptide
QEAEITTTNPVATEQYGWVSTNLQRGDR

SEQ ID NO: 28964 - protein, 28 aa, Artificial Sequence
  Description of Artificial Sequence: Synthetic peptide
QEEEIATVNPVATEGYGSASTNLQRGNR

SEQ ID NO: 28965 - protein, 31 aa, Artificial Sequence
  Description of Artificial Sequence: Synthetic polypeptide
DEEEIRTTNPVATEQYGSVSTNLERDGENED

SEQ ID NO: 28966 - protein, 28 aa, Artificial Sequence
  Description of Artificial Sequence: Synthetic peptide
DDEEIRTTNPVGTEQWGSVSTNVQRPNR

SEQ ID NO: 28967 - protein, 28 aa, Artificial Sequence
  Description of Artificial Sequence: Synthetic peptide
KEEEIATTNPVATEQYGSASEDLQRGNR

SEQ ID NO: 28968 - protein, 28 aa, Artificial Sequence
  Description of Artificial Sequence: Synthetic peptide
AEQEIATTNPVATEVYGWVSTNLQRGNR

SEQ ID NO: 28969 - protein, 28 aa, Artificial Sequence
  Description of Artificial Sequence: Synthetic peptide
DEEEIATTNPVATEQFGWVATNLMRGNR

SEQ ID NO: 28970 - protein, 31 aa, Artificial Sequence
  Description of Artificial Sequence: Synthetic polypeptide
DEEEIRTTNPVATEQYGSVSTNLQELEGNDS

SEQ ID NO: 28971 - protein, 32 aa, Artificial Sequence
  Description of Artificial Sequence: Synthetic polypeptide
DEEEIRTTNPVATEQYGSVDSTNGDQREGNER

SEQ ID NO: 28972 - protein, 28 aa, Artificial Sequence
  Description of Artificial Sequence: Synthetic peptide
DEEEIRTTNPVAWEQYGDVWTNLGPGNR

SEQ ID NO: 28973 - protein, 28 aa, Artificial Sequence
  Description of Artificial Sequence: Synthetic peptide
DEEEIRTTNPVATEQYGCVSTLVQRGTA

SEQ ID NO: 28974 - protein, 28 aa, Artificial Sequence
  Description of Artificial Sequence: Synthetic peptide
DEEEVRTVNPVATEQYGAVSTNLQRGMM

SEQ ID NO: 28975 - protein, 28 aa, Artificial Sequence
  Description of Artificial Sequence: Synthetic peptide
DEEEIRTTNPVATEQYGDVSENLQRMQQ

SEQ ID NO: 28976 - protein, 28 aa, Artificial Sequence
  Description of Artificial Sequence: Synthetic peptide
DEEEIRTTNPVATENYGAVATNLNLGNR

SEQ ID NO: 28977 - protein, 28 aa, Artificial Sequence
  Description of Artificial Sequence: Synthetic peptide
MEEEIRTTNPVATEQYGSVSDDLQVGND

SEQ ID NO: 28978 - protein, 28 aa, Artificial Sequence
  Description of Artificial Sequence: Synthetic peptide
SESEIRTTNPVASEQYGNVSTNLQRGNL

SEQ ID NO: 28979 - protein, 28 aa, Artificial Sequence
  Description of Artificial Sequence: Synthetic peptide
SEEEIRTTNPVATEQYGSVSENEQRGTG

SEQ ID NO: 28980 - protein, 28 aa, Artificial Sequence
  Description of Artificial Sequence: Synthetic peptide
VEEEIRCTNPVAVEQYGSVSENLQRGER

SEQ ID NO: 28981 - protein, 28 aa, Artificial Sequence
  Description of Artificial Sequence: Synthetic peptide
DEEEIRTTNPVCTEVYGCVSTNLERGND

SEQ ID NO: 28982 - protein, 29 aa, Artificial Sequence
  Description of Artificial Sequence: Synthetic peptide
DEEEIRCTNPVATEQWGSYSTNLQIRGDR

SEQ ID NO: 28983 - protein, 29 aa, Artificial Sequence
  Description of Artificial Sequence: Synthetic peptide
DDEEISSTNPVATEQYGSVSTNLQRGNDS

SEQ ID NO: 28984 - protein, 28 aa, Artificial Sequence
  Description of Artificial Sequence: Synthetic peptide
QEEEIATTNPVATEQYGWASDNLQRGNR

SEQ ID NO: 28985 - protein, 28 aa, Artificial Sequence
  Description of Artificial Sequence: Synthetic peptide
DEEEIRTTNPVATEVYGAVSNALQRGNA

SEQ ID NO: 28986 - protein, 29 aa, Artificial Sequence
  Description of Artificial Sequence: Synthetic peptide
DEVEIAATNPVATEQYGSVSTNLQDRGNF

SEQ ID NO: 28987 - protein, 28 aa, Artificial Sequence
  Description of Artificial Sequence: Synthetic peptide
DEEEISTTNPVATEQYGIVSEVLQGGNR

SEQ ID NO: 28988 - protein, 30 aa, Artificial Sequence
  Description of Artificial Sequence: Synthetic polypeptide
DEEEIRTTNPVATEQYGSVSTELQMAGNLA

SEQ ID NO: 28989 - protein, 30 aa, Artificial Sequence
  Description of Artificial Sequence: Synthetic polypeptide
DEEEIRTTNPVATEQYGSVSITDLEREGNN

SEQ ID NO: 28990 - protein, 30 aa, Artificial Sequence
  Description of Artificial Sequence: Synthetic polypeptide
AEEEIRGTNPVATEQYGSVATNLQSRAGNR

SEQ ID NO: 28991 - protein, 29 aa, Artificial Sequence
  Description of Artificial Sequence: Synthetic peptide
DETEIRTTNPVATEQYGSVTTNLMIAGNR

SEQ ID NO: 28992 - protein, 30 aa, Artificial Sequence
  Description of Artificial Sequence: Synthetic polypeptide
DEMEISTTNPVATEQYGSVSTNLQLDGNLR

SEQ ID NO: 28993 - protein, 28 aa, Artificial Sequence
  Description of Artificial Sequence: Synthetic peptide
DEQEVATTNPVATEIYGWVSTNLQRGNR

SEQ ID NO: 28994 - protein, 30 aa, Artificial Sequence
  Description of Artificial Sequence: Synthetic polypeptide
DEEEIRTTNPVATEQYGSVSTELQDLGNDA

SEQ ID NO: 28995 - protein, 28 aa, Artificial Sequence
  Description of Artificial Sequence: Synthetic peptide
SEEEIRCTNPVATEQFGSVSTNDQQGNR

SEQ ID NO: 28996 - protein, 30 aa, Artificial Sequence
  Description of Artificial Sequence: Synthetic polypeptide
DEEEIATTNPVATEQYGSVSCTDLQQRGNA

SEQ ID NO: 28997 - protein, 28 aa, Artificial Sequence
  Description of Artificial Sequence: Synthetic peptide
QEEEIRTTNPVATEQYGEASENLQRGGR

SEQ ID NO: 28998 - protein, 28 aa, Artificial Sequence
  Description of Artificial Sequence: Synthetic peptide
DEEEIATTNPVSTELYGCVGTNLQRGNR

SEQ ID NO: 28999 - protein, 28 aa, Artificial Sequence
  Description of Artificial Sequence: Synthetic peptide
DENEIRTTNPVATEQYGSVSTGLELGND

SEQ ID NO: 29000 - protein, 28 aa, Artificial Sequence
  Description of Artificial Sequence: Synthetic peptide
DESEIATTNPVATEGYGVVSTNLQRGNI

SEQ ID NO: 29001 - protein, 28 aa, Artificial Sequence
  Description of Artificial Sequence: Synthetic peptide
DEEEIRTTNPVASEWYGATSTNLQRGNH

SEQ ID NO: 29002 - protein, 30 aa, Artificial Sequence
  Description of Artificial Sequence: Synthetic polypeptide
DEECIRTTNPVATEQFGSVESTNLYLRGNR

SEQ ID NO: 29003 - protein, 28 aa, Artificial Sequence
  Description of Artificial Sequence: Synthetic peptide
DEEEIRCTNPVATEHYGAVSTNLQVGNA

SEQ ID NO: 29004 - protein, 29 aa, Artificial Sequence
  Description of Artificial Sequence: Synthetic peptide
DEEEIRTVNPVATEQYGSVDNTNLEEGNR

SEQ ID NO: 29005 - protein, 28 aa, Artificial Sequence
  Description of Artificial Sequence: Synthetic peptide
SEEEIAATNPVATEQFGSVPTNLQRGNR

SEQ ID NO: 29006 - protein, 28 aa, Artificial Sequence
  Description of Artificial Sequence: Synthetic peptide
DEEEIRTTNPCATEQYGTVSTNDERGNG

SEQ ID NO: 29007 - protein, 28 aa, Artificial Sequence
  Description of Artificial Sequence: Synthetic peptide
DEEEICTTNPVATEQYGSVSENLQIGDH

SEQ ID NO: 29008 - protein, 28 aa, Artificial Sequence
  Description of Artificial Sequence: Synthetic peptide
DEEEIRTTNPVCTEQYGSVATNVQQGER

SEQ ID NO: 29009 - protein, 28 aa, Artificial Sequence
  Description of Artificial Sequence: Synthetic peptide
DEEEIRTTNPCATEQYGCVSTALQVGNP

SEQ ID NO: 29010 - protein, 28 aa, Artificial Sequence
  Description of Artificial Sequence: Synthetic peptide
DEEEIRCTNPAATEQYGCVSTNLQHGNV

SEQ ID NO: 29011 - protein, 28 aa, Artificial Sequence
  Description of Artificial Sequence: Synthetic peptide
DENEIATTNPVATEQYGDASTNLQHGNR

SEQ ID NO: 29012 - protein, 28 aa, Artificial Sequence
  Description of Artificial Sequence: Synthetic peptide
KEEEIRTTNPVATECYGVVSTNLQWGNE

SEQ ID NO: 29013 - protein, 28 aa, Artificial Sequence
  Description of Artificial Sequence: Synthetic peptide
DEEEIRTTNPFATEQYGSVSTGPEDGNR

SEQ ID NO: 29014 - protein, 28 aa, Artificial Sequence
  Description of Artificial Sequence: Synthetic peptide
DENEIRTTNPVATEQYGSVSENLQLGTS

SEQ ID NO: 29015 - protein, 28 aa, Artificial Sequence
  Description of Artificial Sequence: Synthetic peptide
DEEEIRTTNPVATEQYGDVSEDLQVGNM

SEQ ID NO: 29016 - protein, 31 aa, Artificial Sequence
  Description of Artificial Sequence: Synthetic polypeptide
DPEEIRTTNPVAYEQYGSYVSTNLQRGDNPR

SEQ ID NO: 29017 - protein, 28 aa, Artificial Sequence
  Description of Artificial Sequence: Synthetic peptide
GEEEIATTNPVATEQYGIVSDNLQRGAR

SEQ ID NO: 29018 - protein, 30 aa, Artificial Sequence
  Description of Artificial Sequence: Synthetic polypeptide
DEQEIRTTNPVATEQYGSVSTEDGLQRGNF

SEQ ID NO: 29019 - protein, 28 aa, Artificial Sequence
  Description of Artificial Sequence: Synthetic peptide
YEEEIAQTNPVATEQYGSVSDNLQRANR

SEQ ID NO: 29020 - protein, 28 aa, Artificial Sequence
  Description of Artificial Sequence: Synthetic peptide
DEEEIATTNPVATEMYGGVSTNLQQGNF

SEQ ID NO: 29021 - protein, 28 aa, Artificial Sequence
  Description of Artificial Sequence: Synthetic peptide
QEEEIRTTNPCATEQYGVVSTALQRGER

SEQ ID NO: 29022 - protein, 28 aa, Artificial Sequence
  Description of Artificial Sequence: Synthetic peptide
DEEEIRTTNPVATEQYGSVSTGLDFGDG

SEQ ID NO: 29023 - protein, 28 aa, Artificial Sequence
  Description of Artificial Sequence: Synthetic peptide
DEEEIATTNPVATEQFGSVAENEQRGNR

SEQ ID NO: 29024 - protein, 28 aa, Artificial Sequence
  Description of Artificial Sequence: Synthetic peptide
QEQEICTTNPVATEQYGEVSDNLQRGNR

SEQ ID NO: 29025 - protein, 28 aa, Artificial Sequence
  Description of Artificial Sequence: Synthetic peptide
DEEEIRTTNPVATLQYGSVSTSLDEGNL

SEQ ID NO: 29026 - protein, 28 aa, Artificial Sequence
  Description of Artificial Sequence: Synthetic peptide
DEEEIRTTNPVATEQYGDASENLQHGNQ

SEQ ID NO: 29027 - protein, 28 aa, Artificial Sequence
  Description of Artificial Sequence: Synthetic peptide
DEGEISTTNPVATEQYGCMSTNLQRGNS

SEQ ID NO: 29028 - protein, 28 aa, Artificial Sequence
  Description of Artificial Sequence: Synthetic peptide
QEQEIATTNPVATEQYGEVSENLQRGNR

SEQ ID NO: 29029 - protein, 28 aa, Artificial Sequence
  Description of Artificial Sequence: Synthetic peptide
DEDEIRTTNPVATENYGVVSMNLQRGNM

SEQ ID NO: 29030 - protein, 30 aa, Artificial Sequence
  Description of Artificial Sequence: Synthetic polypeptide
DEEMIRTTNPVATEQYGSVSQTNLQEDGNP

SEQ ID NO: 29031 - protein, 28 aa, Artificial Sequence
  Description of Artificial Sequence: Synthetic peptide
QEEEIATTNPVATECYGSVVTNLQRGER

SEQ ID NO: 29032 - protein, 31 aa, Artificial Sequence
  Description of Artificial Sequence: Synthetic polypeptide
DEEEIRTTNPVATECYGSVSDTNLQIRNGNW

SEQ ID NO: 29033 - protein, 28 aa, Artificial Sequence
  Description of Artificial Sequence: Synthetic peptide
DENEIRTVNPVATEQYGSVATNLQNGNI

SEQ ID NO: 29034 - protein, 28 aa, Artificial Sequence
  Description of Artificial Sequence: Synthetic peptide
AEEEIRTTNPVSTETYGSVSTNLQHFNR

SEQ ID NO: 29035 - protein, 29 aa, Artificial Sequence
  Description of Artificial Sequence: Synthetic peptide
SEEEIRTTNPVSTEQYGSVSTNLQNRGDA

SEQ ID NO: 29036 - protein, 30 aa, Artificial Sequence
  Description of Artificial Sequence: Synthetic polypeptide
DEEEIRTTNPVATEQYGSVSATGLEREGND

SEQ ID NO: 29037 - protein, 28 aa, Artificial Sequence
  Description of Artificial Sequence: Synthetic peptide
DEEEIMTTNPVATEQYGTVSTNLQHGLA

SEQ ID NO: 29038 - protein, 28 aa, Artificial Sequence
  Description of Artificial Sequence: Synthetic peptide
DEEEIVTTNPVATEVYGSVSTELQVGNS

SEQ ID NO: 29039 - protein, 28 aa, Artificial Sequence
  Description of Artificial Sequence: Synthetic peptide
QESEINTTNPVATEGYGSVSTNLQGGNR

SEQ ID NO: 29040 - protein, 28 aa, Artificial Sequence
  Description of Artificial Sequence: Synthetic peptide
DESEIRSTNPVATEQYGVVATNLQRGER

SEQ ID NO: 29041 - protein, 29 aa, Artificial Sequence
  Description of Artificial Sequence: Synthetic peptide
DEAEIRTTNPVATEQFGSVSEIVLQRGNR

SEQ ID NO: 29042 - protein, 28 aa, Artificial Sequence
  Description of Artificial Sequence: Synthetic peptide
DENEIRTTNPVATEQYGEVSDNLQSGNF

SEQ ID NO: 29043 - protein, 28 aa, Artificial Sequence
  Description of Artificial Sequence: Synthetic peptide
FEEEIRCTNPVATEQYGSVSTNVQRGTH

SEQ ID NO: 29044 - protein, 28 aa, Artificial Sequence
  Description of Artificial Sequence: Synthetic peptide
DENEIRATNPVATEQYGWVSDNLQRGER

SEQ ID NO: 29045 - protein, 28 aa, Artificial Sequence
  Description of Artificial Sequence: Synthetic peptide
DENEIRTTNPVATEEYGSVSTVLQRGEK

SEQ ID NO: 29046 - protein, 28 aa, Artificial Sequence
  Description of Artificial Sequence: Synthetic peptide
DEEEVRTTNPVATEQWGSVSTNLIRGEI

SEQ ID NO: 29047 - protein, 28 aa, Artificial Sequence
  Description of Artificial Sequence: Synthetic peptide
DEEEIRTTNPVATEQYGTVSTELETGNI

SEQ ID NO: 29048 - protein, 28 aa, Artificial Sequence
  Description of Artificial Sequence: Synthetic peptide
DENEIRTTNPVATECYGSVSENLQRGEN

SEQ ID NO: 29049 - protein, 28 aa, Artificial Sequence
  Description of Artificial Sequence: Synthetic peptide
DEEEITATNPVATEQYGAVSTNLERGNF

SEQ ID NO: 29050 - protein, 28 aa, Artificial Sequence
  Description of Artificial Sequence: Synthetic peptide
DEEELRTTNPVASEQYGCVSNNLQRGNQ

SEQ ID NO: 29051 - protein, 28 aa, Artificial Sequence
  Description of Artificial Sequence: Synthetic peptide
DEEEIRTTNPVATEQWGSYDTNDERGNR

SEQ ID NO: 29052 - protein, 28 aa, Artificial Sequence
  Description of Artificial Sequence: Synthetic peptide
DEEEISTTNPAATEQYGSVSTNLQGGDI

SEQ ID NO: 29053 - protein, 29 aa, Artificial Sequence
  Description of Artificial Sequence: Synthetic peptide
CEEEIRTTNPVATEQYGSVSTDLQERGDV

SEQ ID NO: 29054 - protein, 32 aa, Artificial Sequence
  Description of Artificial Sequence: Synthetic polypeptide
DEEEIRTTNPVATEQYGSVSETNLQDRGENED

SEQ ID NO: 29055 - protein, 28 aa, Artificial Sequence
  Description of Artificial Sequence: Synthetic peptide
NEFEIGTTNPVATEQYGSVSENLQRGNM

SEQ ID NO: 29056 - protein, 28 aa, Artificial Sequence
  Description of Artificial Sequence: Synthetic peptide
DEEEIRTTNPVATEQYGSVSTDLEAGED

SEQ ID NO: 29057 - protein, 31 aa, Artificial Sequence
  Description of Artificial Sequence: Synthetic polypeptide
DEEEIRTTNPVATEQYGSVSTNNLQNDGMNV

SEQ ID NO: 29058 - protein, 28 aa, Artificial Sequence
  Description of Artificial Sequence: Synthetic peptide
DEEEIWTTNPVATEHYGHVSTNLDRGNG

SEQ ID NO: 29059 - protein, 28 aa, Artificial Sequence
  Description of Artificial Sequence: Synthetic peptide
DENEIRTTNPVATEQYGVVSEEGQRGNR

SEQ ID NO: 29060 - protein, 28 aa, Artificial Sequence
  Description of Artificial Sequence: Synthetic peptide
DEEEIRCTNPVATEQYGEVSDNQQHGNR

SEQ ID NO: 29061 - protein, 28 aa, Artificial Sequence
  Description of Artificial Sequence: Synthetic peptide
DEEEIRATNPTATEPYGSVATNLQRGND

SEQ ID NO: 29062 - protein, 28 aa, Artificial Sequence
  Description of Artificial Sequence: Synthetic peptide
DEQEIRTTNPVATEQWGSVDTNLQTGNM

SEQ ID NO: 29063 - protein, 28 aa, Artificial Sequence
  Description of Artificial Sequence: Synthetic peptide
AEMEITTTNPVATEGYGSVSTNLQHGNR

SEQ ID NO: 29064 - protein, 28 aa, Artificial Sequence
  Description of Artificial Sequence: Synthetic peptide
DEEEIRTTNPTATEQFGGVSENLQQGNR

SEQ ID NO: 29065 - protein, 28 aa, Artificial Sequence
  Description of Artificial Sequence: Synthetic peptide
DEEEIRTTNPVATEQYGDVSENLMQGNA

SEQ ID NO: 29066 - protein, 28 aa, Artificial Sequence
  Description of Artificial Sequence: Synthetic peptide
DEQEIYATNPVATEQYGSVSTNLQQGNY

SEQ ID NO: 29067 - protein, 29 aa, Artificial Sequence
  Description of Artificial Sequence: Synthetic peptide
DEEEIRTTNPVATEQYGSVETNLEIEGER

SEQ ID NO: 29068 - protein, 28 aa, Artificial Sequence
  Description of Artificial Sequence: Synthetic peptide
SEEEIRTTNPTATECYGSVSTNLQVGNE

SEQ ID NO: 29069 - protein, 30 aa, Artificial Sequence
  Description of Artificial Sequence: Synthetic polypeptide
DEEEIRTTNPVATECYGSVSTNLQIRGEDF

SEQ ID NO: 29070 - protein, 28 aa, Artificial Sequence
  Description of Artificial Sequence: Synthetic peptide
DEEEIRTTNPDATEQYGSVSTNLEPGLP

SEQ ID NO: 29071 - protein, 28 aa, Artificial Sequence
  Description of Artificial Sequence: Synthetic peptide
SEEEIATTNPTATEQYGSVSTNPQRGNQ

SEQ ID NO: 29072 - protein, 30 aa, Artificial Sequence
  Description of Artificial Sequence: Synthetic polypeptide
DEEEVRTTNPVATEQYGSVSINGNLQWGNR

SEQ ID NO: 29073 - protein, 28 aa, Artificial Sequence
  Description of Artificial Sequence: Synthetic peptide
KEDEIRATNPVATEQYGSCSTNLQWGNR

SEQ ID NO: 29074 - protein, 32 aa, Artificial Sequence
  Description of Artificial Sequence: Synthetic polypeptide
DEEEIRTTNPVATEQYGSVSSTENGLVDRGNR

SEQ ID NO: 29075 - protein, 28 aa, Artificial Sequence
  Description of Artificial Sequence: Synthetic peptide
DEEEIRTTNPVATEQYGSVLTLVQAGNQ

SEQ ID NO: 29076 - protein, 28 aa, Artificial Sequence
  Description of Artificial Sequence: Synthetic peptide
AEEEIRATNPVATEVYGNVSTVLQRGNR

SEQ ID NO: 29077 - protein, 30 aa, Artificial Sequence
  Description of Artificial Sequence: Synthetic polypeptide
MENEIRTTNPVATEQYGSVSTDLQREGNDR

SEQ ID NO: 29078 - protein, 28 aa, Artificial Sequence
  Description of Artificial Sequence: Synthetic peptide
DEEEIRTTNPVATEQYGYVSTAGQRGTT

SEQ ID NO: 29079 - protein, 28 aa, Artificial Sequence
  Description of Artificial Sequence: Synthetic peptide
MENEIRTTNPVATEQYGSVSEELQNGNR

SEQ ID NO: 29080 - protein, 30 aa, Artificial Sequence
  Description of Artificial Sequence: Synthetic polypeptide
DEEEIRTTNPVATECYGSVSTNLQHEGEDR

SEQ ID NO: 29081 - protein, 28 aa, Artificial Sequence
  Description of Artificial Sequence: Synthetic peptide
DEQEITTTNPVATEQYGDVSTDLQRGNA

SEQ ID NO: 29082 - protein, 28 aa, Artificial Sequence
  Description of Artificial Sequence: Synthetic peptide
DEEEIRCTNPTATETYGSVSANDQRGNR

SEQ ID NO: 29083 - protein, 28 aa, Artificial Sequence
  Description of Artificial Sequence: Synthetic peptide
DEDEIRTTNPVATEQYGSVAYNLQRLNI

SEQ ID NO: 29084 - protein, 28 aa, Artificial Sequence
  Description of Artificial Sequence: Synthetic peptide
DENEIRTTNPVATEQWGSVSTNEQRGTM

SEQ ID NO: 29085 - protein, 28 aa, Artificial Sequence
  Description of Artificial Sequence: Synthetic peptide
SEEEIRTTNPVATECYGGVSTNEQRGNF

SEQ ID NO: 29086 - protein, 28 aa, Artificial Sequence
  Description of Artificial Sequence: Synthetic peptide
DEEEIRTTNPDATEQYGSVSTNEQWGEM

SEQ ID NO: 29087 - protein, 30 aa, Artificial Sequence
  Description of Artificial Sequence: Synthetic polypeptide
DEEEIRTTNPVATEQYGSVTETGLQQGNGR

SEQ ID NO: 29088 - protein, 29 aa, Artificial Sequence
  Description of Artificial Sequence: Synthetic peptide
REEEIRTTNPVATEPYGSASTQLQRAGNR

SEQ ID NO: 29089 - protein, 28 aa, Artificial Sequence
  Description of Artificial Sequence: Synthetic peptide
GEEEIRCTNPVATEIYGSVSTNLQAPNR

SEQ ID NO: 29090 - protein, 29 aa, Artificial Sequence
  Description of Artificial Sequence: Synthetic peptide
DEEEIRTTNPVATEQYGDVDCTNLQGGNA

SEQ ID NO: 29091 - protein, 28 aa, Artificial Sequence
  Description of Artificial Sequence: Synthetic peptide
DEEEIRCTNPVATEQYGSVSTNPQHGTI

SEQ ID NO: 29092 - protein, 29 aa, Artificial Sequence
  Description of Artificial Sequence: Synthetic peptide
SEEEIRTTNPVATEIYGEVSTENLQQGNR

SEQ ID NO: 29093 - protein, 29 aa, Artificial Sequence
  Description of Artificial Sequence: Synthetic peptide
DEEEIRTTNPVATEQWGSVSENEMMRGNR

SEQ ID NO: 29094 - protein, 28 aa, Artificial Sequence
  Description of Artificial Sequence: Synthetic peptide
KEHEIVTTNPVATEQYGSVSTNLQMGNN

SEQ ID NO: 29095 - protein, 31 aa, Artificial Sequence
  Description of Artificial Sequence: Synthetic polypeptide
DEEEIRTTNPVATEQYGCSVSTWDLQGEGNR

SEQ ID NO: 29096 - protein, 30 aa, Artificial Sequence
  Description of Artificial Sequence: Synthetic polypeptide
DEEEIRTTNPVATEQYGSVSEALQQYGANR

SEQ ID NO: 29097 - protein, 28 aa, Artificial Sequence
  Description of Artificial Sequence: Synthetic peptide
DETEIATTNPVATEMYGSVSVNLQRGNI

SEQ ID NO: 29098 - protein, 29 aa, Artificial Sequence
  Description of Artificial Sequence: Synthetic peptide
DEEEISTTNPVATEQYGSVADNLQREGNV

SEQ ID NO: 29099 - protein, 28 aa, Artificial Sequence
  Description of Artificial Sequence: Synthetic peptide
DEEEIATTNPVATEQYGSASENLQRMQR

SEQ ID NO: 29100 - protein, 28 aa, Artificial Sequence
  Description of Artificial Sequence: Synthetic peptide
DEEEIATVNPVATEQYGEVSENLQRGNL

SEQ ID NO: 29101 - protein, 29 aa, Artificial Sequence
  Description of Artificial Sequence: Synthetic peptide
DEEEIRTTNPVAMCQYGSVSTNLNQRGDP

SEQ ID NO: 29102 - protein, 28 aa, Artificial Sequence
  Description of Artificial Sequence: Synthetic peptide
DENEIRTTNPVATEQYGSVSTELQAGDT

SEQ ID NO: 29103 - protein, 32 aa, Artificial Sequence
  Description of Artificial Sequence: Synthetic polypeptide
DEEEIRTTNPVATEQYGSVDSVTNGLERGINR

SEQ ID NO: 29104 - protein, 28 aa, Artificial Sequence
  Description of Artificial Sequence: Synthetic peptide
DENEIATTNPVATEQYGSVSTELQIGNY

SEQ ID NO: 29105 - protein, 31 aa, Artificial Sequence
  Description of Artificial Sequence: Synthetic polypeptide
DENEIRTTNPVATEQYGSVSETDLQLRGENR

SEQ ID NO: 29106 - protein, 28 aa, Artificial Sequence
  Description of Artificial Sequence: Synthetic peptide
DEQEIRTTNPVATECYGSVSTDLQTGNA

SEQ ID NO: 29107 - protein, 29 aa, Artificial Sequence
  Description of Artificial Sequence: Synthetic peptide
DEEEIRTTNPVCTEHYGSVSMPNLQRGNL

SEQ ID NO: 29108 - protein, 28 aa, Artificial Sequence
  Description of Artificial Sequence: Synthetic peptide
DENEISTTNPVATECYGSVSTDLQRGNA

SEQ ID NO: 29109 - protein, 28 aa, Artificial Sequence
  Description of Artificial Sequence: Synthetic peptide
SEEEIRTTNPVATEWWGSVSTNLMRGNF

SEQ ID NO: 29110 - protein, 28 aa, Artificial Sequence
  Description of Artificial Sequence: Synthetic peptide
DEEEVRCTNPVATEQYGCVSMNLERGNR

SEQ ID NO: 29111 - protein, 29 aa, Artificial Sequence
  Description of Artificial Sequence: Synthetic peptide
DEEEIMTTNPVATEQYGCVSTAPQRGENR

SEQ ID NO: 29112 - protein, 28 aa, Artificial Sequence
  Description of Artificial Sequence: Synthetic peptide
DEEEIRTTNPVATEQYGSVDTELQREEE

SEQ ID NO: 29113 - protein, 28 aa, Artificial Sequence
  Description of Artificial Sequence: Synthetic peptide
DEAEIRTTNPVATEMYGSVSELLQRGAR

SEQ ID NO: 29114 - protein, 28 aa, Artificial Sequence
  Description of Artificial Sequence: Synthetic peptide
DEEEIRTTNPVGTEQFGEVSTNEQRGNA

SEQ ID NO: 29115 - protein, 28 aa, Artificial Sequence
  Description of Artificial Sequence: Synthetic peptide
DEHEIVTTNPVATEQYGAVSTNWQRGNI

SEQ ID NO: 29116 - protein, 28 aa, Artificial Sequence
  Description of Artificial Sequence: Synthetic peptide
SEEEIRTTNPVATEQFGSVSTNPQRGTA

SEQ ID NO: 29117 - protein, 28 aa, Artificial Sequence
  Description of Artificial Sequence: Synthetic peptide
DEEEIRYTNPVATEQYGSVSTDDQEGNI

SEQ ID NO: 29118 - protein, 29 aa, Artificial Sequence
  Description of Artificial Sequence: Synthetic peptide
DEQEIRTTNPVATEQYGSVETNDQRGEER

SEQ ID NO: 29119 - protein, 28 aa, Artificial Sequence
  Description of Artificial Sequence: Synthetic peptide
DEQEIRQTNPVATEQYGCCSTNLQRGDR

SEQ ID NO: 29120 - protein, 28 aa, Artificial Sequence
  Description of Artificial Sequence: Synthetic peptide
DEEEIRATNPVATEQFGEVSTNPQRGNA

SEQ ID NO: 29121 - protein, 28 aa, Artificial Sequence
  Description of Artificial Sequence: Synthetic peptide
VESEISTTNPVATEQYGSVATNLQRGTR

SEQ ID NO: 29122 - protein, 31 aa, Artificial Sequence
  Description of Artificial Sequence: Synthetic polypeptide
DEEEIRTTNPVATEQYGSVSTANPQDNEGNR

SEQ ID NO: 29123 - protein, 30 aa, Artificial Sequence
  Description of Artificial Sequence: Synthetic polypeptide
DEEEIRTTNPVATEQYGSVCSMELQRNGNH

SEQ ID NO: 29124 - protein, 29 aa, Artificial Sequence
  Description of Artificial Sequence: Synthetic peptide
DEEEIRTTNPVASEVYGCVSNNLQREGNR

SEQ ID NO: 29125 - protein, 28 aa, Artificial Sequence
  Description of Artificial Sequence: Synthetic peptide
DEEEIRTTNPVATEIYGSVSTEPQRGDN

SEQ ID NO: 29126 - protein, 30 aa, Artificial Sequence
  Description of Artificial Sequence: Synthetic polypeptide
DENEIRTTNPVATEQYGSVSETNLQIKGNQ

SEQ ID NO: 29127 - protein, 29 aa, Artificial Sequence
  Description of Artificial Sequence: Synthetic peptide
DENEIRTTNPVATECYGVVSTNLQMRGND

SEQ ID NO: 29128 - protein, 28 aa, Artificial Sequence
  Description of Artificial Sequence: Synthetic peptide
DEEEIGATNPVATEQYGSVSINVQYGNR

SEQ ID NO: 29129 - protein, 28 aa, Artificial Sequence
  Description of Artificial Sequence: Synthetic peptide
DECEIRTVNPVSTEQYGSVSTNLQQLNR

SEQ ID NO: 29130 - protein, 30 aa, Artificial Sequence
  Description of Artificial Sequence: Synthetic polypeptide
DEEEIRTTNPVATEQYGVVSTNLQYHGENG

SEQ ID NO: 29131 - protein, 29 aa, Artificial Sequence
  Description of Artificial Sequence: Synthetic peptide
DEEEIRTTNPVSTEQYGSVSDNIQRSGMR

SEQ ID NO: 29132 - protein, 28 aa, Artificial Sequence
  Description of Artificial Sequence: Synthetic peptide
DEDEIRCTNPCSTEQYGSVSTNLQMGNR

SEQ ID NO: 29133 - protein, 29 aa, Artificial Sequence
  Description of Artificial Sequence: Synthetic peptide
DEEEIRTTNPVATEQYGSVSCTDWCHGNR

SEQ ID NO: 29134 - protein, 28 aa, Artificial Sequence
  Description of Artificial Sequence: Synthetic peptide
DEEEIRTTNPVATENYGFVSCNLQQPNR

SEQ ID NO: 29135 - protein, 28 aa, Artificial Sequence
  Description of Artificial Sequence: Synthetic peptide
DEEEIRTTNPVSTEWWGSVSTNLMTGNR

SEQ ID NO: 29136 - protein, 28 aa, Artificial Sequence
  Description of Artificial Sequence: Synthetic peptide
DEEEIRTVNPVSTEQYGSVSTGLQSENR

SEQ ID NO: 29137 - protein, 28 aa, Artificial Sequence
  Description of Artificial Sequence: Synthetic peptide
DEQEIRCTNPVATECYGSVSTNLQLGNA

SEQ ID NO: 29138 - protein, 28 aa, Artificial Sequence
  Description of Artificial Sequence: Synthetic peptide
DEAEIRTTNPVATEMYGWVSTNLQQGQR

SEQ ID NO: 29139 - protein, 32 aa, Artificial Sequence
  Description of Artificial Sequence: Synthetic polypeptide
DEEEIRTTNPVATEQYGSVSITNLVQVEGDNR

SEQ ID NO: 29140 - protein, 28 aa, Artificial Sequence
  Description of Artificial Sequence: Synthetic peptide
QEEEIATTNPVATEQWGSVSTNLQHGNA

SEQ ID NO: 29141 - protein, 31 aa, Artificial Sequence
  Description of Artificial Sequence: Synthetic polypeptide
DEEEIRTTNPVSTEQYGTVSMTNNLQTRGNR

SEQ ID NO: 29142 - protein, 30 aa, Artificial Sequence
  Description of Artificial Sequence: Synthetic polypeptide
DEEEIRTTNPVSTEQYGSVSTQELEERGNR

SEQ ID NO: 29143 - protein, 28 aa, Artificial Sequence
  Description of Artificial Sequence: Synthetic peptide
DEEAIRTTNPVATEQYGSVHTNLNYGGR

SEQ ID NO: 29144 - protein, 28 aa, Artificial Sequence
  Description of Artificial Sequence: Synthetic peptide
DENEIRTTNPVATEQYGSVCENLQFGNI

SEQ ID NO: 29145 - protein, 29 aa, Artificial Sequence
  Description of Artificial Sequence: Synthetic peptide
DEAEICTTNPVATEQYGSVSENLQRGEDR

SEQ ID NO: 29146 - protein, 28 aa, Artificial Sequence
  Description of Artificial Sequence: Synthetic peptide
DEEEIRTTNPVATEQYGSVSENPDRGDA

SEQ ID NO: 29147 - protein, 28 aa, Artificial Sequence
  Description of Artificial Sequence: Synthetic peptide
DEEEIGTVNPVATECYGSVSDNLQHGNR

SEQ ID NO: 29148 - protein, 29 aa, Artificial Sequence
  Description of Artificial Sequence: Synthetic peptide
SEEEITTTNPVATEQYGSVSTNLEQRGDF

SEQ ID NO: 29149 - protein, 28 aa, Artificial Sequence
  Description of Artificial Sequence: Synthetic peptide
DENEIRTTNPVATEQYGSVSEILMRGNA

SEQ ID NO: 29150 - protein, 28 aa, Artificial Sequence
  Description of Artificial Sequence: Synthetic peptide
DEEEIRQTNPVATEQYGATSNNLQRENR

SEQ ID NO: 29151 - protein, 28 aa, Artificial Sequence
  Description of Artificial Sequence: Synthetic peptide
AEEEIRATNPVCTEQYGVVSTNLQRGPR

SEQ ID NO: 29152 - protein, 28 aa, Artificial Sequence
  Description of Artificial Sequence: Synthetic peptide
DEEEIRTTNPVATEQYGSVSTDDEAGNE

SEQ ID NO: 29153 - protein, 28 aa, Artificial Sequence
  Description of Artificial Sequence: Synthetic peptide
DEEEICTTNPVATEQYGSASEVLQRGGR

SEQ ID NO: 29154 - protein, 30 aa, Artificial Sequence
  Description of Artificial Sequence: Synthetic polypeptide
DEEEIRTTNPVATLQYGSVSTPDTQIRGNR

SEQ ID NO: 29155 - protein, 31 aa, Artificial Sequence
  Description of Artificial Sequence: Synthetic polypeptide
DEEEIRTTNPVATEQYGSVSATNLQLDNGND

SEQ ID NO: 29156 - protein, 28 aa, Artificial Sequence
  Description of Artificial Sequence: Synthetic peptide
DEQEIAATNPVATEQYGWVGTNLQRGNR

SEQ ID NO: 29157 - protein, 28 aa, Artificial Sequence
  Description of Artificial Sequence: Synthetic peptide
DEEEIRTTNPVAGEQYGSVSCNAQDGQR

SEQ ID NO: 29158 - protein, 28 aa, Artificial Sequence
  Description of Artificial Sequence: Synthetic peptide
DEEEIRTVNPVATEQYGSVPTNCQRENK

SEQ ID NO: 29159 - protein, 28 aa, Artificial Sequence
  Description of Artificial Sequence: Synthetic peptide
DEHEIRTTNPVATDQYGSVNTQLQRGND

SEQ ID NO: 29160 - protein, 29 aa, Artificial Sequence
  Description of Artificial Sequence: Synthetic peptide
VDEEIRTTNPVAYEQYGSVGTNLQDRGNR

SEQ ID NO: 29161 - protein, 28 aa, Artificial Sequence
  Description of Artificial Sequence: Synthetic peptide
DEEEIRTTNPVATEMYGGVSENEQQGNR

SEQ ID NO: 29162 - protein, 28 aa, Artificial Sequence
  Description of Artificial Sequence: Synthetic peptide
DEQEIVTTNPVSTEQYGSVSNNLQRGNQ

SEQ ID NO: 29163 - protein, 29 aa, Artificial Sequence
  Description of Artificial Sequence: Synthetic peptide
DEEEIRTTNPVATEQYGGVSTNLIDRGVQ

SEQ ID NO: 29164 - protein, 28 aa, Artificial Sequence
  Description of Artificial Sequence: Synthetic peptide
DDEEIRTTNPVGTEGYGSVSSNLQRGDR

SEQ ID NO: 29165 - protein, 28 aa, Artificial Sequence
  Description of Artificial Sequence: Synthetic peptide
DENEIVTTNPVATECYGSVSTDLQRGNF

SEQ ID NO: 29166 - protein, 28 aa, Artificial Sequence
  Description of Artificial Sequence: Synthetic peptide
DENEIRTTNPVATEQYGSVSENLMRGDA

SEQ ID NO: 29167 - protein, 28 aa, Artificial Sequence
  Description of Artificial Sequence: Synthetic peptide
DEEEIRTTNPVAYEMYGSVGNNLERGNR

SEQ ID NO: 29168 - protein, 28 aa, Artificial Sequence
  Description of Artificial Sequence: Synthetic peptide
DEEEIRTTNPVATEQYGSVDTNDDMGND

SEQ ID NO: 29169 - protein, 30 aa, Artificial Sequence
  Description of Artificial Sequence: Synthetic polypeptide
DEEEIRTTNPVATEQYGSVSETDNDDRGER

SEQ ID NO: 29170 - protein, 28 aa, Artificial Sequence
  Description of Artificial Sequence: Synthetic peptide
DEEETRTTNPVSYEQYGSVSTSLQWGNR

SEQ ID NO: 29171 - protein, 28 aa, Artificial Sequence
  Description of Artificial Sequence: Synthetic peptide
DEEEIRSTNPVATEQYGDAATNVQRGNR

SEQ ID NO: 29172 - protein, 28 aa, Artificial Sequence
  Description of Artificial Sequence: Synthetic peptide
DEEYIRTTNPVAYEQYGSVSTPDQRGND

SEQ ID NO: 29173 - protein, 29 aa, Artificial Sequence
  Description of Artificial Sequence: Synthetic peptide
DEEEIRTTNPVATEIYGSVAMNLEREGNR

SEQ ID NO: 29174 - protein, 28 aa, Artificial Sequence
  Description of Artificial Sequence: Synthetic peptide
DEDEIRTTNPVATEIYGDVSTTLQYGNR

SEQ ID NO: 29175 - protein, 28 aa, Artificial Sequence
  Description of Artificial Sequence: Synthetic peptide
DEEEIRSVNPVATEQYGVVSNNLQRGNQ

SEQ ID NO: 29176 - protein, 28 aa, Artificial Sequence
  Description of Artificial Sequence: Synthetic peptide
DEDEINTTNPVATEQYGIVSTNLQRGMH

SEQ ID NO: 29177 - protein, 30 aa, Artificial Sequence
  Description of Artificial Sequence: Synthetic polypeptide
DEEEIRTTNPVCVEQYGSVSTNLQREGEDR

SEQ ID NO: 29178 - protein, 28 aa, Artificial Sequence
  Description of Artificial Sequence: Synthetic peptide
DEEELATTNPVATEQYGSTSTNLQHGER

SEQ ID NO: 29179 - protein, 28 aa, Artificial Sequence
  Description of Artificial Sequence: Synthetic peptide
DEEEIRCTNPVATEIYGCVATNLERGNR

SEQ ID NO: 29180 - protein, 31 aa, Artificial Sequence
  Description of Artificial Sequence: Synthetic polypeptide
DEEEIRTTNPVATEIYGSVSSTNLEVRAGNR

SEQ ID NO: 29181 - protein, 28 aa, Artificial Sequence
  Description of Artificial Sequence: Synthetic peptide
DEHEIATTNPVATEVYGSVSTDLQHGNR

SEQ ID NO: 29182 - protein, 29 aa, Artificial Sequence
  Description of Artificial Sequence: Synthetic peptide
DEEEIRTTNPVATEQWGSVSTIEQNRGDR

SEQ ID NO: 29183 - protein, 30 aa, Artificial Sequence
  Description of Artificial Sequence: Synthetic polypeptide
DEEEIRATNPVATEMYGSVSTNLQDWGNDR

SEQ ID NO: 29184 - protein, 28 aa, Artificial Sequence
  Description of Artificial Sequence: Synthetic peptide
DEEEIRTTNPVATEQYGSVSTDDEPGNV

SEQ ID NO: 29185 - protein, 28 aa, Artificial Sequence
  Description of Artificial Sequence: Synthetic peptide
DEPEIRTTNPVATEQYGWVSENLQMGNT

SEQ ID NO: 29186 - protein, 28 aa, Artificial Sequence
  Description of Artificial Sequence: Synthetic peptide
QEEEIRSTNPVATEQYGSVSTNLQAGMV

SEQ ID NO: 29187 - protein, 28 aa, Artificial Sequence
  Description of Artificial Sequence: Synthetic peptide
SEEEIAATNPVATEQFGSVSTNLQVGNR

SEQ ID NO: 29188 - protein, 29 aa, Artificial Sequence
  Description of Artificial Sequence: Synthetic peptide
DEEEIRTTNPVATEWYGSVSTNLQIIGDQ

SEQ ID NO: 29189 - protein, 30 aa, Artificial Sequence
  Description of Artificial Sequence: Synthetic polypeptide
DETEIRTTNPVATEQYGEVSTNLQERELNR

SEQ ID NO: 29190 - protein, 28 aa, Artificial Sequence
  Description of Artificial Sequence: Synthetic peptide
DEEEIRATNPVATEVYGSVSTNDQNGNE

SEQ ID NO: 29191 - protein, 28 aa, Artificial Sequence
  Description of Artificial Sequence: Synthetic peptide
DENEIRTTNPVATEQYGDVSENLMRGQR

SEQ ID NO: 29192 - protein, 28 aa, Artificial Sequence
  Description of Artificial Sequence: Synthetic peptide
DEEEIATVNPVATEQYGSVANNLQRGNT

SEQ ID NO: 29193 - protein, 28 aa, Artificial Sequence
  Description of Artificial Sequence: Synthetic peptide
DESEIKATNPVATETYGSVSTLLQRGNR

SEQ ID NO: 29194 - protein, 29 aa, Artificial Sequence
  Description of Artificial Sequence: Synthetic peptide
DEQEIRTTNPVATEQYGWVSTNQQIGNER

SEQ ID NO: 29195 - protein, 29 aa, Artificial Sequence
  Description of Artificial Sequence: Synthetic peptide
MENEIRTTNPVATEQYGSVSTNLQNGNDM

SEQ ID NO: 29196 - protein, 28 aa, Artificial Sequence
  Description of Artificial Sequence: Synthetic peptide
DEEEIRTTNPEATEQYGSVSTDEQFGER

SEQ ID NO: 29197 - protein, 28 aa, Artificial Sequence
  Description of Artificial Sequence: Synthetic peptide
SEEEIRTTNPVATEQYGGVSTNEQFGTR

SEQ ID NO: 29198 - protein, 28 aa, Artificial Sequence
  Description of Artificial Sequence: Synthetic peptide
DEEEIASTNPVASEQYGSVSENLQVGNR

SEQ ID NO: 29199 - protein, 28 aa, Artificial Sequence
  Description of Artificial Sequence: Synthetic peptide
AEEEINTTNPVATENYGSASENLQRGNR

SEQ ID NO: 29200 - protein, 31 aa, Artificial Sequence
  Description of Artificial Sequence: Synthetic polypeptide
DEEEIRTTNPVATEQYGSVSDTNLERDGDNP

SEQ ID NO: 29201 - protein, 28 aa, Artificial Sequence
  Description of Artificial Sequence: Synthetic peptide
NECEIRTTNPVATELYGCVSTNDQRGNR

SEQ ID NO: 29202 - protein, 32 aa, Artificial Sequence
  Description of Artificial Sequence: Synthetic polypeptide
DEEEIRTTNPVATEQYGSVDSDTDPLQRGNPR

SEQ ID NO: 29203 - protein, 28 aa, Artificial Sequence
  Description of Artificial Sequence: Synthetic peptide
DEEEIATTNPTATEQYGSVSTNEQNGNE

SEQ ID NO: 29204 - protein, 32 aa, Artificial Sequence
  Description of Artificial Sequence: Synthetic polypeptide
DEEQIRTTNPVATEQYGSVSSTNPLQRGENDR

SEQ ID NO: 29205 - protein, 31 aa, Artificial Sequence
  Description of Artificial Sequence: Synthetic polypeptide
DEEEIRTTNPVATEQYGSVDSDLNLQIGDNR

SEQ ID NO: 29206 - protein, 28 aa, Artificial Sequence
  Description of Artificial Sequence: Synthetic peptide
DEQEIATTNPVATEVYGSVGTNLQVGNR

SEQ ID NO: 29207 - protein, 28 aa, Artificial Sequence
  Description of Artificial Sequence: Synthetic peptide
DEHEIRTTNPVATEQYGSVSEDLQHGNS

SEQ ID NO: 29208 - protein, 28 aa, Artificial Sequence
  Description of Artificial Sequence: Synthetic peptide
REEEIATTNPVATEQYGSVSANPQRGNL

SEQ ID NO: 29209 - protein, 28 aa, Artificial Sequence
  Description of Artificial Sequence: Synthetic peptide
DEEEIRTTNPVATEQYGDVSEDLQTGNH

SEQ ID NO: 29210 - protein, 28 aa, Artificial Sequence
  Description of Artificial Sequence: Synthetic peptide
DEEEIRTTNPVATEQYGDVSENLQTGEN

SEQ ID NO: 29211 - protein, 28 aa, Artificial Sequence
  Description of Artificial Sequence: Synthetic peptide
SEEEIAATNPVATEMYGSVSTNLQRGNF

SEQ ID NO: 29212 - protein, 28 aa, Artificial Sequence
  Description of Artificial Sequence: Synthetic peptide
DEAEIATVNPVATEQYGDVSTNLQRGMR

SEQ ID NO: 29213 - protein, 28 aa, Artificial Sequence
  Description of Artificial Sequence: Synthetic peptide
DETEIRTTNPVATEQYGVVSDGLLRGNR

SEQ ID NO: 29214 - protein, 32 aa, Artificial Sequence
  Description of Artificial Sequence: Synthetic polypeptide
DEEEIRTTNPVATEQYGSVSITGPLQRGDNPR

SEQ ID NO: 29215 - protein, 28 aa, Artificial Sequence
  Description of Artificial Sequence: Synthetic peptide
DEEEIRTTNPVATEQWGSVSTNEMIGNW

SEQ ID NO: 29216 - protein, 28 aa, Artificial Sequence
  Description of Artificial Sequence: Synthetic peptide
DEMEICSTNPVATEQYGSVSTNLQMGNA

SEQ ID NO: 29217 - protein, 28 aa, Artificial Sequence
  Description of Artificial Sequence: Synthetic peptide
DEEEIRTTNPVATACYGSVSTNLQQGLF

SEQ ID NO: 29218 - protein, 29 aa, Artificial Sequence
  Description of Artificial Sequence: Synthetic peptide
SEEEIATTNPVATEQYGGVSENLQDRGNR

SEQ ID NO: 29219 - protein, 28 aa, Artificial Sequence
  Description of Artificial Sequence: Synthetic peptide
QENEIGTTNPVATEIYGSVSTNLQNGNR

SEQ ID NO: 29220 - protein, 28 aa, Artificial Sequence
  Description of Artificial Sequence: Synthetic peptide
DTEEIRTTNPVATCQYGSVSTNEMRGNP

SEQ ID NO: 29221 - protein, 28 aa, Artificial Sequence
  Description of Artificial Sequence: Synthetic peptide
DEEEIRTTNPVATEQYGSVETDEQHGNG

SEQ ID NO: 29222 - protein, 28 aa, Artificial Sequence
  Description of Artificial Sequence: Synthetic peptide
DEEEIRTTNPVAQEQYGSVSTELQPGEF

SEQ ID NO: 29223 - protein, 28 aa, Artificial Sequence
  Description of Artificial Sequence: Synthetic peptide
DEAEIRTTNPVATEGYGSCSTLLQHGNR

SEQ ID NO: 29224 - protein, 29 aa, Artificial Sequence
  Description of Artificial Sequence: Synthetic peptide
QEEEIATTNPVATEQYGSVSTVLQHAGNR

SEQ ID NO: 29225 - protein, 28 aa, Artificial Sequence
  Description of Artificial Sequence: Synthetic peptide
DEEEIRSTNPVATEQYGAVSTGPQRGER

SEQ ID NO: 29226 - protein, 28 aa, Artificial Sequence
  Description of Artificial Sequence: Synthetic peptide
DEQEIYTTNPVATECYGQVSDNLQRGNR

SEQ ID NO: 29227 - protein, 30 aa, Artificial Sequence
  Description of Artificial Sequence: Synthetic polypeptide
DENEIRTTNPVATEQYGSVSATNLQQKGNT

SEQ ID NO: 29228 - protein, 28 aa, Artificial Sequence
  Description of Artificial Sequence: Synthetic peptide
SEEEIRTTNPVATEKWGSWSTNLQEGNR

SEQ ID NO: 29229 - protein, 31 aa, Artificial Sequence
  Description of Artificial Sequence: Synthetic polypeptide
DEEEIRTTNPVATEQYGSVSDTNGLVERGER

SEQ ID NO: 29230 - protein, 28 aa, Artificial Sequence
  Description of Artificial Sequence: Synthetic peptide
DEEEIRTTNPVATECYGIVSTVLQRGDL

SEQ ID NO: 29231 - protein, 28 aa, Artificial Sequence
  Description of Artificial Sequence: Synthetic peptide
DEQEIATVNPVATEQYGSASTNLQHGNR

SEQ ID NO: 29232 - protein, 30 aa, Artificial Sequence
  Description of Artificial Sequence: Synthetic polypeptide
DEEEIRCTNPVATEQYGSVSTNVQTAAGNR

SEQ ID NO: 29233 - protein, 28 aa, Artificial Sequence
  Description of Artificial Sequence: Synthetic peptide
DEEELRTTNPVATEQFGTVSTNQQRGTR

SEQ ID NO: 29234 - protein, 28 aa, Artificial Sequence
  Description of Artificial Sequence: Synthetic peptide
DEEEIAATNPVATENYGWVATNLQRGNR

SEQ ID NO: 29235 - protein, 28 aa, Artificial Sequence
  Description of Artificial Sequence: Synthetic peptide
DEEEIKTTNPVATEQYGDTGENLQRGNR

SEQ ID NO: 29236 - protein, 28 aa, Artificial Sequence
  Description of Artificial Sequence: Synthetic peptide
DEEELRTVNPVSTEQYGTVSTNLQRGNQ

SEQ ID NO: 29237 - protein, 32 aa, Artificial Sequence
  Description of Artificial Sequence: Synthetic polypeptide
DEEEIRTTNPVATEQYGSVQSATNLEQRNGNF

SEQ ID NO: 29238 - protein, 29 aa, Artificial Sequence
  Description of Artificial Sequence: Synthetic peptide
DEEEIRTTNPVATEQYGDVSENLQNQGNA

SEQ ID NO: 29239 - protein, 30 aa, Artificial Sequence
  Description of Artificial Sequence: Synthetic polypeptide
DEHEIRTTNPVATEQYGSVSEMNLQHNGNR

SEQ ID NO: 29240 - protein, 28 aa, Artificial Sequence
  Description of Artificial Sequence: Synthetic peptide
DENEIATTNPVATECYGDVSTNLQRENR

SEQ ID NO: 29241 - protein, 28 aa, Artificial Sequence
  Description of Artificial Sequence: Synthetic peptide
DEEEIRATNPVAHEQYGSVSTNLQQGTA

SEQ ID NO: 29242 - protein, 28 aa, Artificial Sequence
  Description of Artificial Sequence: Synthetic peptide
DENEIRTTNPVATEQYGDVSENLQHGNQ

SEQ ID NO: 29243 - protein, 30 aa, Artificial Sequence
  Description of Artificial Sequence: Synthetic polypeptide
QEEEIRTTNPVATEQYGDVSEMNLQREGNR

SEQ ID NO: 29244 - protein, 30 aa, Artificial Sequence
  Description of Artificial Sequence: Synthetic polypeptide
DEEEIRTTNPVATEQYGVVYSTNLQGGANE

SEQ ID NO: 29245 - protein, 29 aa, Artificial Sequence
  Description of Artificial Sequence: Synthetic peptide
DEQEIRTTNPVATEQYGSVSDNLQIGNDM

SEQ ID NO: 29246 - protein, 28 aa, Artificial Sequence
  Description of Artificial Sequence: Synthetic peptide
DEEEICCTNPVATEQFGSVSTNWQQGNR

SEQ ID NO: 29247 - protein, 28 aa, Artificial Sequence
  Description of Artificial Sequence: Synthetic peptide
SEEEIRATNPVATEQYGEVSENLQRGNQ

SEQ ID NO: 29248 - protein, 28 aa, Artificial Sequence
  Description of Artificial Sequence: Synthetic peptide
DEEEICTTNPVATEQYGDVSTVLQRGML

SEQ ID NO: 29249 - protein, 28 aa, Artificial Sequence
  Description of Artificial Sequence: Synthetic peptide
QEEEIRTTNPCATEQYGSVSTIIQRGNA

SEQ ID NO: 29250 - protein, 29 aa, Artificial Sequence
  Description of Artificial Sequence: Synthetic peptide
DEEEIRTTNPISTEQYGCVSATNLERGNR

SEQ ID NO: 29251 - protein, 28 aa, Artificial Sequence
  Description of Artificial Sequence: Synthetic peptide
DENEIATTNPVATEQYGSVSTNLQHGEM

SEQ ID NO: 29252 - protein, 28 aa, Artificial Sequence
  Description of Artificial Sequence: Synthetic peptide
DEEEIRTTNPVAYECYGSVFYNLQPGNR

SEQ ID NO: 29253 - protein, 29 aa, Artificial Sequence
  Description of Artificial Sequence: Synthetic peptide
DEEEIRTTNPVATEQWGSVSENEQMRGNA

SEQ ID NO: 29254 - protein, 29 aa, Artificial Sequence
  Description of Artificial Sequence: Synthetic peptide
DESEIRCTNPVATEQYGSASTNLQSGDNR

SEQ ID NO: 29255 - protein, 30 aa, Artificial Sequence
  Description of Artificial Sequence: Synthetic polypeptide
DEEEIATTNPVATEQYGSVSTNEQIEGDNR

SEQ ID NO: 29256 - protein, 30 aa, Artificial Sequence
  Description of Artificial Sequence: Synthetic polypeptide
DEEEIRTTNPVATEQYGSVSTDLQESGNDN

SEQ ID NO: 29257 - protein, 28 aa, Artificial Sequence
  Description of Artificial Sequence: Synthetic peptide
DEEELRTTNPVCTEQYGSVSTNLQVPND

SEQ ID NO: 29258 - protein, 31 aa, Artificial Sequence
  Description of Artificial Sequence: Synthetic polypeptide
DEEEIRTTNPVATEQYGSVSTPNLQDPGDNP

SEQ ID NO: 29259 - protein, 28 aa, Artificial Sequence
  Description of Artificial Sequence: Synthetic peptide
DENEIATTNPVATECYGSVSTDLQRGER

SEQ ID NO: 29260 - protein, 29 aa, Artificial Sequence
  Description of Artificial Sequence: Synthetic peptide
DENEIRTTNPVATEQYGSVSTNLQHGEEN

SEQ ID NO: 29261 - protein, 29 aa, Artificial Sequence
  Description of Artificial Sequence: Synthetic peptide
DEEEIRTTNPVATEQWGSVSTNEQMQGNM

SEQ ID NO: 29262 - protein, 28 aa, Artificial Sequence
  Description of Artificial Sequence: Synthetic peptide
DEEEISTTNPVATEVYGSVSDELQRGAR

SEQ ID NO: 29263 - protein, 31 aa, Artificial Sequence
  Description of Artificial Sequence: Synthetic polypeptide
DEQEIRTTNPVATEQYGSVSTPNLQREGDDR

SEQ ID NO: 29264 - protein, 28 aa, Artificial Sequence
  Description of Artificial Sequence: Synthetic peptide
DENEIRTTNPVATEWYGSVSENEQRGNF

SEQ ID NO: 29265 - protein, 30 aa, Artificial Sequence
  Description of Artificial Sequence: Synthetic polypeptide
DEEEIRTTNPVATEQYGGVISECNLQRGNE

SEQ ID NO: 29266 - protein, 28 aa, Artificial Sequence
  Description of Artificial Sequence: Synthetic peptide
DEEEIRTTNPVATQCYGFVHTNLQDGNR

SEQ ID NO: 29267 - protein, 28 aa, Artificial Sequence
  Description of Artificial Sequence: Synthetic peptide
DEEEIAATNPVATEQYGVVSENLQRGDR

SEQ ID NO: 29268 - protein, 30 aa, Artificial Sequence
  Description of Artificial Sequence: Synthetic polypeptide
DEEEIRTTNPVATEQYGSVSTNLQDDKGEA

SEQ ID NO: 29269 - protein, 28 aa, Artificial Sequence
  Description of Artificial Sequence: Synthetic peptide
DEEELATTNPVATEQFGSVSSNLQRGNI

SEQ ID NO: 29270 - protein, 30 aa, Artificial Sequence
  Description of Artificial Sequence: Synthetic polypeptide
DEEEIRQTNPVATEQYGSVSTMPLQHGDNR

SEQ ID NO: 29271 - protein, 28 aa, Artificial Sequence
  Description of Artificial Sequence: Synthetic peptide
DEEEIRQTNPVATEQYGSASTGEQRGNN

SEQ ID NO: 29272 - protein, 28 aa, Artificial Sequence
  Description of Artificial Sequence: Synthetic peptide
DENEIRTTNPVATEQWGNVSENLQRGNW

SEQ ID NO: 29273 - protein, 28 aa, Artificial Sequence
  Description of Artificial Sequence: Synthetic peptide
DEHEIRCTNPVATEQYGDVSENLQQGNR

SEQ ID NO: 29274 - protein, 28 aa, Artificial Sequence
  Description of Artificial Sequence: Synthetic peptide
DEEEIRTTNPVATELYGFVSTNIQRPGR

SEQ ID NO: 29275 - protein, 28 aa, Artificial Sequence
  Description of Artificial Sequence: Synthetic peptide
QEQEIRATNPVATEQYGSVSTNLQRGGM

SEQ ID NO: 29276 - protein, 28 aa, Artificial Sequence
  Description of Artificial Sequence: Synthetic peptide
QEEEIATTNPVATECYGVVSTNLQNGNR

SEQ ID NO: 29277 - protein, 28 aa, Artificial Sequence
  Description of Artificial Sequence: Synthetic peptide
DDEEIRTTNPVATECWGSVSENLMRGNR

SEQ ID NO: 29278 - protein, 28 aa, Artificial Sequence
  Description of Artificial Sequence: Synthetic peptide
DEQEIVTTNPVATEHYGSVGTNLQPGNR

SEQ ID NO: 29279 - protein, 29 aa, Artificial Sequence
  Description of Artificial Sequence: Synthetic peptide
AEEEIRTTNPVATEQYGDASTNLQRAGNQ

SEQ ID NO: 29280 - protein, 29 aa, Artificial Sequence
  Description of Artificial Sequence: Synthetic peptide
DEHEIRTTNPVATEQYGSVSSNLQYHGNH

SEQ ID NO: 29281 - protein, 29 aa, Artificial Sequence
  Description of Artificial Sequence: Synthetic peptide
HEEEIRTTNPVATEQYGQVSENLQRPENR

SEQ ID NO: 29282 - protein, 30 aa, Artificial Sequence
  Description of Artificial Sequence: Synthetic polypeptide
AEEEIRTTNPCATEQYGSASTNLQRAGNDR

SEQ ID NO: 29283 - protein, 28 aa, Artificial Sequence
  Description of Artificial Sequence: Synthetic peptide
DEEEIATTNPVATEQYGSVDTDLQHGNA

SEQ ID NO: 29284 - protein, 28 aa, Artificial Sequence
  Description of Artificial Sequence: Synthetic peptide
DEVEIATTNPVATEQYGSVSENLQNGNA

SEQ ID NO: 29285 - protein, 29 aa, Artificial Sequence
  Description of Artificial Sequence: Synthetic peptide
MEEEIRTTNPVATEQYGSVSTDLQDIGND

SEQ ID NO: 29286 - protein, 28 aa, Artificial Sequence
  Description of Artificial Sequence: Synthetic peptide
DEFEIATTNPVATEQWGSVSTNLQGGNF

SEQ ID NO: 29287 - protein, 28 aa, Artificial Sequence
  Description of Artificial Sequence: Synthetic peptide
DEVEIRTTNPVATECYGTVSTDLQHGNR

SEQ ID NO: 29288 - protein, 29 aa, Artificial Sequence
  Description of Artificial Sequence: Synthetic peptide
DEQEIRTTNPVATEQYGSMATNLQEAGNR

SEQ ID NO: 29289 - protein, 28 aa, Artificial Sequence
  Description of Artificial Sequence: Synthetic peptide
AENEICTTNPVATEQYGEVSDNLQRGNR

SEQ ID NO: 29290 - protein, 30 aa, Artificial Sequence
  Description of Artificial Sequence: Synthetic polypeptide
DEEEIRTTNPVATEQYGDVSCEDLQRGNDR

SEQ ID NO: 29291 - protein, 28 aa, Artificial Sequence
  Description of Artificial Sequence: Synthetic peptide
QENEIRTTNPVATECYGSVSTNLQYGNT

SEQ ID NO: 29292 - protein, 28 aa, Artificial Sequence
  Description of Artificial Sequence: Synthetic peptide
DENEIRTTNPVATECYGSVSTDLQQGNM

SEQ ID NO: 29293 - protein, 28 aa, Artificial Sequence
  Description of Artificial Sequence: Synthetic peptide
DEEEIRTTNPVATQQYGSVSHNDLPGNR

SEQ ID NO: 29294 - protein, 28 aa, Artificial Sequence
  Description of Artificial Sequence: Synthetic peptide
DEEEIRTTNPVATEQWGSVSENEMRGNM

SEQ ID NO: 29295 - protein, 29 aa, Artificial Sequence
  Description of Artificial Sequence: Synthetic peptide
DEEEIRATNPTATEVYGSVSTNLQRGNWE

SEQ ID NO: 29296 - protein, 30 aa, Artificial Sequence
  Description of Artificial Sequence: Synthetic polypeptide
SEEEIRTTNPVATEQFGSVSTNLQREGENF

SEQ ID NO: 29297 - protein, 28 aa, Artificial Sequence
  Description of Artificial Sequence: Synthetic peptide
DEEEIRTTNPVATEQYGIVTTALQHGNA

SEQ ID NO: 29298 - protein, 29 aa, Artificial Sequence
  Description of Artificial Sequence: Synthetic peptide
DEEEIRTTNPVATEQYGIVSDNLQRAGMM

SEQ ID NO: 29299 - protein, 31 aa, Artificial Sequence
  Description of Artificial Sequence: Synthetic polypeptide
DEEEIRTTNPVATEQYGSVSETNPDQRGDNN

SEQ ID NO: 29300 - protein, 28 aa, Artificial Sequence
  Description of Artificial Sequence: Synthetic peptide
DEEEIRCTNPVAVEQYGSISTDLQRGGR

SEQ ID NO: 29301 - protein, 28 aa, Artificial Sequence
  Description of Artificial Sequence: Synthetic peptide
DEEEIRTVNPVATECYGSVSTELQWGDR

SEQ ID NO: 29302 - protein, 28 aa, Artificial Sequence
  Description of Artificial Sequence: Synthetic peptide
DEQEITTTNPVATECYGSVSTNLQQGNW

SEQ ID NO: 29303 - protein, 29 aa, Artificial Sequence
  Description of Artificial Sequence: Synthetic peptide
DEEEIRTTNPVAYETYGCVSNNLQREGNR

SEQ ID NO: 29304 - protein, 30 aa, Artificial Sequence
  Description of Artificial Sequence: Synthetic polypeptide
DEEEIRTTNPVATEQYGSVSTEPLQVRGES

SEQ ID NO: 29305 - protein, 29 aa, Artificial Sequence
  Description of Artificial Sequence: Synthetic peptide
DEDEISTTNPVATEQYGSTATNLQIRGNR

SEQ ID NO: 29306 - protein, 31 aa, Artificial Sequence
  Description of Artificial Sequence: Synthetic polypeptide
DEEEIRTTNPVATEQYGSYVESTPPLDRGNR

SEQ ID NO: 29307 - protein, 28 aa, Artificial Sequence
  Description of Artificial Sequence: Synthetic peptide
DEEEIRTTNPFATEQYGSVSTDQERGNL

SEQ ID NO: 29308 - protein, 28 aa, Artificial Sequence
  Description of Artificial Sequence: Synthetic peptide
DEEEIRTTNPVATEQYGSVDTALEYGNW

SEQ ID NO: 29309 - protein, 29 aa, Artificial Sequence
  Description of Artificial Sequence: Synthetic peptide
DEEEIRTTNPVATEQWGSVSTNEMQNGNF

SEQ ID NO: 29310 - protein, 30 aa, Artificial Sequence
  Description of Artificial Sequence: Synthetic polypeptide
DEEVIRTTNPVSTEQYGHVSDTNLQLRGNR

SEQ ID NO: 29311 - protein, 28 aa, Artificial Sequence
  Description of Artificial Sequence: Synthetic peptide
MEQEIRTTNPVATECYGSVSENLQRGNA

SEQ ID NO: 29312 - protein, 28 aa, Artificial Sequence
  Description of Artificial Sequence: Synthetic peptide
SEEEIRTTNPTATEQYGSVSTNPQLGTR

SEQ ID NO: 29313 - protein, 28 aa, Artificial Sequence
  Description of Artificial Sequence: Synthetic peptide
NEEEIRTTNPVATEQYGSCSENLQRGPA

SEQ ID NO: 29314 - protein, 29 aa, Artificial Sequence
  Description of Artificial Sequence: Synthetic peptide
DEEEIRTTNPVATEQYGMSVSDNLMSGNV

SEQ ID NO: 29315 - protein, 28 aa, Artificial Sequence
  Description of Artificial Sequence: Synthetic peptide
DEGEITTVNPVATEQYGEVSTNLQRGNA

SEQ ID NO: 29316 - protein, 28 aa, Artificial Sequence
  Description of Artificial Sequence: Synthetic peptide
DEEEIRTTNPVATEQYGSVETNDQWGDN

SEQ ID NO: 29317 - protein, 31 aa, Artificial Sequence
  Description of Artificial Sequence: Synthetic polypeptide
DEEEIRTTNPVATEQYGSVSETNLEETGNDR

SEQ ID NO: 29318 - protein, 28 aa, Artificial Sequence
  Description of Artificial Sequence: Synthetic peptide
DENEIRTTNPVATECYGSVSTDLQHGNV

SEQ ID NO: 29319 - protein, 29 aa, Artificial Sequence
  Description of Artificial Sequence: Synthetic peptide
DENEINSTNPVATENYGSVSTNLQSRGNR

SEQ ID NO: 29320 - protein, 28 aa, Artificial Sequence
  Description of Artificial Sequence: Synthetic peptide
SEEEIRTTNPVATEQYGSVSTNWQFGPH

SEQ ID NO: 29321 - protein, 31 aa, Artificial Sequence
  Description of Artificial Sequence: Synthetic polypeptide
DEEEIRTTNPVATEQYGSVSETNLEDRGNDQ

SEQ ID NO: 29322 - protein, 30 aa, Artificial Sequence
  Description of Artificial Sequence: Synthetic polypeptide
DEEEIRTTNPVAHERYGSVGTMNLQDRGNR

SEQ ID NO: 29323 - protein, 28 aa, Artificial Sequence
  Description of Artificial Sequence: Synthetic peptide
DEQEIVCTNPVATEHYGWVSTNLQRGNR

SEQ ID NO: 29324 - protein, 30 aa, Artificial Sequence
  Description of Artificial Sequence: Synthetic polypeptide
DEEEIRTTNPVCTEQYGSVSTDLQQQYGNR

SEQ ID NO: 29325 - protein, 29 aa, Artificial Sequence
  Description of Artificial Sequence: Synthetic peptide
SEEEIRATNPVATEIYGGVSTGNLQRGNR

SEQ ID NO: 29326 - protein, 28 aa, Artificial Sequence
  Description of Artificial Sequence: Synthetic peptide
YEQEIRTTNPVATEQYGSASSNLQHGNR

SEQ ID NO: 29327 - protein, 28 aa, Artificial Sequence
  Description of Artificial Sequence: Synthetic peptide
MEEEIATTNPVATEQYGSVSDNFNRGNR

SEQ ID NO: 29328 - protein, 29 aa, Artificial Sequence
  Description of Artificial Sequence: Synthetic peptide
DEEEICTTNPVATEQYGSVSDVLQHAGNR

SEQ ID NO: 29329 - protein, 29 aa, Artificial Sequence
  Description of Artificial Sequence: Synthetic peptide
DEEEIRTTNPVATECFGCVSTNLQQEGNR

SEQ ID NO: 29330 - protein, 28 aa, Artificial Sequence
  Description of Artificial Sequence: Synthetic peptide
REEEIRTTNPVATEQYGSVATALQNGFR

SEQ ID NO: 29331 - protein, 28 aa, Artificial Sequence
  Description of Artificial Sequence: Synthetic peptide
DEEEIRTTNPVATECYGSVSECEQRENR

SEQ ID NO: 29332 - protein, 28 aa, Artificial Sequence
  Description of Artificial Sequence: Synthetic peptide
DEEEIRTTNPVATEQYGWVSENDQAGNY

SEQ ID NO: 29333 - protein, 28 aa, Artificial Sequence
  Description of Artificial Sequence: Synthetic peptide
SEEEIRTTNPVATEQFGSVSTNPQRGTN

SEQ ID NO: 29334 - protein, 28 aa, Artificial Sequence
  Description of Artificial Sequence: Synthetic peptide
DESEIGTTNPVATEQYGDVSINLQRGQR

SEQ ID NO: 29335 - protein, 30 aa, Artificial Sequence
  Description of Artificial Sequence: Synthetic polypeptide
DEEEIRTTNPVATEQYGSVSTPLQNGDNDN

SEQ ID NO: 29336 - protein, 28 aa, Artificial Sequence
  Description of Artificial Sequence: Synthetic peptide
DEDEIRTTNPVATEQYGEVSTNPQTGNM

SEQ ID NO: 29337 - protein, 28 aa, Artificial Sequence
  Description of Artificial Sequence: Synthetic peptide
DENEIRSTNPVASEQYGSVSTDLQQGNR

SEQ ID NO: 29338 - protein, 28 aa, Artificial Sequence
  Description of Artificial Sequence: Synthetic peptide
DEGEIATTNPVATEQYGSVCVNLQRGTR

SEQ ID NO: 29339 - protein, 31 aa, Artificial Sequence
  Description of Artificial Sequence: Synthetic polypeptide
DEEEIRTTNPVATEQYGSVSTELQEHEGNDR

SEQ ID NO: 29340 - protein, 30 aa, Artificial Sequence
  Description of Artificial Sequence: Synthetic polypeptide
NEHEIRTTNPVATEQYGSVSCTNLQERGNS

SEQ ID NO: 29341 - protein, 28 aa, Artificial Sequence
  Description of Artificial Sequence: Synthetic peptide
DEEELRSTNPVASEQYGVVSTNLQRGNQ

SEQ ID NO: 29342 - protein, 28 aa, Artificial Sequence
  Description of Artificial Sequence: Synthetic peptide
DENEIAQTNPVATEQYGSVSENLQRGNA

SEQ ID NO: 29343 - protein, 28 aa, Artificial Sequence
  Description of Artificial Sequence: Synthetic peptide
DEMEIRTTNPVATEQYGQVATNDQHGNR

SEQ ID NO: 29344 - protein, 28 aa, Artificial Sequence
  Description of Artificial Sequence: Synthetic peptide
DEEEIRTTNPVATEQYGDVSENLQHGQQ

SEQ ID NO: 29345 - protein, 28 aa, Artificial Sequence
  Description of Artificial Sequence: Synthetic peptide
DEEEIRATNPTATEQYGSVSENEQQGNR

SEQ ID NO: 29346 - protein, 28 aa, Artificial Sequence
  Description of Artificial Sequence: Synthetic peptide
DEQEIRTTNPVATEQYGSVSEDIQHGNR

SEQ ID NO: 29347 - protein, 28 aa, Artificial Sequence
  Description of Artificial Sequence: Synthetic peptide
DEVEITTTNPVATECYGEVSTNLQRGNS

SEQ ID NO: 29348 - protein, 30 aa, Artificial Sequence
  Description of Artificial Sequence: Synthetic polypeptide
DEEEIRTTNPVATEQYGSVSTELQDVDGNW

SEQ ID NO: 29349 - protein, 28 aa, Artificial Sequence
  Description of Artificial Sequence: Synthetic peptide
DEEEIRATNPVSTECYGSVSTNDQRGNV

SEQ ID NO: 29350 - protein, 31 aa, Artificial Sequence
  Description of Artificial Sequence: Synthetic polypeptide
DEECIRTTNPVATFQYGSVSTNSLQPRGDNR

SEQ ID NO: 29351 - protein, 30 aa, Artificial Sequence
  Description of Artificial Sequence: Synthetic polypeptide
DEEEIATTNPVATEQYGSVSTNPQDNEGNR

SEQ ID NO: 29352 - protein, 28 aa, Artificial Sequence
  Description of Artificial Sequence: Synthetic peptide
DEEEIRTTNPVATEQWGSYSDNLQVGDR

SEQ ID NO: 29353 - protein, 29 aa, Artificial Sequence
  Description of Artificial Sequence: Synthetic peptide
DENEIRTTNPVATEQYGSVSENEMMRGNR

SEQ ID NO: 29354 - protein, 28 aa, Artificial Sequence
  Description of Artificial Sequence: Synthetic peptide
VEQEIATTNPVATEMYGWVSTNLQRGNR

SEQ ID NO: 29355 - protein, 28 aa, Artificial Sequence
  Description of Artificial Sequence: Synthetic peptide
DEEEIRTTNPVATEIYGTVATNLQRGDM

SEQ ID NO: 29356 - protein, 28 aa, Artificial Sequence
  Description of Artificial Sequence: Synthetic peptide
DEEEIRATNPVATEIYGSVSEDLQRGNV

SEQ ID NO: 29357 - protein, 28 aa, Artificial Sequence
  Description of Artificial Sequence: Synthetic peptide
DEEEIRTTNPVATEQYGSVSTGPDNGNF

SEQ ID NO: 29358 - protein, 28 aa, Artificial Sequence
  Description of Artificial Sequence: Synthetic peptide
DEEEIRTTNPVATEVYGDVSTNLQHMQR

SEQ ID NO: 29359 - protein, 28 aa, Artificial Sequence
  Description of Artificial Sequence: Synthetic peptide
DENEIGTTNPVATEQYGSVDTNLQQGDR

SEQ ID NO: 29360 - protein, 28 aa, Artificial Sequence
  Description of Artificial Sequence: Synthetic peptide
QEQEIATTNPVATEQYGSVSDNLQQGNR

SEQ ID NO: 29361 - protein, 28 aa, Artificial Sequence
  Description of Artificial Sequence: Synthetic peptide
HEEELRTTNPVATEQYGECSTNLQRGMR

SEQ ID NO: 29362 - protein, 29 aa, Artificial Sequence
  Description of Artificial Sequence: Synthetic peptide
DEHEIVTTNPVATEQYGWVSTNLQTRGNH

SEQ ID NO: 29363 - protein, 28 aa, Artificial Sequence
  Description of Artificial Sequence: Synthetic peptide
DEEEIRTTNPVATEQYGSVADELQMGNT

SEQ ID NO: 29364 - protein, 28 aa, Artificial Sequence
  Description of Artificial Sequence: Synthetic peptide
DEEEIRATNPVATEIYGVVSTNLQHGNL

SEQ ID NO: 29365 - protein, 28 aa, Artificial Sequence
  Description of Artificial Sequence: Synthetic peptide
DEEEICCTNPEATEQYGSVSTNLQLGNH

SEQ ID NO: 29366 - protein, 29 aa, Artificial Sequence
  Description of Artificial Sequence: Synthetic peptide
DENEIRTTNPCATEQYGWVSTNLQERGNF

SEQ ID NO: 29367 - protein, 29 aa, Artificial Sequence
  Description of Artificial Sequence: Synthetic peptide
MEEEIRTTNPVATEQYGSVSENLQREGEL

SEQ ID NO: 29368 - protein, 31 aa, Artificial Sequence
  Description of Artificial Sequence: Synthetic polypeptide
SEEEIRTTNPVATEQYGCVSTNGLPQERGNR

SEQ ID NO: 29369 - protein, 28 aa, Artificial Sequence
  Description of Artificial Sequence: Synthetic peptide
DEEEINTTNPVASEVYGEVSCNLQRGNR

SEQ ID NO: 29370 - protein, 29 aa, Artificial Sequence
  Description of Artificial Sequence: Synthetic peptide
DEQEIRTTNPVATEQYGSVSTMLLQHGNT

SEQ ID NO: 29371 - protein, 28 aa, Artificial Sequence
  Description of Artificial Sequence: Synthetic peptide
AEEEIATTNPVATEQYGSVSTNLMRGQQ

SEQ ID NO: 29372 - protein, 31 aa, Artificial Sequence
  Description of Artificial Sequence: Synthetic polypeptide
DEEEIRTTNPVATEQYGCSYVSENLQPRGDR

SEQ ID NO: 29373 - protein, 30 aa, Artificial Sequence
  Description of Artificial Sequence: Synthetic polypeptide
DEEEIRTTNPVATEQYGSVSTNPLQVDGEG

SEQ ID NO: 29374 - protein, 28 aa, Artificial Sequence
  Description of Artificial Sequence: Synthetic peptide
DEVEIRTTNPVATEQFGSVSTNGQQGTR

SEQ ID NO: 29375 - protein, 28 aa, Artificial Sequence
  Description of Artificial Sequence: Synthetic peptide
DEQEIVTTNPVATEQYGSVSENLTHGNR

SEQ ID NO: 29376 - protein, 28 aa, Artificial Sequence
  Description of Artificial Sequence: Synthetic peptide
DENEIRTTNPVATEQYGSVSTNLEHGEL

SEQ ID NO: 29377 - protein, 29 aa, Artificial Sequence
  Description of Artificial Sequence: Synthetic peptide
SEEEIRTTNPVATEQYGSVSENLQERGTH

SEQ ID NO: 29378 - protein, 28 aa, Artificial Sequence
  Description of Artificial Sequence: Synthetic peptide
DEEEIRTTNPVATEQWGIVSENLQGGTR

SEQ ID NO: 29379 - protein, 28 aa, Artificial Sequence
  Description of Artificial Sequence: Synthetic peptide
SEEEIRTTNPVATEQYGSVSENPQIGTR

SEQ ID NO: 29380 - protein, 28 aa, Artificial Sequence
  Description of Artificial Sequence: Synthetic peptide
CEQEIATTNPVATEQYGSVSTNLQNGNF

SEQ ID NO: 29381 - protein, 30 aa, Artificial Sequence
  Description of Artificial Sequence: Synthetic polypeptide
DEEEIRTTNPVATEQYGSVSTEPLQDKGER

SEQ ID NO: 29382 - protein, 28 aa, Artificial Sequence
  Description of Artificial Sequence: Synthetic peptide
SEEEIRTTNPVATEQYGSMSTDLQRGDS

SEQ ID NO: 29383 - protein, 32 aa, Artificial Sequence
  Description of Artificial Sequence: Synthetic polypeptide
DEEEIRTTNPTATEQYGSVSTMNLQDREGDNR

SEQ ID NO: 29384 - protein, 30 aa, Artificial Sequence
  Description of Artificial Sequence: Synthetic polypeptide
DEEEIRTTNPVATEQYGDVSCTMNLQVGNV

SEQ ID NO: 29385 - protein, 28 aa, Artificial Sequence
  Description of Artificial Sequence: Synthetic peptide
QEEEIRCTNPVSTEQYGSVSTNLQIGER

SEQ ID NO: 29386 - protein, 32 aa, Artificial Sequence
  Description of Artificial Sequence: Synthetic polypeptide
DEEEIRTTNPVATEQYGSVISTNLPQDRGNTQ

SEQ ID NO: 29387 - protein, 30 aa, Artificial Sequence
  Description of Artificial Sequence: Synthetic polypeptide
DEEEIRTTNPVATEQYGSVSTNLQETDGDY

SEQ ID NO: 29388 - protein, 28 aa, Artificial Sequence
  Description of Artificial Sequence: Synthetic peptide
DEEEIRATNPVATEQYGVVSENLQQGNS

SEQ ID NO: 29389 - protein, 28 aa, Artificial Sequence
  Description of Artificial Sequence: Synthetic peptide
MEEEIATTNPVATEQYGSMSDNLQRGNK

SEQ ID NO: 29390 - protein, 28 aa, Artificial Sequence
  Description of Artificial Sequence: Synthetic peptide
DEEEIRTTNPVATEQYGSVSDPDQNGNI

SEQ ID NO: 29391 - protein, 28 aa, Artificial Sequence
  Description of Artificial Sequence: Synthetic peptide
DEEEIRTTNPVATECYGSVSTELQPGES

SEQ ID NO: 29392 - protein, 30 aa, Artificial Sequence
  Description of Artificial Sequence: Synthetic polypeptide
DEEEIRTTNPVATEQYGSVSTMDLQDGGNS

SEQ ID NO: 29393 - protein, 31 aa, Artificial Sequence
  Description of Artificial Sequence: Synthetic polypeptide
DEEEIRTTNPVATEQYGSVSETNDQRKGEER

SEQ ID NO: 29394 - protein, 29 aa, Artificial Sequence
  Description of Artificial Sequence: Synthetic peptide
DEEEIRTTNPCATECYGSVSENLQSDGNR

SEQ ID NO: 29395 - protein, 28 aa, Artificial Sequence
  Description of Artificial Sequence: Synthetic peptide
DEEEIRTTNPVSTEVYGEASTNLQRGMR

SEQ ID NO: 29396 - protein, 28 aa, Artificial Sequence
  Description of Artificial Sequence: Synthetic peptide
DEEEIRTTNPVATEQYGSVETGEQPGNT

SEQ ID NO: 29397 - protein, 28 aa, Artificial Sequence
  Description of Artificial Sequence: Synthetic peptide
DEVEIRTTNPVATEQYGVVSTNDQYGNQ

SEQ ID NO: 29398 - protein, 28 aa, Artificial Sequence
  Description of Artificial Sequence: Synthetic peptide
DDEELRTTNPIATEQYGSVSTNQQRGDR

SEQ ID NO: 29399 - protein, 28 aa, Artificial Sequence
  Description of Artificial Sequence: Synthetic peptide
DEEEIRTTNPVATELYGLCSTNVQRGNL

SEQ ID NO: 29400 - protein, 31 aa, Artificial Sequence
  Description of Artificial Sequence: Synthetic polypeptide
DEEEIRTTNPVATEQYGSVSTNLQESEGNDW

SEQ ID NO: 29401 - protein, 29 aa, Artificial Sequence
  Description of Artificial Sequence: Synthetic peptide
AENEIRTTNPVATEQYGSASTNLQHAGNR

SEQ ID NO: 29402 - protein, 29 aa, Artificial Sequence
  Description of Artificial Sequence: Synthetic peptide
DEQEIRTTNPVATEIYGCVSATNLERGNR

SEQ ID NO: 29403 - protein, 28 aa, Artificial Sequence
  Description of Artificial Sequence: Synthetic peptide
SEEEIRTTNPVATEQYGGVSENLQFGNH

SEQ ID NO: 29404 - protein, 28 aa, Artificial Sequence
  Description of Artificial Sequence: Synthetic peptide
DEEEIRTTNPVATEVYGSVDTNEQAGNI

SEQ ID NO: 29405 - protein, 28 aa, Artificial Sequence
  Description of Artificial Sequence: Synthetic peptide
DEEEIRTTNPVATEQYGDVSTQLQLNNE

SEQ ID NO: 29406 - protein, 28 aa, Artificial Sequence
  Description of Artificial Sequence: Synthetic peptide
SEEEIATTNPVATELYGSVSTNLQQGNF

SEQ ID NO: 29407 - protein, 28 aa, Artificial Sequence
  Description of Artificial Sequence: Synthetic peptide
DDNEIRTTNPVATEQWGSVSTNLQQGNF

SEQ ID NO: 29408 - protein, 28 aa, Artificial Sequence
  Description of Artificial Sequence: Synthetic peptide
DEQEIRATNPVATEQYGEVSTNLQHGGR

SEQ ID NO: 29409 - protein, 28 aa, Artificial Sequence
  Description of Artificial Sequence: Synthetic peptide
DEEEIRTTNPAATECYGSVSVNLQGGTR

SEQ ID NO: 29410 - protein, 28 aa, Artificial Sequence
  Description of Artificial Sequence: Synthetic peptide
VEEEIRCTNPVATEQYGSVSNNLQRGTQ

SEQ ID NO: 29411 - protein, 29 aa, Artificial Sequence
  Description of Artificial Sequence: Synthetic peptide
DEHEIRTTNPVATEIYGSVSEDLQSRGNR

SEQ ID NO: 29412 - protein, 29 aa, Artificial Sequence
  Description of Artificial Sequence: Synthetic peptide
DEEEIRTTNPVATEQYGSVDSENLQTGEI

SEQ ID NO: 29413 - protein, 28 aa, Artificial Sequence
  Description of Artificial Sequence: Synthetic peptide
DEDEIATTNPVATEQYGSVSTELEHGNR

SEQ ID NO: 29414 - protein, 28 aa, Artificial Sequence
  Description of Artificial Sequence: Synthetic peptide
DEEEIRTTNPVATEQYGSVSDDPQGGNP

SEQ ID NO: 29415 - protein, 28 aa, Artificial Sequence
  Description of Artificial Sequence: Synthetic peptide
DEEEIRTTNPVSTEQWGSVDTNDMRGNR

SEQ ID NO: 29416 - protein, 29 aa, Artificial Sequence
  Description of Artificial Sequence: Synthetic peptide
DEEEIRTTNPVATEQYGSVSDDELQRGGV

SEQ ID NO: 29417 - protein, 28 aa, Artificial Sequence
  Description of Artificial Sequence: Synthetic peptide
DEEEIRTTNPVATEQWGIVSENLQVGNS

SEQ ID NO: 29418 - protein, 28 aa, Artificial Sequence
  Description of Artificial Sequence: Synthetic peptide
CEEEIRSTNPVATECWGSVSTNLQRGGR

SEQ ID NO: 29419 - protein, 28 aa, Artificial Sequence
  Description of Artificial Sequence: Synthetic peptide
DEEEIRTTNPVATECYGVVSTDLQNGER

SEQ ID NO: 29420 - protein, 31 aa, Artificial Sequence
  Description of Artificial Sequence: Synthetic polypeptide
DEEEIRTTNPVATEQYGSVSSTPLQELGNER

SEQ ID NO: 29421 - protein, 28 aa, Artificial Sequence
  Description of Artificial Sequence: Synthetic peptide
SEVEIRTTNPVATEQFGSVSTNEQRGTR

SEQ ID NO: 29422 - protein, 28 aa, Artificial Sequence
  Description of Artificial Sequence: Synthetic peptide
SEEEIVTTNPVATEQFGSVSTNPQRGDR

SEQ ID NO: 29423 - protein, 30 aa, Artificial Sequence
  Description of Artificial Sequence: Synthetic polypeptide
DEEEIRTTNPVATEQYGSVISTNLQIGTDQ

SEQ ID NO: 29424 - protein, 29 aa, Artificial Sequence
  Description of Artificial Sequence: Synthetic peptide
KEEEIRTTNPVATEQYGSVSTDLQDGGNA

SEQ ID NO: 29425 - protein, 30 aa, Artificial Sequence
  Description of Artificial Sequence: Synthetic polypeptide
DEEEIRTTNPVATEQYGSVSTGLQDNKGNE

SEQ ID NO: 29426 - protein, 28 aa, Artificial Sequence
  Description of Artificial Sequence: Synthetic peptide
QEQEIATTNPVATEVYGEVSTNLQRGNR

SEQ ID NO: 29427 - protein, 30 aa, Artificial Sequence
  Description of Artificial Sequence: Synthetic polypeptide
PEEEIRTTNPVAYEQYGSVSITNLQPGDNR

SEQ ID NO: 29428 - protein, 28 aa, Artificial Sequence
  Description of Artificial Sequence: Synthetic peptide
DEEEIATTNPVATEQYGSVDANLQTGNS

SEQ ID NO: 29429 - protein, 31 aa, Artificial Sequence
  Description of Artificial Sequence: Synthetic polypeptide
DEEEIRTTNPVATEQYGSVSTINGQEPEGNR

SEQ ID NO: 29430 - protein, 28 aa, Artificial Sequence
  Description of Artificial Sequence: Synthetic peptide
DEVEIRATNPVATEQYGSVSENLPYGNR

SEQ ID NO: 29431 - protein, 32 aa, Artificial Sequence
  Description of Artificial Sequence: Synthetic polypeptide
DEEEIRTTNPVSTEQYGSVSTTNPLTQRGENR

SEQ ID NO: 29432 - protein, 30 aa, Artificial Sequence
  Description of Artificial Sequence: Synthetic polypeptide
DEEEIRTTNPVATECYGSVSTNLQRAGDYA

SEQ ID NO: 29433 - protein, 28 aa, Artificial Sequence
  Description of Artificial Sequence: Synthetic peptide
DEEEIRTTNPVGTECYGSVSTNLQQGGF

SEQ ID NO: 29434 - protein, 30 aa, Artificial Sequence
  Description of Artificial Sequence: Synthetic polypeptide
DEEEIRTTNPDATEQYGSVFTNDVQRGENR

SEQ ID NO: 29435 - protein, 29 aa, Artificial Sequence
  Description of Artificial Sequence: Synthetic peptide
DEEEIRTTNPVATEQYGDVSENLQRGEDA

SEQ ID NO: 29436 - protein, 28 aa, Artificial Sequence
  Description of Artificial Sequence: Synthetic peptide
DESEIRTTNPVAYECYGSVSENLQIGNR

SEQ ID NO: 29437 - protein, 28 aa, Artificial Sequence
  Description of Artificial Sequence: Synthetic peptide
DEAEIACTNPVSTEQYGWVSTNLQRGNR

SEQ ID NO: 29438 - protein, 28 aa, Artificial Sequence
  Description of Artificial Sequence: Synthetic peptide
MEQEIRTTNPVATEQYGEVSTNLQNGNF

SEQ ID NO: 29439 - protein, 28 aa, Artificial Sequence
  Description of Artificial Sequence: Synthetic peptide
DENEIRTTNPVATEQYGIVSENLMQGNR

SEQ ID NO: 29440 - protein, 31 aa, Artificial Sequence
  Description of Artificial Sequence: Synthetic polypeptide
DEEEIRTTNPVATEQYGSVSTNPLVQERGEF

SEQ ID NO: 29441 - protein, 29 aa, Artificial Sequence
  Description of Artificial Sequence: Synthetic peptide
DEEEIRTTNPFATEQYGHVSVTNLQDGNF

SEQ ID NO: 29442 - protein, 28 aa, Artificial Sequence
  Description of Artificial Sequence: Synthetic peptide
DEEEIRTTNPVATECWGSYSTNLQRGDM

SEQ ID NO: 29443 - protein, 31 aa, Artificial Sequence
  Description of Artificial Sequence: Synthetic polypeptide
DEEEIRTTNPVATEQYGSVSTNLQVQNGNDH

SEQ ID NO: 29444 - protein, 28 aa, Artificial Sequence
  Description of Artificial Sequence: Synthetic peptide
DENEIRTTNPFATEQYGSVSTGLQRGED

SEQ ID NO: 29445 - protein, 28 aa, Artificial Sequence
  Description of Artificial Sequence: Synthetic peptide
DEEEIRTTNPVATEQYGSVETDLQGGEV

SEQ ID NO: 29446 - protein, 28 aa, Artificial Sequence
  Description of Artificial Sequence: Synthetic peptide
SEEEIRTTNPVATEQYGSVSTNPQSGTQ

SEQ ID NO: 29447 - protein, 28 aa, Artificial Sequence
  Description of Artificial Sequence: Synthetic peptide
DEEEIRSTNPVATENYGAVSMNLQRGNQ

SEQ ID NO: 29448 - protein, 30 aa, Artificial Sequence
  Description of Artificial Sequence: Synthetic polypeptide
DEEEIATTNPVATEQYGSVSTNLQEYKGER

SEQ ID NO: 29449 - protein, 30 aa, Artificial Sequence
  Description of Artificial Sequence: Synthetic polypeptide
DENEIRTTNPVATEQYGSVSTNLQDIKGNQ

SEQ ID NO: 29450 - protein, 28 aa, Artificial Sequence
  Description of Artificial Sequence: Synthetic peptide
DEEEIRTTNPVGTEQYGVVSENEQRGNI

SEQ ID NO: 29451 - protein, 31 aa, Artificial Sequence
  Description of Artificial Sequence: Synthetic polypeptide
DEEEIRTTNPVATEQYGSMVSDHNLQREGNP

SEQ ID NO: 29452 - protein, 28 aa, Artificial Sequence
  Description of Artificial Sequence: Synthetic peptide
DHEEIRTTNPVATEQYGSVWTNDQPGNP

SEQ ID NO: 29453 - protein, 28 aa, Artificial Sequence
  Description of Artificial Sequence: Synthetic peptide
DENEIRTTNPVATEQWGSASENLQRGMR

SEQ ID NO: 29454 - protein, 32 aa, Artificial Sequence
  Description of Artificial Sequence: Synthetic polypeptide
DEEEIRTTNPTATEQYGSVSTANLQLREGENR

SEQ ID NO: 29455 - protein, 28 aa, Artificial Sequence
  Description of Artificial Sequence: Synthetic peptide
SEEEIRATNPVATEMFGGVSTNLQRGNR

SEQ ID NO: 29456 - protein, 28 aa, Artificial Sequence
  Description of Artificial Sequence: Synthetic peptide
DEEEIRTTNPVATEQYGDVSEDLQHGNA

SEQ ID NO: 29457 - protein, 28 aa, Artificial Sequence
  Description of Artificial Sequence: Synthetic peptide
SEEEIRTTNPTATELYGSVSTNLQNGNT

SEQ ID NO: 29458 - protein, 28 aa, Artificial Sequence
  Description of Artificial Sequence: Synthetic peptide
DENEIATTNPVATEQYGSVSTCLQRGEQ

SEQ ID NO: 29459 - protein, 28 aa, Artificial Sequence
  Description of Artificial Sequence: Synthetic peptide
QEEEIATTNPVATEQYGDVSTIEQRGNR

SEQ ID NO: 29460 - protein, 28 aa, Artificial Sequence
  Description of Artificial Sequence: Synthetic peptide
DEQEIATTNPVSTEMYGWVSTNLQRGNR

SEQ ID NO: 29461 - protein, 29 aa, Artificial Sequence
  Description of Artificial Sequence: Synthetic peptide
DEEEIRTTNPVATEQYGSVSDVLQHAGGR

SEQ ID NO: 29462 - protein, 30 aa, Artificial Sequence
  Description of Artificial Sequence: Synthetic polypeptide
DEEEIRATNPVATEMYGSVISTNLQQGDNR

SEQ ID NO: 29463 - protein, 28 aa, Artificial Sequence
  Description of Artificial Sequence: Synthetic peptide
DEEEIRTTNPVATEQYGSVETNDEPGNV

SEQ ID NO: 29464 - protein, 29 aa, Artificial Sequence
  Description of Artificial Sequence: Synthetic peptide
FEEEIRTTNPVATEGYGSVPTTLQRSGNR

SEQ ID NO: 29465 - protein, 28 aa, Artificial Sequence
  Description of Artificial Sequence: Synthetic peptide
NEEEIRTTNPVATEQYGSVGNNLQRGTQ

SEQ ID NO: 29466 - protein, 30 aa, Artificial Sequence
  Description of Artificial Sequence: Synthetic polypeptide
DEEEIRTTNPVSTEQWGIVSTNLQRAGNDR

SEQ ID NO: 29467 - protein, 28 aa, Artificial Sequence
  Description of Artificial Sequence: Synthetic peptide
MEQEIRTTNPVATEQYGSVSTDLQTGNH

SEQ ID NO: 29468 - protein, 31 aa, Artificial Sequence
  Description of Artificial Sequence: Synthetic polypeptide
DEEEIRTTNPVATEQYGSVSDTADQRKGENR

SEQ ID NO: 29469 - protein, 28 aa, Artificial Sequence
  Description of Artificial Sequence: Synthetic peptide
AEEEIRTTNPVATENYGSCGTNLQRGQR

SEQ ID NO: 29470 - protein, 28 aa, Artificial Sequence
  Description of Artificial Sequence: Synthetic peptide
DEEEIRTTNPVATEVYGDVSTNLQHGQQ

SEQ ID NO: 29471 - protein, 30 aa, Artificial Sequence
  Description of Artificial Sequence: Synthetic polypeptide
DEEEIRTTNPVATEQYGSVSTNLEEIEGER

SEQ ID NO: 29472 - protein, 29 aa, Artificial Sequence
  Description of Artificial Sequence: Synthetic peptide
DEEEIRTTNPVATEIWGSVSTNLQMTGNF

SEQ ID NO: 29473 - protein, 28 aa, Artificial Sequence
  Description of Artificial Sequence: Synthetic peptide
DEEEIRTTNPVASEQYGEVSDNLQIMNR

SEQ ID NO: 29474 - protein, 29 aa, Artificial Sequence
  Description of Artificial Sequence: Synthetic peptide
KEEEIATTNPVATEQYGSVSTDLQRGDDR

SEQ ID NO: 29475 - protein, 28 aa, Artificial Sequence
  Description of Artificial Sequence: Synthetic peptide
DEQEIAATNPVATEVYGWVSTNLQRGNR

SEQ ID NO: 29476 - protein, 28 aa, Artificial Sequence
  Description of Artificial Sequence: Synthetic peptide
HEEEIRTTNPVATEQYGCVSTALQQGDR

SEQ ID NO: 29477 - protein, 30 aa, Artificial Sequence
  Description of Artificial Sequence: Synthetic polypeptide
DEEEIRTTNPVATELYGSVSTNWQRGENTH

SEQ ID NO: 29478 - protein, 29 aa, Artificial Sequence
  Description of Artificial Sequence: Synthetic peptide
DEEEIRSTNPVATEQYGLVSENLQERGND

SEQ ID NO: 29479 - protein, 30 aa, Artificial Sequence
  Description of Artificial Sequence: Synthetic polypeptide
DEEEIRTTNPVATEIYGSVSDTNLERDGND

SEQ ID NO: 29480 - protein, 28 aa, Artificial Sequence
  Description of Artificial Sequence: Synthetic peptide
DEEEIATTNPVATEQYGSVSTNLMHMQR

SEQ ID NO: 29481 - protein, 29 aa, Artificial Sequence
  Description of Artificial Sequence: Synthetic peptide
DEEEIATTNPVATEQYGSVSTDLQTEGER

SEQ ID NO: 29482 - protein, 29 aa, Artificial Sequence
  Description of Artificial Sequence: Synthetic peptide
DENEIRTTNPVATEQWGSVSTNDQIRGNA

SEQ ID NO: 29483 - protein, 28 aa, Artificial Sequence
  Description of Artificial Sequence: Synthetic peptide
DEVEIRTTNPVATEVYGWVSTNVQRGDR

SEQ ID NO: 29484 - protein, 28 aa, Artificial Sequence
  Description of Artificial Sequence: Synthetic peptide
AEEEIRTTNPVATEQYGSVSTDLERGED

SEQ ID NO: 29485 - protein, 28 aa, Artificial Sequence
  Description of Artificial Sequence: Synthetic peptide
DEQEIRTTNPVSTEQYGEVSENLQRGGR

SEQ ID NO: 29486 - protein, 30 aa, Artificial Sequence
  Description of Artificial Sequence: Synthetic polypeptide
NEHEIRTTNPVATEQYGDVSTNLQQRAGNR

SEQ ID NO: 29487 - protein, 32 aa, Artificial Sequence
  Description of Artificial Sequence: Synthetic polypeptide
DEEEIRTTNPVATEQYGSVSTNLQELKGENDR

SEQ ID NO: 29488 - protein, 30 aa, Artificial Sequence
  Description of Artificial Sequence: Synthetic polypeptide
DEEEIRTTNPVATEHYGCTSDTNLQRGENR

SEQ ID NO: 29489 - protein, 29 aa, Artificial Sequence
  Description of Artificial Sequence: Synthetic peptide
DEEEIRTTNPVATEQYGLVSTNLQMGDDQ

SEQ ID NO: 29490 - protein, 31 aa, Artificial Sequence
  Description of Artificial Sequence: Synthetic polypeptide
DEEEIRTTNPVATEQYGCSVSCNLQETGNDR

SEQ ID NO: 29491 - protein, 29 aa, Artificial Sequence
  Description of Artificial Sequence: Synthetic peptide
DEEEVRTTNPVAYEMYGSVSMNLQRNGNR

SEQ ID NO: 29492 - protein, 30 aa, Artificial Sequence
  Description of Artificial Sequence: Synthetic polypeptide
DEEEIRTTNPVATEQYGSVCSSNDQRDENR

SEQ ID NO: 29493 - protein, 28 aa, Artificial Sequence
  Description of Artificial Sequence: Synthetic peptide
AEEEIGTTNPVATEQYGDVSTNLQMGQR

SEQ ID NO: 29494 - protein, 28 aa, Artificial Sequence
  Description of Artificial Sequence: Synthetic peptide
DEEEIRTTNPVATEIYGTVDNNLQTGNR

SEQ ID NO: 29495 - protein, 28 aa, Artificial Sequence
  Description of Artificial Sequence: Synthetic peptide
DMEEIRTTNPDATEQYGSVSTNLQNENT

SEQ ID NO: 29496 - protein, 28 aa, Artificial Sequence
  Description of Artificial Sequence: Synthetic peptide
CEEEIETTNPVATEQYGSVSMNVQRGLR

SEQ ID NO: 29497 - protein, 28 aa, Artificial Sequence
  Description of Artificial Sequence: Synthetic peptide
AEEEIATTNPVATEQYGVVSTNQERGNR

SEQ ID NO: 29498 - protein, 31 aa, Artificial Sequence
  Description of Artificial Sequence: Synthetic polypeptide
DEEEIRTTNPVATEQYGSVSTNLQDVEGNDQ

SEQ ID NO: 29499 - protein, 28 aa, Artificial Sequence
  Description of Artificial Sequence: Synthetic peptide
QEEEIRTTNPVATEMYGSVSANLQRGTS

SEQ ID NO: 29500 - protein, 28 aa, Artificial Sequence
  Description of Artificial Sequence: Synthetic peptide
AEEEITTTNPVATEQYGSVTTNLERGER

SEQ ID NO: 29501 - protein, 28 aa, Artificial Sequence
  Description of Artificial Sequence: Synthetic peptide
DENEIRTTNPVATEQWGSYSEILQRGNR

SEQ ID NO: 29502 - protein, 28 aa, Artificial Sequence
  Description of Artificial Sequence: Synthetic peptide
DEEEIRTTNPTATEQYGEVSENLQRGDH

SEQ ID NO: 29503 - protein, 28 aa, Artificial Sequence
  Description of Artificial Sequence: Synthetic peptide
VEEEIRTVNPVATEQYGSVSTNLQAPNL

SEQ ID NO: 29504 - protein, 31 aa, Artificial Sequence
  Description of Artificial Sequence: Synthetic polypeptide
DEEEIRTTNPVATECYGSVSTNLQDREGNDF

SEQ ID NO: 29505 - protein, 31 aa, Artificial Sequence
  Description of Artificial Sequence: Synthetic polypeptide
DEEEIRTTNPVATEQYGSVSATNLQVNGNDE

SEQ ID NO: 29506 - protein, 28 aa, Artificial Sequence
  Description of Artificial Sequence: Synthetic peptide
DEEEIRATNPVCTEQYGSVSDNLQYGNV

SEQ ID NO: 29507 - protein, 28 aa, Artificial Sequence
  Description of Artificial Sequence: Synthetic peptide
DEEEIATTNPVATEQYGVVSENLQSGNY

SEQ ID NO: 29508 - protein, 31 aa, Artificial Sequence
  Description of Artificial Sequence: Synthetic polypeptide
DEEEIRTTNPVATEQYGSVSTNLQQAGLDYR

SEQ ID NO: 29509 - protein, 28 aa, Artificial Sequence
  Description of Artificial Sequence: Synthetic peptide
DEEEIRQTNPVATEQYGVVSTAEQRGNT

SEQ ID NO: 29510 - protein, 30 aa, Artificial Sequence
  Description of Artificial Sequence: Synthetic polypeptide
QEEEIRTTNPVATEQYGEVSATNLQHAGNR

SEQ ID NO: 29511 - protein, 28 aa, Artificial Sequence
  Description of Artificial Sequence: Synthetic peptide
DEEEIRTTNPVATEQYGWYSTNLQLGEA

SEQ ID NO: 29512 - protein, 29 aa, Artificial Sequence
  Description of Artificial Sequence: Synthetic peptide
DEEEIRATNPVATEQYGSVGATVLQRGNA

SEQ ID NO: 29513 - protein, 28 aa, Artificial Sequence
  Description of Artificial Sequence: Synthetic peptide
DDEEIRTTNPCATEQYGCVATNLERGNR

SEQ ID NO: 29514 - protein, 28 aa, Artificial Sequence
  Description of Artificial Sequence: Synthetic peptide
DEEEISTTNPVATEQYGSVSENLMRGQK

SEQ ID NO: 29515 - protein, 31 aa, Artificial Sequence
  Description of Artificial Sequence: Synthetic polypeptide
DEEEIRTTNPDATEQYGSVSTNLVDRGDNPR

SEQ ID NO: 29516 - protein, 28 aa, Artificial Sequence
  Description of Artificial Sequence: Synthetic peptide
DEEEIRTTNPVASEQYGAVSTELERGND

SEQ ID NO: 29517 - protein, 28 aa, Artificial Sequence
  Description of Artificial Sequence: Synthetic peptide
DEEEIATTNPTATEMYGSVSTNEQRGTR

SEQ ID NO: 29518 - protein, 30 aa, Artificial Sequence
  Description of Artificial Sequence: Synthetic polypeptide
DEEEIRTTNPVATEQYGSVDCTNGQERGND

SEQ ID NO: 29519 - protein, 28 aa, Artificial Sequence
  Description of Artificial Sequence: Synthetic peptide
DEAEINTTNPVSTEQYGDVPTNLQRGNR

SEQ ID NO: 29520 - protein, 28 aa, Artificial Sequence
  Description of Artificial Sequence: Synthetic peptide
DEEEIKTVNPVATEPYGSVSTNLQRGLE

SEQ ID NO: 29521 - protein, 28 aa, Artificial Sequence
  Description of Artificial Sequence: Synthetic peptide
DEHEIRTVNPVATEQYGSVSTALERGNM

SEQ ID NO: 29522 - protein, 28 aa, Artificial Sequence
  Description of Artificial Sequence: Synthetic peptide
DEEEIRTTNPVATECYGSVSTELQHGEN

SEQ ID NO: 29523 - protein, 29 aa, Artificial Sequence
  Description of Artificial Sequence: Synthetic peptide
DEEEIRTTNPVATEQYGIVSTNLMMGGDR

SEQ ID NO: 29524 - protein, 28 aa, Artificial Sequence
  Description of Artificial Sequence: Synthetic peptide
DENEIGTTNPVATEQYGSVSDNLQYGER

SEQ ID NO: 29525 - protein, 28 aa, Artificial Sequence
  Description of Artificial Sequence: Synthetic peptide
DENEIRTTNPCATEQYGSVSTNQQLGNF

SEQ ID NO: 29526 - protein, 28 aa, Artificial Sequence
  Description of Artificial Sequence: Synthetic peptide
VEGEIRTTNPVATEQYGAVSENLQHGNR

SEQ ID NO: 29527 - protein, 30 aa, Artificial Sequence
  Description of Artificial Sequence: Synthetic polypeptide
DEEEIRTVNPVATEQYGWVSSNLQRKGENR

SEQ ID NO: 29528 - protein, 29 aa, Artificial Sequence
  Description of Artificial Sequence: Synthetic peptide
DEEEIRTTNPVAWEQYGSVSVLLQRGDMR

SEQ ID NO: 29529 - protein, 28 aa, Artificial Sequence
  Description of Artificial Sequence: Synthetic peptide
DEGEIRATNPVATEQYGDVSTNIQRGNF

SEQ ID NO: 29530 - protein, 29 aa, Artificial Sequence
  Description of Artificial Sequence: Synthetic peptide
DEEEITTTNPVATEQYGSVSAENLQVGER

SEQ ID NO: 29531 - protein, 28 aa, Artificial Sequence
  Description of Artificial Sequence: Synthetic peptide
DESEIRTTNPVATEQFGCVSNNLQTGNR

SEQ ID NO: 29532 - protein, 30 aa, Artificial Sequence
  Description of Artificial Sequence: Synthetic polypeptide
DEEEIRTTNPVATEQYGSVSTNPQEIGNTN

SEQ ID NO: 29533 - protein, 28 aa, Artificial Sequence
  Description of Artificial Sequence: Synthetic peptide
AENEIATTNPVATEQYGSVSTNQQRGER

SEQ ID NO: 29534 - protein, 28 aa, Artificial Sequence
  Description of Artificial Sequence: Synthetic peptide
DENEIRTTNPVATECYGSVPTNLQHGER

SEQ ID NO: 29535 - protein, 31 aa, Artificial Sequence
  Description of Artificial Sequence: Synthetic polypeptide
DEEEIRTTNPVATEQYGSVETNLVQERGNDF

SEQ ID NO: 29536 - protein, 28 aa, Artificial Sequence
  Description of Artificial Sequence: Synthetic peptide
NEEEIATTNPVATEQYGAASTDLQRGNR

SEQ ID NO: 29537 - protein, 30 aa, Artificial Sequence
  Description of Artificial Sequence: Synthetic polypeptide
DEEEIRTTNPVATEQYGSVSTDLQNEGNDM

SEQ ID NO: 29538 - protein, 28 aa, Artificial Sequence
  Description of Artificial Sequence: Synthetic peptide
DEVEIATTNPVATEMFGSVSENLQRGNR

SEQ ID NO: 29539 - protein, 28 aa, Artificial Sequence
  Description of Artificial Sequence: Synthetic peptide
DEQEIRTTNPVATEQWGSVSENEMRGNR

SEQ ID NO: 29540 - protein, 28 aa, Artificial Sequence
  Description of Artificial Sequence: Synthetic peptide
DEEEIRATNPVATEQYGSVSENLQHGEY

SEQ ID NO: 29541 - protein, 28 aa, Artificial Sequence
  Description of Artificial Sequence: Synthetic peptide
KEEEIATTNPVATECYGSASENLQRGNR

SEQ ID NO: 29542 - protein, 31 aa, Artificial Sequence
  Description of Artificial Sequence: Synthetic polypeptide
DEEEIRQTNPVATEQYGSVSETNLVQVGENR

SEQ ID NO: 29543 - protein, 30 aa, Artificial Sequence
  Description of Artificial Sequence: Synthetic polypeptide
DEEEISTTNPVATECYGSVSTNGLQRGDTR

SEQ ID NO: 29544 - protein, 28 aa, Artificial Sequence
  Description of Artificial Sequence: Synthetic peptide
DENEIATTNPVATEQYGVVSTNLQIGNN

SEQ ID NO: 29545 - protein, 28 aa, Artificial Sequence
  Description of Artificial Sequence: Synthetic peptide
DEEEIRSTNPVATEGYGAVPTVLQRGNR

SEQ ID NO: 29546 - protein, 28 aa, Artificial Sequence
  Description of Artificial Sequence: Synthetic peptide
DEEEIVTTNPVATEMYGSVSENEQSGNR

SEQ ID NO: 29547 - protein, 30 aa, Artificial Sequence
  Description of Artificial Sequence: Synthetic polypeptide
DEQEIRTTNPVATEQYGSVSATNLQRGEDL

SEQ ID NO: 29548 - protein, 31 aa, Artificial Sequence
  Description of Artificial Sequence: Synthetic polypeptide
DEQEIRTTNPVATEQYGSVDSTNDQRGENER

SEQ ID NO: 29549 - protein, 28 aa, Artificial Sequence
  Description of Artificial Sequence: Synthetic peptide
DEEEIRTTNPVSTEVYGSTSTNGQNGNR

SEQ ID NO: 29550 - protein, 32 aa, Artificial Sequence
  Description of Artificial Sequence: Synthetic polypeptide
DEEEIRTTNPTATEQYGSVSTANLQREGDNDR

SEQ ID NO: 29551 - protein, 29 aa, Artificial Sequence
  Description of Artificial Sequence: Synthetic peptide
SEEEIRTTNPVATEQYGSVFSDNLQSGNA

SEQ ID NO: 29552 - protein, 28 aa, Artificial Sequence
  Description of Artificial Sequence: Synthetic peptide
DEEEITTTNPVCTEQYGTVSTNLQYGND

SEQ ID NO: 29553 - protein, 29 aa, Artificial Sequence
  Description of Artificial Sequence: Synthetic peptide
DENEIRTTNPVATEQWGSVSTNLQNQGNA

SEQ ID NO: 29554 - protein, 31 aa, Artificial Sequence
  Description of Artificial Sequence: Synthetic polypeptide
DEEEIRTTNPVATEQYGSVSCTMDLQHGNDR

SEQ ID NO: 29555 - protein, 28 aa, Artificial Sequence
  Description of Artificial Sequence: Synthetic peptide
DEEEIGTTNPTATEQFGSVSTALQRGGR

SEQ ID NO: 29556 - protein, 28 aa, Artificial Sequence
  Description of Artificial Sequence: Synthetic peptide
DENEIKTVNPVATEQYGSVSTNDQHGNR

SEQ ID NO: 29557 - protein, 28 aa, Artificial Sequence
  Description of Artificial Sequence: Synthetic peptide
QEDEIRTTNPVATEQYGSVAENCQRGNR

SEQ ID NO: 29558 - protein, 28 aa, Artificial Sequence
  Description of Artificial Sequence: Synthetic peptide
DEQEIRTTNPVATELWGSVSENLQRGNM

SEQ ID NO: 29559 - protein, 28 aa, Artificial Sequence
  Description of Artificial Sequence: Synthetic peptide
DENEIRTTNPVATECYGSVSTELQGGNH

SEQ ID NO: 29560 - protein, 28 aa, Artificial Sequence
  Description of Artificial Sequence: Synthetic peptide
KEEEIRTTNPVATECYGSVSTELQGGNT

SEQ ID NO: 29561 - protein, 29 aa, Artificial Sequence
  Description of Artificial Sequence: Synthetic peptide
DEEEIRTVNPVATEQYGWVSTNLQESGNE

SEQ ID NO: 29562 - protein, 28 aa, Artificial Sequence
  Description of Artificial Sequence: Synthetic peptide
DEEEIAATNPVATEQYGSVSELLQTGNR

SEQ ID NO: 29563 - protein, 28 aa, Artificial Sequence
  Description of Artificial Sequence: Synthetic peptide
DEYEISTTNPVATEQYGSVSENLQSGNV

SEQ ID NO: 29564 - protein, 28 aa, Artificial Sequence
  Description of Artificial Sequence: Synthetic peptide
SEEEIVTTNPVATEQYGSVSTDPQSGNR

SEQ ID NO: 29565 - protein, 28 aa, Artificial Sequence
  Description of Artificial Sequence: Synthetic peptide
DEVEIATTNPVATELYGSVSTNLQRENF

SEQ ID NO: 29566 - protein, 28 aa, Artificial Sequence
  Description of Artificial Sequence: Synthetic peptide
DEEEIRTTNPAATECFGSVSTNLQNGNH

SEQ ID NO: 29567 - protein, 28 aa, Artificial Sequence
  Description of Artificial Sequence: Synthetic peptide
KEEEIRTTNPVASEQYGVVSTNLQNGDR

SEQ ID NO: 29568 - protein, 28 aa, Artificial Sequence
  Description of Artificial Sequence: Synthetic peptide
DEEEIRTTNPFATEQYGSVSTNQQYGEM

SEQ ID NO: 29569 - protein, 28 aa, Artificial Sequence
  Description of Artificial Sequence: Synthetic peptide
DEEEITTTNPVCTEQYGTVSTNLQQGNE

SEQ ID NO: 29570 - protein, 28 aa, Artificial Sequence
  Description of Artificial Sequence: Synthetic peptide
DECEIRCTNPVATELYGSVSMALQRGNR

SEQ ID NO: 29571 - protein, 28 aa, Artificial Sequence
  Description of Artificial Sequence: Synthetic peptide
DEEEIRTTNPVATEQYGSVDTPLQVGEG

SEQ ID NO: 29572 - protein, 28 aa, Artificial Sequence
  Description of Artificial Sequence: Synthetic peptide
DEEEIATTNPVATEQYGSVSTDLQIGEQ

SEQ ID NO: 29573 - protein, 28 aa, Artificial Sequence
  Description of Artificial Sequence: Synthetic peptide
DEEEIRTTNPVATEQYGSVSTDDEVGND

SEQ ID NO: 29574 - protein, 28 aa, Artificial Sequence
  Description of Artificial Sequence: Synthetic peptide
DEDEIRTTNPVATEQYGWVSMALQMGNR

SEQ ID NO: 29575 - protein, 28 aa, Artificial Sequence
  Description of Artificial Sequence: Synthetic peptide
NEEEIRTTNPVATEVYGLVSDNLQSGNR

SEQ ID NO: 29576 - protein, 28 aa, Artificial Sequence
  Description of Artificial Sequence: Synthetic peptide
DEQEIRTTNPVATEQYGDVSENDQHGNR

SEQ ID NO: 29577 - protein, 28 aa, Artificial Sequence
  Description of Artificial Sequence: Synthetic peptide
QEQEIATTNPVATEVYGSVSTNLQRGGR

SEQ ID NO: 29578 - protein, 28 aa, Artificial Sequence
  Description of Artificial Sequence: Synthetic peptide
DEDEISTTNPVATEMWGSVSENLQRGNR

SEQ ID NO: 29579 - protein, 28 aa, Artificial Sequence
  Description of Artificial Sequence: Synthetic peptide
SEQEIRTTNPVATEQYGSVSENLMRGNF

SEQ ID NO: 29580 - protein, 30 aa, Artificial Sequence
  Description of Artificial Sequence: Synthetic polypeptide
DEEEIRTTNPVAWEQYGSVSTNLQLNGDLR

SEQ ID NO: 29581 - protein, 30 aa, Artificial Sequence
  Description of Artificial Sequence: Synthetic polypeptide
KEEEIRTTNPVATEQYGSVSTNLQEAEGNN

SEQ ID NO: 29582 - protein, 29 aa, Artificial Sequence
  Description of Artificial Sequence: Synthetic peptide
DEEEIRTTNPVATEQYGDVSENLQHGNDA

SEQ ID NO: 29583 - protein, 30 aa, Artificial Sequence
  Description of Artificial Sequence: Synthetic polypeptide
DEHEIRATNPVATEQYGSVSTNDQYREGNR

SEQ ID NO: 29584 - protein, 30 aa, Artificial Sequence
  Description of Artificial Sequence: Synthetic polypeptide
DEEEIRTTNPVATEQYGSVATNDQVYGINR

SEQ ID NO: 29585 - protein, 28 aa, Artificial Sequence
  Description of Artificial Sequence: Synthetic peptide
DEEEIRTTNPVATEQYGSVSTGPQMGDP

SEQ ID NO: 29586 - protein, 28 aa, Artificial Sequence
  Description of Artificial Sequence: Synthetic peptide
QEDEICTTNPVATEQYGGVSDNLQRGNR

SEQ ID NO: 29587 - protein, 30 aa, Artificial Sequence
  Description of Artificial Sequence: Synthetic polypeptide
DEEEVRTTNPVATEQYGSVSANLQVAGDNR

SEQ ID NO: 29588 - protein, 28 aa, Artificial Sequence
  Description of Artificial Sequence: Synthetic peptide
DENEIRTTNPVATECYGSVSTDLQHGER

SEQ ID NO: 29589 - protein, 30 aa, Artificial Sequence
  Description of Artificial Sequence: Synthetic polypeptide
DEQEIRTTNPVATEQYGSVSTNLQREGDEH

SEQ ID NO: 29590 - protein, 28 aa, Artificial Sequence
  Description of Artificial Sequence: Synthetic peptide
AEQEIRTTNPVATECYGVVSTELQRGNR

SEQ ID NO: 29591 - protein, 28 aa, Artificial Sequence
  Description of Artificial Sequence: Synthetic peptide
DEDEIRTTNPVATEQYGSVSDTLKRGNA

SEQ ID NO: 29592 - protein, 30 aa, Artificial Sequence
  Description of Artificial Sequence: Synthetic polypeptide
DEEEIRTTNPVATEQYGSVSATNLELKGNE

SEQ ID NO: 29593 - protein, 29 aa, Artificial Sequence
  Description of Artificial Sequence: Synthetic peptide
DTEEIRYTNPVATEQYGSKVSTNLQNGTR

SEQ ID NO: 29594 - protein, 29 aa, Artificial Sequence
  Description of Artificial Sequence: Synthetic peptide
SEEEIRTTNPVSTECYGIVSTNLQIRGNR

SEQ ID NO: 29595 - protein, 29 aa, Artificial Sequence
  Description of Artificial Sequence: Synthetic peptide
DEQEIRTVNPVATEQYGSVSTNLQLGEDR

SEQ ID NO: 29596 - protein, 28 aa, Artificial Sequence
  Description of Artificial Sequence: Synthetic peptide
DEEEIRTTNPVATEQYGSVDTPLDRGET

SEQ ID NO: 29597 - protein, 29 aa, Artificial Sequence
  Description of Artificial Sequence: Synthetic peptide
SEEEIRTTNPVATEQYGSVSTNPQDRGTV

SEQ ID NO: 29598 - protein, 28 aa, Artificial Sequence
  Description of Artificial Sequence: Synthetic peptide
DEDEIRTTNPVATEQFGDVSTNLQFGNF

SEQ ID NO: 29599 - protein, 28 aa, Artificial Sequence
  Description of Artificial Sequence: Synthetic peptide
SENEIRTTNPVATEQYGSVSENLMRGDR

SEQ ID NO: 29600 - protein, 28 aa, Artificial Sequence
  Description of Artificial Sequence: Synthetic peptide
HEEEIRTTNPVATEQYGSVSEALQLGNF

SEQ ID NO: 29601 - protein, 31 aa, Artificial Sequence
  Description of Artificial Sequence: Synthetic polypeptide
DEEEIVTTNPVATEQYGSVSTTNPDQRGENR

SEQ ID NO: 29602 - protein, 28 aa, Artificial Sequence
  Description of Artificial Sequence: Synthetic peptide
DENEIRTTNPVATELYGSVSENEQRGNA

SEQ ID NO: 29603 - protein, 30 aa, Artificial Sequence
  Description of Artificial Sequence: Synthetic polypeptide
DEEEIRTTNPVATEQYGSVSCEELQDRGNY

SEQ ID NO: 29604 - protein, 33 aa, Artificial Sequence
  Description of Artificial Sequence: Synthetic polypeptide
DEEEIRTTNPVATEQYGSVDSATDNLQERGNDR

SEQ ID NO: 29605 - protein, 28 aa, Artificial Sequence
  Description of Artificial Sequence: Synthetic peptide
DEEEIAQTNPVATEQYGVVSTDQQRGNR

SEQ ID NO: 29606 - protein, 28 aa, Artificial Sequence
  Description of Artificial Sequence: Synthetic peptide
DEEEIYTTNPVATEQWGSCSTNLQRMNH

SEQ ID NO: 29607 - protein, 28 aa, Artificial Sequence
  Description of Artificial Sequence: Synthetic peptide
DEEEIRTTNPVATEQYGSVSTGPYNGNF

SEQ ID NO: 29608 - protein, 28 aa, Artificial Sequence
  Description of Artificial Sequence: Synthetic peptide
DEEEIRTTNPCATEQYGSVDTAEQFGNR

SEQ ID NO: 29609 - protein, 28 aa, Artificial Sequence
  Description of Artificial Sequence: Synthetic peptide
DEEEIRTTNPVATEMYGCVSTNLQRLPQ

SEQ ID NO: 29610 - protein, 28 aa, Artificial Sequence
  Description of Artificial Sequence: Synthetic peptide
DEEEIRTTNPVATEQYGSASENLQFMTR

SEQ ID NO: 29611 - protein, 28 aa, Artificial Sequence
  Description of Artificial Sequence: Synthetic peptide
DEEEVRTTNPVATEGYGSVATDLQTGNR

SEQ ID NO: 29612 - protein, 30 aa, Artificial Sequence
  Description of Artificial Sequence: Synthetic polypeptide
DEEEIRTTNPVATEQYGSVDTLPLQRGNDQ

SEQ ID NO: 29613 - protein, 28 aa, Artificial Sequence
  Description of Artificial Sequence: Synthetic peptide
DEEEIRTTNPVATEQYGDVSTNEQREEL

SEQ ID NO: 29614 - protein, 28 aa, Artificial Sequence
  Description of Artificial Sequence: Synthetic peptide
DEAEIRTTNPVSTEQYGDVSLMLQRGNR

SEQ ID NO: 29615 - protein, 28 aa, Artificial Sequence
  Description of Artificial Sequence: Synthetic peptide
DEEEIRTTNPVSYEIYGAVATNLQRGNR

SEQ ID NO: 29616 - protein, 28 aa, Artificial Sequence
  Description of Artificial Sequence: Synthetic peptide
SEDEIRTTNPAATEQYGSVSENWQRGNR

SEQ ID NO: 29617 - protein, 30 aa, Artificial Sequence
  Description of Artificial Sequence: Synthetic polypeptide
DEEEIRTTNPVATEQYGSVSTNLQDTDGDE

SEQ ID NO: 29618 - protein, 29 aa, Artificial Sequence
  Description of Artificial Sequence: Synthetic peptide
SEVEIACTNPVATEQYGSVSTNLQRGNDR

SEQ ID NO: 29619 - protein, 30 aa, Artificial Sequence
  Description of Artificial Sequence: Synthetic polypeptide
DEEEIRTTNPVATEQYGDVSTNLQTNGEER

SEQ ID NO: 29620 - protein, 28 aa, Artificial Sequence
  Description of Artificial Sequence: Synthetic peptide
DEEEIRTTNPVATEHYGVVSTDWQRGNY

SEQ ID NO: 29621 - protein, 28 aa, Artificial Sequence
  Description of Artificial Sequence: Synthetic peptide
QENEIRTTNPVATECYGVVSTNLQYGNR

SEQ ID NO: 29622 - protein, 28 aa, Artificial Sequence
  Description of Artificial Sequence: Synthetic peptide
DEQEIAATNPVATEVYGVVSTNLQRGNR

SEQ ID NO: 29623 - protein, 31 aa, Artificial Sequence
  Description of Artificial Sequence: Synthetic polypeptide
DEEEIRTTNPVATEQYGCSVSTNLQSRDNYN

SEQ ID NO: 29624 - protein, 29 aa, Artificial Sequence
  Description of Artificial Sequence: Synthetic peptide
DEQEIRTTNPVATEIYGSVSTNLQIHGNT

SEQ ID NO: 29625 - protein, 28 aa, Artificial Sequence
  Description of Artificial Sequence: Synthetic peptide
DEEEIRTTNPVATEQYGWVSDNAQAGNN

SEQ ID NO: 29626 - protein, 28 aa, Artificial Sequence
  Description of Artificial Sequence: Synthetic peptide
DEEEIRCTNPVATEWYGSVSTNEMRGNM

SEQ ID NO: 29627 - protein, 29 aa, Artificial Sequence
  Description of Artificial Sequence: Synthetic peptide
DEEEIRTTNPFATEQYGSVSTGNPEDGNR

SEQ ID NO: 29628 - protein, 28 aa, Artificial Sequence
  Description of Artificial Sequence: Synthetic peptide
SEEEIRTTNPVATEQYGEVTTNLQIYNR

SEQ ID NO: 29629 - protein, 29 aa, Artificial Sequence
  Description of Artificial Sequence: Synthetic peptide
DENEIATTNPVATECYGSVSTNLQDHGNR

SEQ ID NO: 29630 - protein, 31 aa, Artificial Sequence
  Description of Artificial Sequence: Synthetic polypeptide
DEEEIRTTNPVATEQYGSVDSTNLEDEGNER

SEQ ID NO: 29631 - protein, 32 aa, Artificial Sequence
  Description of Artificial Sequence: Synthetic polypeptide
DEEEIRTTNPVATEQYGSVSTANLQEIEGDNR

SEQ ID NO: 29632 - protein, 29 aa, Artificial Sequence
  Description of Artificial Sequence: Synthetic peptide
DECEIYTTNPVATEGYGSVSATVLQRGNR

SEQ ID NO: 29633 - protein, 28 aa, Artificial Sequence
  Description of Artificial Sequence: Synthetic peptide
QEEEIRATNPVATEQYGSASTNLQHGMR

SEQ ID NO: 29634 - protein, 28 aa, Artificial Sequence
  Description of Artificial Sequence: Synthetic peptide
DEVEIAATNPVATEQYGWVSSNLQRGNR

SEQ ID NO: 29635 - protein, 30 aa, Artificial Sequence
  Description of Artificial Sequence: Synthetic polypeptide
DEEEIRTTNPCATEQYGSVSTNLTQLDGNQ

SEQ ID NO: 29636 - protein, 28 aa, Artificial Sequence
  Description of Artificial Sequence: Synthetic peptide
DENEIRTTNPVATEQYGSVSENEMRGNA

SEQ ID NO: 29637 - protein, 31 aa, Artificial Sequence
  Description of Artificial Sequence: Synthetic polypeptide
DEEEIRTTNPVATEQYGSVDSTNLQPWEDNR

SEQ ID NO: 29638 - protein, 28 aa, Artificial Sequence
  Description of Artificial Sequence: Synthetic peptide
DEEEIATTNPVATECYGSVSTDLQAGNM

SEQ ID NO: 29639 - protein, 30 aa, Artificial Sequence
  Description of Artificial Sequence: Synthetic polypeptide
DEEEIRTTNPVATECYGSVSTNLQDQEGER

SEQ ID NO: 29640 - protein, 30 aa, Artificial Sequence
  Description of Artificial Sequence: Synthetic polypeptide
DEEEIRTTNPVATEQYGSVSENCQRAGPNK

SEQ ID NO: 29641 - protein, 28 aa, Artificial Sequence
  Description of Artificial Sequence: Synthetic peptide
VEEEIRTTNPVSSEQYGSVATNLQRGNQ

SEQ ID NO: 29642 - protein, 30 aa, Artificial Sequence
  Description of Artificial Sequence: Synthetic polypeptide
DEQEIRTTNPVATECYGSVSETNLQIRGNY

SEQ ID NO: 29643 - protein, 28 aa, Artificial Sequence
  Description of Artificial Sequence: Synthetic peptide
DEDEIRQTNPVATEQYGEVSTNLQHMNR

SEQ ID NO: 29644 - protein, 28 aa, Artificial Sequence
  Description of Artificial Sequence: Synthetic peptide
DEEEIRAVNPVATECYGSVSTNLQYGER

SEQ ID NO: 29645 - protein, 28 aa, Artificial Sequence
  Description of Artificial Sequence: Synthetic peptide
DEEEIITTNPVATEQYGSVSTPLQGGES

SEQ ID NO: 29646 - protein, 28 aa, Artificial Sequence
  Description of Artificial Sequence: Synthetic peptide
DEEEIVTTNPVATECYGSVSTNLQTGEA

SEQ ID NO: 29647 - protein, 28 aa, Artificial Sequence
  Description of Artificial Sequence: Synthetic peptide
DEECIRTTNPVAFQQYGSVSTNLQRGEP

SEQ ID NO: 29648 - protein, 28 aa, Artificial Sequence
  Description of Artificial Sequence: Synthetic peptide
DEEEIATTNPVATECYGSVSTDLQRGED

SEQ ID NO: 29649 - protein, 28 aa, Artificial Sequence
  Description of Artificial Sequence: Synthetic peptide
DEQEIATTNPVATEQYGSVSTDLERGNN

SEQ ID NO: 29650 - protein, 29 aa, Artificial Sequence
  Description of Artificial Sequence: Synthetic peptide
DEEEIRTTNPVATEQYGSVSTELEIHGNH

SEQ ID NO: 29651 - protein, 28 aa, Artificial Sequence
  Description of Artificial Sequence: Synthetic peptide
REEEIMTTNPVATEHYGEVSTNLQRGNL

SEQ ID NO: 29652 - protein, 28 aa, Artificial Sequence
  Description of Artificial Sequence: Synthetic peptide
DEQEISTTNPVSTEMYGEVSTNLQRGNR

SEQ ID NO: 29653 - protein, 28 aa, Artificial Sequence
  Description of Artificial Sequence: Synthetic peptide
DEEEIRTTNPVATEQYGDVSENDDRGER

SEQ ID NO: 29654 - protein, 29 aa, Artificial Sequence
  Description of Artificial Sequence: Synthetic peptide
DEEEIRTTNPVATEQYGSVSTELQDAGES

SEQ ID NO: 29655 - protein, 28 aa, Artificial Sequence
  Description of Artificial Sequence: Synthetic peptide
DEEEIRTTNPVATEQYGSVSTEDQEGEE

SEQ ID NO: 29656 - protein, 29 aa, Artificial Sequence
  Description of Artificial Sequence: Synthetic peptide
MENEIRTTNPVATEQYGSVSTNLQENGNM

SEQ ID NO: 29657 - protein, 29 aa, Artificial Sequence
  Description of Artificial Sequence: Synthetic peptide
DESEIRTTNPVATEWYGCVSDNLQRAGNR

SEQ ID NO: 29658 - protein, 30 aa, Artificial Sequence
  Description of Artificial Sequence: Synthetic polypeptide
DEEEIRTTNPVATEQYGSIASTNGLEGGNR

SEQ ID NO: 29659 - protein, 30 aa, Artificial Sequence
  Description of Artificial Sequence: Synthetic polypeptide
DEEEIRTTNPVATEQYGNVAEVNLQRGFNR

SEQ ID NO: 29660 - protein, 28 aa, Artificial Sequence
  Description of Artificial Sequence: Synthetic peptide
DEEEIRTTNPVATECYGFVSTNLQIGEW

SEQ ID NO: 29661 - protein, 28 aa, Artificial Sequence
  Description of Artificial Sequence: Synthetic peptide
DEEEIRTTNPVATELWGSVSTNEQIGNF

SEQ ID NO: 29662 - protein, 28 aa, Artificial Sequence
  Description of Artificial Sequence: Synthetic peptide
DEEEIRTTNPYATEQYGSVSTGDQWGNT

SEQ ID NO: 29663 - protein, 28 aa, Artificial Sequence
  Description of Artificial Sequence: Synthetic peptide
DEEEIRTTNPVATEQYGSVSENEMTGNF

SEQ ID NO: 29664 - protein, 28 aa, Artificial Sequence
  Description of Artificial Sequence: Synthetic peptide
DEEEIRTTNPFATEQYGSVSTPLQIEND

SEQ ID NO: 29665 - protein, 28 aa, Artificial Sequence
  Description of Artificial Sequence: Synthetic peptide
DEEKIRTTNPVATEHYGSVSTNLQHGQM

SEQ ID NO: 29666 - protein, 28 aa, Artificial Sequence
  Description of Artificial Sequence: Synthetic peptide
DEDEIRTTNPVATEGYGSVSENLQRENK

SEQ ID NO: 29667 - protein, 32 aa, Artificial Sequence
  Description of Artificial Sequence: Synthetic polypeptide
DEEEIRTTNPVATEQYGSVSTNPLQERGDNDI

SEQ ID NO: 29668 - protein, 30 aa, Artificial Sequence
  Description of Artificial Sequence: Synthetic polypeptide
DEEEIRTTNPVATEQYGSVSTNEQIQGDDR

SEQ ID NO: 29669 - protein, 28 aa, Artificial Sequence
  Description of Artificial Sequence: Synthetic peptide
DEEEIRTTNPDATEQYGVVATNIQRGND

SEQ ID NO: 29670 - protein, 28 aa, Artificial Sequence
  Description of Artificial Sequence: Synthetic peptide
DEEEVRCTNPVAYEQYGAVSNNLQRGNR

SEQ ID NO: 29671 - protein, 28 aa, Artificial Sequence
  Description of Artificial Sequence: Synthetic peptide
REEEIRATNPVATEQYGWASTNLQRLNR

SEQ ID NO: 29672 - protein, 28 aa, Artificial Sequence
  Description of Artificial Sequence: Synthetic peptide
DEEEISTTNPVATEIYGSVSENLDVGNR

SEQ ID NO: 29673 - protein, 29 aa, Artificial Sequence
  Description of Artificial Sequence: Synthetic peptide
DEEEIRTTNPVATQQYGSVSTNPDDRGER

SEQ ID NO: 29674 - protein, 30 aa, Artificial Sequence
  Description of Artificial Sequence: Synthetic polypeptide
DEEEIRTTNPVAWAQYGSVSTMDLQRGENR

SEQ ID NO: 29675 - protein, 29 aa, Artificial Sequence
  Description of Artificial Sequence: Synthetic peptide
DEEEIRTTNPVSTEVYGSVSDNLQNRGNM

SEQ ID NO: 29676 - protein, 28 aa, Artificial Sequence
  Description of Artificial Sequence: Synthetic peptide
DEEEIRTTNPVATEQYGVVSTELQHGEI

SEQ ID NO: 29677 - protein, 28 aa, Artificial Sequence
  Description of Artificial Sequence: Synthetic peptide
DEEEIRTTNPVATEQWGSVSTNEMQGNM

SEQ ID NO: 29678 - protein, 30 aa, Artificial Sequence
  Description of Artificial Sequence: Synthetic polypeptide
DEEEIATTNPVATEQYGSVSTNEQEHEGNR

SEQ ID NO: 29679 - protein, 28 aa, Artificial Sequence
  Description of Artificial Sequence: Synthetic peptide
SEEEIRTTNPVATELYGSVSTNEQHGNI

SEQ ID NO: 29680 - protein, 29 aa, Artificial Sequence
  Description of Artificial Sequence: Synthetic peptide
YEEEIRTTNPVATEQYGLVSTALQIRGND

SEQ ID NO: 29681 - protein, 28 aa, Artificial Sequence
  Description of Artificial Sequence: Synthetic peptide
DEEEIRTTNPCATECYGSVSTNLQVEND

SEQ ID NO: 29682 - protein, 28 aa, Artificial Sequence
  Description of Artificial Sequence: Synthetic peptide
DEEEIRTTNPEATEQYGSVSTDLQHDNA

SEQ ID NO: 29683 - protein, 28 aa, Artificial Sequence
  Description of Artificial Sequence: Synthetic peptide
VEEEIRTTNPVATEQYGSASDNLQQQNR

SEQ ID NO: 29684 - protein, 29 aa, Artificial Sequence
  Description of Artificial Sequence: Synthetic peptide
DEQEIRTTNPVATEQYGSVSDNLQRGDDS

SEQ ID NO: 29685 - protein, 28 aa, Artificial Sequence
  Description of Artificial Sequence: Synthetic peptide
DEEEIAATNPVATEMYGSVGENLQRGNR

SEQ ID NO: 29686 - protein, 29 aa, Artificial Sequence
  Description of Artificial Sequence: Synthetic peptide
DEEEIRTTNPVATEQYGDVSENLMNRGNA

SEQ ID NO: 29687 - protein, 30 aa, Artificial Sequence
  Description of Artificial Sequence: Synthetic polypeptide
DEEEIRTTNPVATEQYGDCSATNLQQAGNR

SEQ ID NO: 29688 - protein, 28 aa, Artificial Sequence
  Description of Artificial Sequence: Synthetic peptide
DEQEIRTTNPVSTEMYGSVSTNLQRGPQ

SEQ ID NO: 29689 - protein, 29 aa, Artificial Sequence
  Description of Artificial Sequence: Synthetic peptide
DENEIRTTNPVATEQYGDVSTNLQNEGNA

SEQ ID NO: 29690 - protein, 28 aa, Artificial Sequence
  Description of Artificial Sequence: Synthetic peptide
DEEEIRTVNPVATEQYGCVSTDWQLGNR

SEQ ID NO: 29691 - protein, 29 aa, Artificial Sequence
  Description of Artificial Sequence: Synthetic peptide
DEEEIRTTNPVATEQWGIVSENLQMRGNQ

SEQ ID NO: 29692 - protein, 28 aa, Artificial Sequence
  Description of Artificial Sequence: Synthetic peptide
QESEIRTTNPVATEQYGSVSTNLQDGED

SEQ ID NO: 29693 - protein, 29 aa, Artificial Sequence
  Description of Artificial Sequence: Synthetic peptide
DEEEIRTTNPVATEVYGSVSENLQGAGNF

SEQ ID NO: 29694 - protein, 28 aa, Artificial Sequence
  Description of Artificial Sequence: Synthetic peptide
DEEEIASTNPVATECYGSVSMNLQRGTR

SEQ ID NO: 29695 - protein, 30 aa, Artificial Sequence
  Description of Artificial Sequence: Synthetic polypeptide
DEHEIATTNPVATEGYGSVSTNLQQRAGNR

SEQ ID NO: 29696 - protein, 31 aa, Artificial Sequence
  Description of Artificial Sequence: Synthetic polypeptide
DEEEIRTTNPVATEQYGSVSTVNLQEMGENG

SEQ ID NO: 29697 - protein, 28 aa, Artificial Sequence
  Description of Artificial Sequence: Synthetic peptide
DENEIATTNPVATEQYGSASTNLMRGQR

SEQ ID NO: 29698 - protein, 28 aa, Artificial Sequence
  Description of Artificial Sequence: Synthetic peptide
DEEEIRTTNPVATDQYGSVSTDDQRGTM

SEQ ID NO: 29699 - protein, 28 aa, Artificial Sequence
  Description of Artificial Sequence: Synthetic peptide
DEQEIRTTNPVATECYGSVSTELQMGND

SEQ ID NO: 29700 - protein, 28 aa, Artificial Sequence
  Description of Artificial Sequence: Synthetic peptide
DEEEIRSTNPVATEQYGNVSTEPQTGNR

SEQ ID NO: 29701 - protein, 32 aa, Artificial Sequence
  Description of Artificial Sequence: Synthetic polypeptide
DEEEIRTTNPVATEQYGSVSETNLERDGENDR

SEQ ID NO: 29702 - protein, 28 aa, Artificial Sequence
  Description of Artificial Sequence: Synthetic peptide
DEEEIRTTNPVATEQYGSVSTDDQIGEL

SEQ ID NO: 29703 - protein, 29 aa, Artificial Sequence
  Description of Artificial Sequence: Synthetic peptide
DEQEIATTNPVATECYGSVSTNLQRKGNQ

SEQ ID NO: 29704 - protein, 28 aa, Artificial Sequence
  Description of Artificial Sequence: Synthetic peptide
SEEEIRTTNPVATEQYGVVSTNLQVGTN

SEQ ID NO: 29705 - protein, 30 aa, Artificial Sequence
  Description of Artificial Sequence: Synthetic polypeptide
DEEEIRTVNPVATEQYGSVSTGNLQSGILR

SEQ ID NO: 29706 - protein, 31 aa, Artificial Sequence
  Description of Artificial Sequence: Synthetic polypeptide
DEQEIRTTNPVATEQYGSVSATNLQREGENE

SEQ ID NO: 29707 - protein, 30 aa, Artificial Sequence
  Description of Artificial Sequence: Synthetic polypeptide
DEEEIRTTNPVATEQYGSVSTANPQDQGNA

SEQ ID NO: 29708 - protein, 28 aa, Artificial Sequence
  Description of Artificial Sequence: Synthetic peptide
DENEIIATNPVATEQYGWVSTNLQNGNR

SEQ ID NO: 29709 - protein, 28 aa, Artificial Sequence
  Description of Artificial Sequence: Synthetic peptide
QEQEIVTTNPVATEQYGEVSENLQRGNR

SEQ ID NO: 29710 - protein, 28 aa, Artificial Sequence
  Description of Artificial Sequence: Synthetic peptide
DEHEISTTNPVATELYGSVSTNLERGER

SEQ ID NO: 29711 - protein, 28 aa, Artificial Sequence
  Description of Artificial Sequence: Synthetic peptide
DECEISTTNPVATEQYGSVSTALQHGNV

SEQ ID NO: 29712 - protein, 28 aa, Artificial Sequence
  Description of Artificial Sequence: Synthetic peptide
DENEIRTTNPVATEQYGDASENLQRGNQ

SEQ ID NO: 29713 - protein, 28 aa, Artificial Sequence
  Description of Artificial Sequence: Synthetic peptide
VESEVRTTNPVATEQYGCVSTNLQRGTR

SEQ ID NO: 29714 - protein, 28 aa, Artificial Sequence
  Description of Artificial Sequence: Synthetic peptide
VEEEIRATNPVATEQYGCVATNLQRGNQ

SEQ ID NO: 29715 - protein, 28 aa, Artificial Sequence
  Description of Artificial Sequence: Synthetic peptide
DEEEIRTTNPFATEQYGSVSTDLITGNN

SEQ ID NO: 29716 - protein, 28 aa, Artificial Sequence
  Description of Artificial Sequence: Synthetic peptide
DEEEIATTNPVATEHFGSVSTNLQRPND

SEQ ID NO: 29717 - protein, 30 aa, Artificial Sequence
  Description of Artificial Sequence: Synthetic polypeptide
DEDEIRTTNPVATEQYGSASTNLQNHGPNR

SEQ ID NO: 29718 - protein, 29 aa, Artificial Sequence
  Description of Artificial Sequence: Synthetic peptide
DEDEIRTTNPVATEVYGSVSTNLQHAGMR

SEQ ID NO: 29719 - protein, 28 aa, Artificial Sequence
  Description of Artificial Sequence: Synthetic peptide
DEEEIRTTNPVATEWYGSVSTNDQQGDM

SEQ ID NO: 29720 - protein, 28 aa, Artificial Sequence
  Description of Artificial Sequence: Synthetic peptide
DEEEIRQTNPVSTEQYGEVATNLQHGNR

SEQ ID NO: 29721 - protein, 31 aa, Artificial Sequence
  Description of Artificial Sequence: Synthetic polypeptide
DEEEIRTTNPVATEQYGSVSTTMGLQRGENF

SEQ ID NO: 29722 - protein, 28 aa, Artificial Sequence
  Description of Artificial Sequence: Synthetic peptide
DEEEIRTTNPVATEQYGSVSTDLENGEW

SEQ ID NO: 29723 - protein, 28 aa, Artificial Sequence
  Description of Artificial Sequence: Synthetic peptide
DEQEIATTNPVATEVYGVVATNLQRGNR

SEQ ID NO: 29724 - protein, 28 aa, Artificial Sequence
  Description of Artificial Sequence: Synthetic peptide
DEEEIRTTNPVATEIYGVVSTDLQLGND

SEQ ID NO: 29725 - protein, 28 aa, Artificial Sequence
  Description of Artificial Sequence: Synthetic peptide
DEEEIRTTNPVATENWGEVSTQLQRGQR

SEQ ID NO: 29726 - protein, 28 aa, Artificial Sequence
  Description of Artificial Sequence: Synthetic peptide
REEEIRTTNPVATELYGTVSNNLQQGNR

SEQ ID NO: 29727 - protein, 28 aa, Artificial Sequence
  Description of Artificial Sequence: Synthetic peptide
HEEEIRTTNPCATEQYGAVSENLQRGQR

SEQ ID NO: 29728 - protein, 28 aa, Artificial Sequence
  Description of Artificial Sequence: Synthetic peptide
AEQEIATTNPVATEQYGDVSENLQRGNR

SEQ ID NO: 29729 - protein, 29 aa, Artificial Sequence
  Description of Artificial Sequence: Synthetic peptide
DEEEIRTTNPVATECYGSVSTNEQMLGNL

SEQ ID NO: 29730 - protein, 31 aa, Artificial Sequence
  Description of Artificial Sequence: Synthetic polypeptide
DEEEIRTTNPVATEQYGSVSTQNLEYNGNIR

SEQ ID NO: 29731 - protein, 28 aa, Artificial Sequence
  Description of Artificial Sequence: Synthetic peptide
MENEIRTTNPVATEMYGSVSTNLQQGNL

SEQ ID NO: 29732 - protein, 28 aa, Artificial Sequence
  Description of Artificial Sequence: Synthetic peptide
DEEEIRTTNPVATEQYGSVSENLEDDNQ

SEQ ID NO: 29733 - protein, 30 aa, Artificial Sequence
  Description of Artificial Sequence: Synthetic polypeptide
DEEEIRTTNPVATEQYGVVSTTNQQRTGNA

SEQ ID NO: 29734 - protein, 28 aa, Artificial Sequence
  Description of Artificial Sequence: Synthetic peptide
MESEIRTTNPVATEQYGSCSEDLQRGNR

SEQ ID NO: 29735 - protein, 28 aa, Artificial Sequence
  Description of Artificial Sequence: Synthetic peptide
DEEEIRTTNPAATEQFGSVSTNEQQGTR

SEQ ID NO: 29736 - protein, 28 aa, Artificial Sequence
  Description of Artificial Sequence: Synthetic peptide
DEEEIMTTNPVATEQYGCVSMNDQFGNR

SEQ ID NO: 29737 - protein, 29 aa, Artificial Sequence
  Description of Artificial Sequence: Synthetic peptide
DEEEIRTTNPVSTEQYGSVSENVQRGQYR

SEQ ID NO: 29738 - protein, 29 aa, Artificial Sequence
  Description of Artificial Sequence: Synthetic peptide
DEEELNTTNPVATEGYGSVSENLQMRGNR

SEQ ID NO: 29739 - protein, 28 aa, Artificial Sequence
  Description of Artificial Sequence: Synthetic peptide
MEEEIRTTNPVATEQYGSVSTELQNGDM

SEQ ID NO: 29740 - protein, 28 aa, Artificial Sequence
  Description of Artificial Sequence: Synthetic peptide
DENEIRTTNPVATECYGVVSTNLQDGNM

SEQ ID NO: 29741 - protein, 28 aa, Artificial Sequence
  Description of Artificial Sequence: Synthetic peptide
DENEIRTTNPVATEQWGSVSENEQRGNM

SEQ ID NO: 29742 - protein, 28 aa, Artificial Sequence
  Description of Artificial Sequence: Synthetic peptide
QENEIATTNPVATEQYGWVSENLQRGNR

SEQ ID NO: 29743 - protein, 29 aa, Artificial Sequence
  Description of Artificial Sequence: Synthetic peptide
DEEEIRTTNPVATEVYGEASTNLQHAGNR

SEQ ID NO: 29744 - protein, 29 aa, Artificial Sequence
  Description of Artificial Sequence: Synthetic peptide
DEEEIATTNPVATEQYGSASEDLQRSGNR

SEQ ID NO: 29745 - protein, 28 aa, Artificial Sequence
  Description of Artificial Sequence: Synthetic peptide
KEEEIRTTNPVATEQYGSVSTELQAGDH

SEQ ID NO: 29746 - protein, 28 aa, Artificial Sequence
  Description of Artificial Sequence: Synthetic peptide
DEEEIRATNPVATEQYGEVSTAPQMGNR

SEQ ID NO: 29747 - protein, 28 aa, Artificial Sequence
  Description of Artificial Sequence: Synthetic peptide
DEEEIRTTNPVATENYGSVSTGGNVGNR

SEQ ID NO: 29748 - protein, 29 aa, Artificial Sequence
  Description of Artificial Sequence: Synthetic peptide
DEEEIRTTNPVATEQYGSVEDNGLNRGDR

SEQ ID NO: 29749 - protein, 30 aa, Artificial Sequence
  Description of Artificial Sequence: Synthetic polypeptide
DEEEIRTTNPVATEQYGSVSTNPLVEHGNM

SEQ ID NO: 29750 - protein, 30 aa, Artificial Sequence
  Description of Artificial Sequence: Synthetic polypeptide
GEEEIRTTNPVATEQYGSVSTMNWQDRGNF

SEQ ID NO: 29751 - protein, 28 aa, Artificial Sequence
  Description of Artificial Sequence: Synthetic peptide
DEEEIRATNPVCTEQYGSVSTDLQIGNY

SEQ ID NO: 29752 - protein, 28 aa, Artificial Sequence
  Description of Artificial Sequence: Synthetic peptide
DEQEIAATNPVATECYGWVSTNLQRGNR

SEQ ID NO: 29753 - protein, 28 aa, Artificial Sequence
  Description of Artificial Sequence: Synthetic peptide
SEVEIRATNPVATEQFGSVSENLQRGNR

SEQ ID NO: 29754 - protein, 28 aa, Artificial Sequence
  Description of Artificial Sequence: Synthetic peptide
MEEEIRTTNPVATEMYGSVSTELQQGNT

SEQ ID NO: 29755 - protein, 28 aa, Artificial Sequence
  Description of Artificial Sequence: Synthetic peptide
QENEISTTNPCATEQYGSVSTNWQRGNR

SEQ ID NO: 29756 - protein, 29 aa, Artificial Sequence
  Description of Artificial Sequence: Synthetic peptide
DEEEIRTTNPVASEIYGSVSTDLEREGNR

SEQ ID NO: 29757 - protein, 30 aa, Artificial Sequence
  Description of Artificial Sequence: Synthetic polypeptide
HEEEIRTTNPVATEIYGSVSTANLQNRGNV

SEQ ID NO: 29758 - protein, 28 aa, Artificial Sequence
  Description of Artificial Sequence: Synthetic peptide
DEEEIKTTNPTATECYGEASTNLQRGNR

SEQ ID NO: 29759 - protein, 30 aa, Artificial Sequence
  Description of Artificial Sequence: Synthetic polypeptide
DEEEIRSVNPVATEQYGSVSTGNEQQRGNR

SEQ ID NO: 29760 - protein, 28 aa, Artificial Sequence
  Description of Artificial Sequence: Synthetic peptide
DEEEIATTNPVATEIFGGVSTNLQRGNS

SEQ ID NO: 29761 - protein, 28 aa, Artificial Sequence
  Description of Artificial Sequence: Synthetic peptide
DEEEIRATNPVATEQYGSVMTPLEDGNR

SEQ ID NO: 29762 - protein, 28 aa, Artificial Sequence
  Description of Artificial Sequence: Synthetic peptide
DEEIIRTTNPVATEQYGCVSTNCQFGNC

SEQ ID NO: 29763 - protein, 28 aa, Artificial Sequence
  Description of Artificial Sequence: Synthetic peptide
DEEEIRTTNPVATEQYGSVSTNDDDGEW

SEQ ID NO: 29764 - protein, 28 aa, Artificial Sequence
  Description of Artificial Sequence: Synthetic peptide
DEEEICTTNPVATEIYGSASTNLQHGMR

SEQ ID NO: 29765 - protein, 30 aa, Artificial Sequence
  Description of Artificial Sequence: Synthetic polypeptide
DEEEIRTTNPVATEQYGSVSTANPQENGNQ

SEQ ID NO: 29766 - protein, 28 aa, Artificial Sequence
  Description of Artificial Sequence: Synthetic peptide
SEEEIRTTNPVSTEWWGSVSTNLQLGNR

SEQ ID NO: 29767 - protein, 28 aa, Artificial Sequence
  Description of Artificial Sequence: Synthetic peptide
DENEIRCTNPVATEQWGSVSTNLQRGTA

SEQ ID NO: 29768 - protein, 28 aa, Artificial Sequence
  Description of Artificial Sequence: Synthetic peptide
DEQEIVTTNPVATEQYGVVSTNLQHGNY

SEQ ID NO: 29769 - protein, 29 aa, Artificial Sequence
  Description of Artificial Sequence: Synthetic peptide
DEEEIATTNPVATECYGSVSTNLQHNGNQ

SEQ ID NO: 29770 - protein, 28 aa, Artificial Sequence
  Description of Artificial Sequence: Synthetic peptide
DEEEIRTTNPVATEQYGSVSENEMQGNQ

SEQ ID NO: 29771 - protein, 28 aa, Artificial Sequence
  Description of Artificial Sequence: Synthetic peptide
DEEEIRTTNPVATAQYGFVSTDDQRGLR

SEQ ID NO: 29772 - protein, 28 aa, Artificial Sequence
  Description of Artificial Sequence: Synthetic peptide
DEEEIRTTNPVATEIYGSVSTDLEYGNY

SEQ ID NO: 29773 - protein, 29 aa, Artificial Sequence
  Description of Artificial Sequence: Synthetic peptide
DTEEIRTTNPVATEQYGSVSHNDQPEGNR

SEQ ID NO: 29774 - protein, 30 aa, Artificial Sequence
  Description of Artificial Sequence: Synthetic polypeptide
QEEEIRTTNPVATEIYGSVSTELQREGNDR

SEQ ID NO: 29775 - protein, 28 aa, Artificial Sequence
  Description of Artificial Sequence: Synthetic peptide
SEEEIRTTNPAATEQFGSVSTNEQRGNS

SEQ ID NO: 29776 - protein, 28 aa, Artificial Sequence
  Description of Artificial Sequence: Synthetic peptide
DEQEIRTTNPVATEIYGCVATNLERGNR

SEQ ID NO: 29777 - protein, 28 aa, Artificial Sequence
  Description of Artificial Sequence: Synthetic peptide
DEEEIRTTNPVATEQYGNVAEALQRGQR

SEQ ID NO: 29778 - protein, 30 aa, Artificial Sequence
  Description of Artificial Sequence: Synthetic polypeptide
DEEEIRTTNPVATEQYGSVSTNLEDGDNEE

SEQ ID NO: 29779 - protein, 28 aa, Artificial Sequence
  Description of Artificial Sequence: Synthetic peptide
DEEEIRTTNPVATEQYGSVETDLDRDNP

SEQ ID NO: 29780 - protein, 28 aa, Artificial Sequence
  Description of Artificial Sequence: Synthetic peptide
DENEIRTTNPVATECWGSVSTNLQQGNA

SEQ ID NO: 29781 - protein, 28 aa, Artificial Sequence
  Description of Artificial Sequence: Synthetic peptide
AEEEIRTTNPVATEQYGSVSETFQVGNR

SEQ ID NO: 29782 - protein, 31 aa, Artificial Sequence
  Description of Artificial Sequence: Synthetic polypeptide
DEEEIRTTNPVATEQYGSVSTNLEDHEGNDR

SEQ ID NO: 29783 - protein, 28 aa, Artificial Sequence
  Description of Artificial Sequence: Synthetic peptide
AEEEIVTTNPVATEQYGWASENLQRGNR

SEQ ID NO: 29784 - protein, 29 aa, Artificial Sequence
  Description of Artificial Sequence: Synthetic peptide
DEEEIRATNPVATEQYGSAISENLQRENR

SEQ ID NO: 29785 - protein, 33 aa, Artificial Sequence
  Description of Artificial Sequence: Synthetic polypeptide
DEEEIRTTNPVATEQYGSVASVTNLQQDRDGNR

SEQ ID NO: 29786 - protein, 28 aa, Artificial Sequence
  Description of Artificial Sequence: Synthetic peptide
DEDEIRTTNPVACEQYGVVSTNLEPGNR

SEQ ID NO: 29787 - protein, 28 aa, Artificial Sequence
  Description of Artificial Sequence: Synthetic peptide
DEQEIATTNPVATENYGVVATNLQRGNR

SEQ ID NO: 29788 - protein, 31 aa, Artificial Sequence
  Description of Artificial Sequence: Synthetic polypeptide
DEEEIATTNPVATEQYGSVSATNLQREGNDI

SEQ ID NO: 29789 - protein, 28 aa, Artificial Sequence
  Description of Artificial Sequence: Synthetic peptide
DESEIRTTNPTATEFYGSVSTNLQQGNH

SEQ ID NO: 29790 - protein, 28 aa, Artificial Sequence
  Description of Artificial Sequence: Synthetic peptide
DEEEIATVNPVSTEQYGTVSTNLQRPNR

SEQ ID NO: 29791 - protein, 28 aa, Artificial Sequence
  Description of Artificial Sequence: Synthetic peptide
DEEEIRTTNPVATEWYGSVSENLQFGEG

SEQ ID NO: 29792 - protein, 28 aa, Artificial Sequence
  Description of Artificial Sequence: Synthetic peptide
DEQEIAATNPVATEIYGWVSTNLQRGNR

SEQ ID NO: 29793 - protein, 28 aa, Artificial Sequence
  Description of Artificial Sequence: Synthetic peptide
DESEIRTTNPVATEQFGVVSNNLQHGNR

SEQ ID NO: 29794 - protein, 31 aa, Artificial Sequence
  Description of Artificial Sequence: Synthetic polypeptide
DEEEIRTTNPVCTEQYGSVSTMNLQERGNDL

SEQ ID NO: 29795 - protein, 28 aa, Artificial Sequence
  Description of Artificial Sequence: Synthetic peptide
KEEEIRTTNPVATECYGSVSTDLQRGEQ

SEQ ID NO: 29796 - protein, 29 aa, Artificial Sequence
  Description of Artificial Sequence: Synthetic peptide
DEEEIRTTNPVATEQYGSVDSTPDEPGNR

SEQ ID NO: 29797 - protein, 28 aa, Artificial Sequence
  Description of Artificial Sequence: Synthetic peptide
VENEIRTTNPVATEQYGSVSTDLQNGNF

SEQ ID NO: 29798 - protein, 28 aa, Artificial Sequence
  Description of Artificial Sequence: Synthetic peptide
SEEEIRTTNPVATELWGSVSTNLERGNM

SEQ ID NO: 29799 - protein, 28 aa, Artificial Sequence
  Description of Artificial Sequence: Synthetic peptide
DESEIRTTNPVATKHYGSVSTNLQRTNM

SEQ ID NO: 29800 - protein, 28 aa, Artificial Sequence
  Description of Artificial Sequence: Synthetic peptide
DEMEIRTTNPVATEQYGSVSTEEQLGNA

SEQ ID NO: 29801 - protein, 28 aa, Artificial Sequence
  Description of Artificial Sequence: Synthetic peptide
DEEEIKTTNPVATEVYGEVSENLQRGQR

SEQ ID NO: 29802 - protein, 28 aa, Artificial Sequence
  Description of Artificial Sequence: Synthetic peptide
DEEEIRTTNPVCTEQYGSVSTDDQMGNT

SEQ ID NO: 29803 - protein, 28 aa, Artificial Sequence
  Description of Artificial Sequence: Synthetic peptide
QEEEIATTNPVATECYGSVPTNLQRENR

SEQ ID NO: 29804 - protein, 28 aa, Artificial Sequence
  Description of Artificial Sequence: Synthetic peptide
DEEEIRTTNPVATETYGSVSTNGQVGMF

SEQ ID NO: 29805 - protein, 31 aa, Artificial Sequence
  Description of Artificial Sequence: Synthetic polypeptide
DEEEIRTTNPVATEQYGSVSETNLVQINGER

SEQ ID NO: 29806 - protein, 28 aa, Artificial Sequence
  Description of Artificial Sequence: Synthetic peptide
DEVEIRTTNPTATEQFGSVSTNLQNGNA

SEQ ID NO: 29807 - protein, 28 aa, Artificial Sequence
  Description of Artificial Sequence: Synthetic peptide
DEEEIRTTNPVATEQYGSVSTGDQQGES

SEQ ID NO: 29808 - protein, 30 aa, Artificial Sequence
  Description of Artificial Sequence: Synthetic polypeptide
DEEEIRTTNPVATEQYGSVASTLPGDRGNR

SEQ ID NO: 29809 - protein, 30 aa, Artificial Sequence
  Description of Artificial Sequence: Synthetic polypeptide
AEEEIRTTNPVATEQYGSVSAENLQQRGPR

SEQ ID NO: 29810 - protein, 28 aa, Artificial Sequence
  Description of Artificial Sequence: Synthetic peptide
SEEEIRSTNPVATEVYGSVSTNLQRGTY

SEQ ID NO: 29811 - protein, 32 aa, Artificial Sequence
  Description of Artificial Sequence: Synthetic polypeptide
DEEEIRTTNPVATEQYGSVSETNGLTQRDGNP

SEQ ID NO: 29812 - protein, 29 aa, Artificial Sequence
  Description of Artificial Sequence: Synthetic peptide
DEQEIRTTNPVATEIYGSVSANNLERGNR

SEQ ID NO: 29813 - protein, 29 aa, Artificial Sequence
  Description of Artificial Sequence: Synthetic peptide
DEEEIRTTNPVATEQWGIVSENLQWRGTR

SEQ ID NO: 29814 - protein, 28 aa, Artificial Sequence
  Description of Artificial Sequence: Synthetic peptide
QEEEIATTNPVATEGYGSASTNLQRENR

SEQ ID NO: 29815 - protein, 28 aa, Artificial Sequence
  Description of Artificial Sequence: Synthetic peptide
DECEIRTTNPVATEQYGIVCENLQRGNK

SEQ ID NO: 29816 - protein, 28 aa, Artificial Sequence
  Description of Artificial Sequence: Synthetic peptide
DEQEIRTTNPVATEVYGEVSTLLQVGNR

SEQ ID NO: 29817 - protein, 28 aa, Artificial Sequence
  Description of Artificial Sequence: Synthetic peptide
DEEEIRTTNPFATEQYGSVSTNDDRGEN

SEQ ID NO: 29818 - protein, 28 aa, Artificial Sequence
  Description of Artificial Sequence: Synthetic peptide
DEEEINTTNPVATEQYGECSTNLQRGTM

SEQ ID NO: 29819 - protein, 28 aa, Artificial Sequence
  Description of Artificial Sequence: Synthetic peptide
SEEEIRTTNPVATEQYGEVNTNEQRGDR

SEQ ID NO: 29820 - protein, 28 aa, Artificial Sequence
  Description of Artificial Sequence: Synthetic peptide
DEQEIRTTNPVATDQYGSVSDNLQRGDF

SEQ ID NO: 29821 - protein, 28 aa, Artificial Sequence
  Description of Artificial Sequence: Synthetic peptide
MEEEIRSTNPVATEQYGSVSENLQNGNA

SEQ ID NO: 29822 - protein, 28 aa, Artificial Sequence
  Description of Artificial Sequence: Synthetic peptide
KEEEIRTVNPVATEQYGVVSTNLQIGNQ

SEQ ID NO: 29823 - protein, 28 aa, Artificial Sequence
  Description of Artificial Sequence: Synthetic peptide
DEEEIRTTNPEATEQYGSVITDLQTGNQ

SEQ ID NO: 29824 - protein, 32 aa, Artificial Sequence
  Description of Artificial Sequence: Synthetic polypeptide
DEEEIRTTNPVATEQYGSVDSDTNLELRDGNR

SEQ ID NO: 29825 - protein, 28 aa, Artificial Sequence
  Description of Artificial Sequence: Synthetic peptide
DEQEIATTNPVATEQYGWVSTNLQYGNL

SEQ ID NO: 29826 - protein, 28 aa, Artificial Sequence
  Description of Artificial Sequence: Synthetic peptide
DEEEIATTNPVCTEQYGSVSTDLQHGNA

SEQ ID NO: 29827 - protein, 28 aa, Artificial Sequence
  Description of Artificial Sequence: Synthetic peptide
DEEEIRCTNPVATEVYGVVSTNLQYGNF

SEQ ID NO: 29828 - protein, 28 aa, Artificial Sequence
  Description of Artificial Sequence: Synthetic peptide
DEEEIRTTNPCATEPYGSASMNLQTGNR

SEQ ID NO: 29829 - protein, 30 aa, Artificial Sequence
  Description of Artificial Sequence: Synthetic polypeptide
DEEEIRTTNPVATEQYGDVSCTELQCGGNR

SEQ ID NO: 29830 - protein, 30 aa, Artificial Sequence
  Description of Artificial Sequence: Synthetic polypeptide
DEEEIRTTNPVATEQYGYVSTNLVQMMGND

SEQ ID NO: 29831 - protein, 28 aa, Artificial Sequence
  Description of Artificial Sequence: Synthetic peptide
DEQEIACTNPVATEMYGWVSTNLQRGNR

SEQ ID NO: 29832 - protein, 30 aa, Artificial Sequence
  Description of Artificial Sequence: Synthetic polypeptide
NEEEIACTNPVATEQYGSVSTNPLQDRGNR

SEQ ID NO: 29833 - protein, 28 aa, Artificial Sequence
  Description of Artificial Sequence: Synthetic peptide
MESEIRTTNPVATEQYGSVSTDLQVGNQ

SEQ ID NO: 29834 - protein, 31 aa, Artificial Sequence
  Description of Artificial Sequence: Synthetic polypeptide
DEEEIRTTNPVATEQYGSVSTNLDRDGDNEN

SEQ ID NO: 29835 - protein, 28 aa, Artificial Sequence
  Description of Artificial Sequence: Synthetic peptide
DEEEIRTTNPFATEQYGSVSTNPLRGEV

SEQ ID NO: 29836 - protein, 28 aa, Artificial Sequence
  Description of Artificial Sequence: Synthetic peptide
SEGEIVTTNPVATEQYGIVSTNLQGGNR

SEQ ID NO: 29837 - protein, 28 aa, Artificial Sequence
  Description of Artificial Sequence: Synthetic peptide
DEEEIATTNPTATEQYGSVSTNEQHGNL

SEQ ID NO: 29838 - protein, 28 aa, Artificial Sequence
  Description of Artificial Sequence: Synthetic peptide
DEEEIRATNPIATEQYGYASTNLQRGNA

SEQ ID NO: 29839 - protein, 30 aa, Artificial Sequence
  Description of Artificial Sequence: Synthetic polypeptide
DEEEIRTTNPVATEQYGDVSTCNPVQRGER

SEQ ID NO: 29840 - protein, 28 aa, Artificial Sequence
  Description of Artificial Sequence: Synthetic peptide
DEEEIRTTNPVATEQYGSVSTEEQPENP

SEQ ID NO: 29841 - protein, 28 aa, Artificial Sequence
  Description of Artificial Sequence: Synthetic peptide
DEEEIRTTNPVATEQFGSVSTNEQFGTA

SEQ ID NO: 29842 - protein, 29 aa, Artificial Sequence
  Description of Artificial Sequence: Synthetic peptide
DEEEIRTTNPVATEQYGESVDTPDQRGNW

SEQ ID NO: 29843 - protein, 28 aa, Artificial Sequence
  Description of Artificial Sequence: Synthetic peptide
SEEEIRTTNPTATEQFGSVSTNLQQGTR

SEQ ID NO: 29844 - protein, 28 aa, Artificial Sequence
  Description of Artificial Sequence: Synthetic peptide
DEQEIAATNPVATETYGWVSTNLQRGNR

SEQ ID NO: 29845 - protein, 28 aa, Artificial Sequence
  Description of Artificial Sequence: Synthetic peptide
DEHEIRTTNPVATEQYGWVDTNEQRGND

SEQ ID NO: 29846 - protein, 28 aa, Artificial Sequence
  Description of Artificial Sequence: Synthetic peptide
DENEIAATNPVATECYGSVSTELQRGNR

SEQ ID NO: 29847 - protein, 28 aa, Artificial Sequence
  Description of Artificial Sequence: Synthetic peptide
CEEEICTTNPVATELYGVVSTNLQRGER

SEQ ID NO: 29848 - protein, 28 aa, Artificial Sequence
  Description of Artificial Sequence: Synthetic peptide
MENEIRTTNPVATEQYGSVSTDLQTGNN

SEQ ID NO: 29849 - protein, 28 aa, Artificial Sequence
  Description of Artificial Sequence: Synthetic peptide
DEDEIRTTNPVATEQYGVVSENLQHGNH

SEQ ID NO: 29850 - protein, 28 aa, Artificial Sequence
  Description of Artificial Sequence: Synthetic peptide
DEEEIRTTNPVATDTYGSVSENLQHGQR

SEQ ID NO: 29851 - protein, 28 aa, Artificial Sequence
  Description of Artificial Sequence: Synthetic peptide
QEEEIRTTNPVATEQYGGVPMNLQRGER

SEQ ID NO: 29852 - protein, 30 aa, Artificial Sequence
  Description of Artificial Sequence: Synthetic polypeptide
DEDEIRTTNPVATEQYGSVDTNLQRGENDG

SEQ ID NO: 29853 - protein, 28 aa, Artificial Sequence
  Description of Artificial Sequence: Synthetic peptide
DEEEIRTTNPVATEQYGEAATVLQRGGR

SEQ ID NO: 29854 - protein, 28 aa, Artificial Sequence
  Description of Artificial Sequence: Synthetic peptide
EEEEISTTNPVATEQYGVVSTNLQNGND

SEQ ID NO: 29855 - protein, 28 aa, Artificial Sequence
  Description of Artificial Sequence: Synthetic peptide
DEEEIRTTNPVATEQYGGVSEELQLGNA

SEQ ID NO: 29856 - protein, 28 aa, Artificial Sequence
  Description of Artificial Sequence: Synthetic peptide
EEEEIRTTNPVATESYGSVSENLQGLNR

SEQ ID NO: 29857 - protein, 28 aa, Artificial Sequence
  Description of Artificial Sequence: Synthetic peptide
DENEIRCTNPVATEVYGSVATNLQRGNF

SEQ ID NO: 29858 - protein, 33 aa, Artificial Sequence
  Description of Artificial Sequence: Synthetic polypeptide
DEEEIRTTNPVATEQYGSVSVTNGLQRKGLNDR

SEQ ID NO: 29859 - protein, 30 aa, Artificial Sequence
  Description of Artificial Sequence: Synthetic polypeptide
DEEEIRTTNPTATEQYGSVSTMNEQRGDNQ

SEQ ID NO: 29860 - protein, 28 aa, Artificial Sequence
  Description of Artificial Sequence: Synthetic peptide
DEEEVRTTNPVATESYGSVSTNWQRGDG

SEQ ID NO: 29861 - protein, 28 aa, Artificial Sequence
  Description of Artificial Sequence: Synthetic peptide
DEQEIRTTNPVATECYGSVSTDLQHGER

SEQ ID NO: 29862 - protein, 28 aa, Artificial Sequence
  Description of Artificial Sequence: Synthetic peptide
DEEEIRSTNPVASEGYGEVSCNLQRGNR

SEQ ID NO: 29863 - protein, 28 aa, Artificial Sequence
  Description of Artificial Sequence: Synthetic peptide
SEEEIRTTNPVATEQWGSVSENLMRGNF

SEQ ID NO: 29864 - protein, 30 aa, Artificial Sequence
  Description of Artificial Sequence: Synthetic polypeptide
DEHEIRTTNPVATEQYGSVSTMNLQTNGTR

SEQ ID NO: 29865 - protein, 28 aa, Artificial Sequence
  Description of Artificial Sequence: Synthetic peptide
DETEIAATNPVATEMYGTVSTNLQRGNR

SEQ ID NO: 29866 - protein, 28 aa, Artificial Sequence
  Description of Artificial Sequence: Synthetic peptide
MEEEIRATNPVASEQYGEVSDNLQRGNR

SEQ ID NO: 29867 - protein, 28 aa, Artificial Sequence
  Description of Artificial Sequence: Synthetic peptide
SEEEIRTTNPTATEQFGSVSTNEQQGNR

SEQ ID NO: 29868 - protein, 30 aa, Artificial Sequence
  Description of Artificial Sequence: Synthetic polypeptide
DEEEVRTTNPVATEQYGCVSATNLERNGNR

SEQ ID NO: 29869 - protein, 32 aa, Artificial Sequence
  Description of Artificial Sequence: Synthetic polypeptide
DEEEIRTTNPVATEQYGSVSTNLPQDREGDTR

SEQ ID NO: 29870 - protein, 28 aa, Artificial Sequence
  Description of Artificial Sequence: Synthetic peptide
DEEEIRATNPVATEMYGSVSENEQRGTR

SEQ ID NO: 29871 - protein, 28 aa, Artificial Sequence
  Description of Artificial Sequence: Synthetic peptide
QENEICTTNPVATEQYGWVSDNLQRGNR

SEQ ID NO: 29872 - protein, 28 aa, Artificial Sequence
  Description of Artificial Sequence: Synthetic peptide
QEDEISTTNPVATEQYGEVSENLQRGNR

SEQ ID NO: 29873 - protein, 30 aa, Artificial Sequence
  Description of Artificial Sequence: Synthetic polypeptide
DEEEIRCTNPVATENYGDVSATNLQRGNDR

SEQ ID NO: 29874 - protein, 28 aa, Artificial Sequence
  Description of Artificial Sequence: Synthetic peptide
DEECIRTTNPVCTEQYGSVSYNLQPGND

SEQ ID NO: 29875 - protein, 28 aa, Artificial Sequence
  Description of Artificial Sequence: Synthetic peptide
DEEEIRTTNPFATEQYGSVSTNLIGGEQ

SEQ ID NO: 29876 - protein, 28 aa, Artificial Sequence
  Description of Artificial Sequence: Synthetic peptide
DENEIRTTNPVATEQWGSVSENEQRGNW

SEQ ID NO: 29877 - protein, 31 aa, Artificial Sequence
  Description of Artificial Sequence: Synthetic polypeptide
DEEEIRTTNPVATEQYGFVSTENLQRGENEQ

SEQ ID NO: 29878 - protein, 28 aa, Artificial Sequence
  Description of Artificial Sequence: Synthetic peptide
QEEEITTTNPVATEQYGSVSTDLQSGND

SEQ ID NO: 29879 - protein, 28 aa, Artificial Sequence
  Description of Artificial Sequence: Synthetic peptide
DEEEIRTTNPCAYECYGSVATNLERGNR

SEQ ID NO: 29880 - protein, 28 aa, Artificial Sequence
  Description of Artificial Sequence: Synthetic peptide
DEEEIATTNPTATEQYGSVSENLQQGTR

SEQ ID NO: 29881 - protein, 28 aa, Artificial Sequence
  Description of Artificial Sequence: Synthetic peptide
GEEEICTTNPVATEQYGSVSANLQRGTY

SEQ ID NO: 29882 - protein, 29 aa, Artificial Sequence
  Description of Artificial Sequence: Synthetic peptide
QEEEIRTTNPVATEIYGVVSTNLQRGENQ

SEQ ID NO: 29883 - protein, 29 aa, Artificial Sequence
  Description of Artificial Sequence: Synthetic peptide
DEEEVRTTNPVATEQYGSVSLTNLEQGNS

SEQ ID NO: 29884 - protein, 30 aa, Artificial Sequence
  Description of Artificial Sequence: Synthetic polypeptide
DEEEIRATNPVATEQYGFVSMTNLFQGGNR

SEQ ID NO: 29885 - protein, 28 aa, Artificial Sequence
  Description of Artificial Sequence: Synthetic peptide
DEEEIRTTNPVATEQYGSVSDNLDREEN

SEQ ID NO: 29886 - protein, 28 aa, Artificial Sequence
  Description of Artificial Sequence: Synthetic peptide
DEQEIRTTNPVATECYGSVSTDLERGER

SEQ ID NO: 29887 - protein, 28 aa, Artificial Sequence
  Description of Artificial Sequence: Synthetic peptide
DEEEICTTNPVATEQYGEAATNLQRGNM

SEQ ID NO: 29888 - protein, 28 aa, Artificial Sequence
  Description of Artificial Sequence: Synthetic peptide
AEEEIAQTNPVATENYGSVSTNLQRGER

SEQ ID NO: 29889 - protein, 28 aa, Artificial Sequence
  Description of Artificial Sequence: Synthetic peptide
DEEELRTTNPVCTEQYGSVATDYQRGNR

SEQ ID NO: 29890 - protein, 28 aa, Artificial Sequence
  Description of Artificial Sequence: Synthetic peptide
AEDEISTTNPVATEQYGWVSDNLQRGNR

SEQ ID NO: 29891 - protein, 31 aa, Artificial Sequence
  Description of Artificial Sequence: Synthetic polypeptide
DEEEIRSTNPVATEQYGSVSTNLQDRGDNDQ

SEQ ID NO: 29892 - protein, 28 aa, Artificial Sequence
  Description of Artificial Sequence: Synthetic peptide
DEEELRTTNPVATEHYGEVGTNLQRGER

SEQ ID NO: 29893 - protein, 28 aa, Artificial Sequence
  Description of Artificial Sequence: Synthetic peptide
DEVEIRTTNPVATEQFGSVSTNEQRGDF

SEQ ID NO: 29894 - protein, 29 aa, Artificial Sequence
  Description of Artificial Sequence: Synthetic peptide
DEEEIATTNPVATEQYGSVSTEPQEHGNR

SEQ ID NO: 29895 - protein, 28 aa, Artificial Sequence
  Description of Artificial Sequence: Synthetic peptide
DEDEIRTTNPVATEMYGVVSTILQRGNA

SEQ ID NO: 29896 - protein, 28 aa, Artificial Sequence
  Description of Artificial Sequence: Synthetic peptide
MENEIRTTNPVATECYGSVSTDLQNGNR

SEQ ID NO: 29897 - protein, 28 aa, Artificial Sequence
  Description of Artificial Sequence: Synthetic peptide
DEEEIRCTNPEATELYGSVSANLQSGNR

SEQ ID NO: 29898 - protein, 28 aa, Artificial Sequence
  Description of Artificial Sequence: Synthetic peptide
AEEEIRCTNPVATEQYGSASENLQLGNR

SEQ ID NO: 29899 - protein, 28 aa, Artificial Sequence
  Description of Artificial Sequence: Synthetic peptide
DEEEIRTTNPVATEQYGSVETNLDPGEP

SEQ ID NO: 29900 - protein, 28 aa, Artificial Sequence
  Description of Artificial Sequence: Synthetic peptide
DDEEIRTTNPVATEQYGSVSTALMVGNF

SEQ ID NO: 29901 - protein, 28 aa, Artificial Sequence
  Description of Artificial Sequence: Synthetic peptide
DEQEIATTNPVATEQYGSVSTDLQHGNA

SEQ ID NO: 29902 - protein, 28 aa, Artificial Sequence
  Description of Artificial Sequence: Synthetic peptide
MEEEIRTTNPVATECYGSVSTDLQNGNM

SEQ ID NO: 29903 - protein, 31 aa, Artificial Sequence
  Description of Artificial Sequence: Synthetic polypeptide
DEEEIRTTNPVATEQYGSVSTNPLTDIRDNR

SEQ ID NO: 29904 - protein, 28 aa, Artificial Sequence
  Description of Artificial Sequence: Synthetic peptide
DEEEIRTTNPVATEQYGSVDTDDERGND

SEQ ID NO: 29905 - protein, 29 aa, Artificial Sequence
  Description of Artificial Sequence: Synthetic peptide
DEEEIRTTNPVAYEIYGSVSANNLERGNR

SEQ ID NO: 29906 - protein, 31 aa, Artificial Sequence
  Description of Artificial Sequence: Synthetic polypeptide
DEEEIRTTNPVATEQYGSVSETENLQIGNDE

SEQ ID NO: 29907 - protein, 28 aa, Artificial Sequence
  Description of Artificial Sequence: Synthetic peptide
DEEEIRTTNPVATECYGSVSTDLEQGNI

SEQ ID NO: 29908 - protein, 31 aa, Artificial Sequence
  Description of Artificial Sequence: Synthetic polypeptide
DEEEIRTTNPVATEQYGESWADTNLQRGNDR

SEQ ID NO: 29909 - protein, 28 aa, Artificial Sequence
  Description of Artificial Sequence: Synthetic peptide
DEVEIATTNPVATEQYGEVSTNEQQGNR

SEQ ID NO: 29910 - protein, 32 aa, Artificial Sequence
  Description of Artificial Sequence: Synthetic polypeptide
DEEEIRTTNPVATEQYGSVCSDTNLQDRGDER

SEQ ID NO: 29911 - protein, 28 aa, Artificial Sequence
  Description of Artificial Sequence: Synthetic peptide
DEEEIRTTNPVATEQYGSCSEQLQNGNQ

SEQ ID NO: 29912 - protein, 28 aa, Artificial Sequence
  Description of Artificial Sequence: Synthetic peptide
QEAEIATTNPVASEQYGSVSTNLQRGPR

SEQ ID NO: 29913 - protein, 28 aa, Artificial Sequence
  Description of Artificial Sequence: Synthetic peptide
MENEIRTTNPVATEQYGVVSTNLERGNM

SEQ ID NO: 29914 - protein, 28 aa, Artificial Sequence
  Description of Artificial Sequence: Synthetic peptide
DEQEIRTTNPVATEQWGSVSTNEMRGNA

SEQ ID NO: 29915 - protein, 28 aa, Artificial Sequence
  Description of Artificial Sequence: Synthetic peptide
QENEIVTTNPVATEQYGDVSENLQRGNR

SEQ ID NO: 29916 - protein, 31 aa, Artificial Sequence
  Description of Artificial Sequence: Synthetic polypeptide
DEEEIRTTNPVATEQYGSVSTNLQLDNGNDF

SEQ ID NO: 29917 - protein, 28 aa, Artificial Sequence
  Description of Artificial Sequence: Synthetic peptide
DEQEIATTNPVATEIYGVVGTNLQRGNR

SEQ ID NO: 29918 - protein, 28 aa, Artificial Sequence
  Description of Artificial Sequence: Synthetic peptide
DEVEIRTTNPVATEIYGSVSENLQLGDR

SEQ ID NO: 29919 - protein, 28 aa, Artificial Sequence
  Description of Artificial Sequence: Synthetic peptide
DENEIWTTNPCATEIYGSVSTNLQHGNR

SEQ ID NO: 29920 - protein, 30 aa, Artificial Sequence
  Description of Artificial Sequence: Synthetic polypeptide
DEEEIRTTNPVATEQYGSVSTIDPDQRGER

SEQ ID NO: 29921 - protein, 32 aa, Artificial Sequence
  Description of Artificial Sequence: Synthetic polypeptide
DEEEIRTTNPVATEQYGSVSATNLQLNGDNFR

SEQ ID NO: 29922 - protein, 28 aa, Artificial Sequence
  Description of Artificial Sequence: Synthetic peptide
DENEIVTTNPVATEQWGSVSTNLMRGNF

SEQ ID NO: 29923 - protein, 30 aa, Artificial Sequence
  Description of Artificial Sequence: Synthetic polypeptide
DEEEIRTTNPVATECYGSVSTNLQDLEGNM

SEQ ID NO: 29924 - protein, 32 aa, Artificial Sequence
  Description of Artificial Sequence: Synthetic polypeptide
DEEEIRTTNPVATEQYGSVSTGNEQDREGDNR

SEQ ID NO: 29925 - protein, 28 aa, Artificial Sequence
  Description of Artificial Sequence: Synthetic peptide
DEEEIQSTNPVATEQYGSVSENLQHNNR

SEQ ID NO: 29926 - protein, 30 aa, Artificial Sequence
  Description of Artificial Sequence: Synthetic polypeptide
KEEEIRTTNPVATEQYGSVSTDLQERQGER

SEQ ID NO: 29927 - protein, 28 aa, Artificial Sequence
  Description of Artificial Sequence: Synthetic peptide
AEDEIVTTNPVATEQYGEVSDNLQRGNR

SEQ ID NO: 29928 - protein, 28 aa, Artificial Sequence
  Description of Artificial Sequence: Synthetic peptide
DEEEIATTNPVATECYGSVSENLQHGNV

SEQ ID NO: 29929 - protein, 28 aa, Artificial Sequence
  Description of Artificial Sequence: Synthetic peptide
DEEEIRTTNPVATEQYGDVSEDLQHGNL

SEQ ID NO: 29930 - protein, 28 aa, Artificial Sequence
  Description of Artificial Sequence: Synthetic peptide
DEVEICTTNPVATEQYGSVSENLQRGDN

SEQ ID NO: 29931 - protein, 30 aa, Artificial Sequence
  Description of Artificial Sequence: Synthetic polypeptide
GEEEIRTTNPVATEQYGCVSVTNLQQRGNG

SEQ ID NO: 29932 - protein, 28 aa, Artificial Sequence
  Description of Artificial Sequence: Synthetic peptide
DEQEIRTTNPVATECYGSVSTPLERGNS

SEQ ID NO: 29933 - protein, 28 aa, Artificial Sequence
  Description of Artificial Sequence: Synthetic peptide
DEQEIRTTNPVATEQWGSVSENLMQGNR

SEQ ID NO: 29934 - protein, 28 aa, Artificial Sequence
  Description of Artificial Sequence: Synthetic peptide
DENEIRTTNPVATEQWGSVSENLQQGNA

SEQ ID NO: 29935 - protein, 30 aa, Artificial Sequence
  Description of Artificial Sequence: Synthetic polypeptide
DEEEIRTTNPVATEQYGSVSTGDLQRENEM

SEQ ID NO: 29936 - protein, 29 aa, Artificial Sequence
  Description of Artificial Sequence: Synthetic peptide
MENEIRTTNPVATEQYGSVSTNLQDRGTM

SEQ ID NO: 29937 - protein, 28 aa, Artificial Sequence
  Description of Artificial Sequence: Synthetic peptide
DENEIATTNPVATEQYGDVSTNPQRENR

SEQ ID NO: 29938 - protein, 28 aa, Artificial Sequence
  Description of Artificial Sequence: Synthetic peptide
AEQEIATTNPVSTEHYGSVSTNLQRGNR

SEQ ID NO: 29939 - protein, 28 aa, Artificial Sequence
  Description of Artificial Sequence: Synthetic peptide
MENEIRTTNPVATEQYGSVSTNLQSGDA

SEQ ID NO: 29940 - protein, 28 aa, Artificial Sequence
  Description of Artificial Sequence: Synthetic peptide
DEEEIGTTNPVATETYGSVSDILQSGNR

SEQ ID NO: 29941 - protein, 28 aa, Artificial Sequence
  Description of Artificial Sequence: Synthetic peptide
DEQEIRTTNPVATEQYGVVSDNLQAGNA

SEQ ID NO: 29942 - protein, 30 aa, Artificial Sequence
  Description of Artificial Sequence: Synthetic polypeptide
DEEEIRTTNPVATECYGSVSTNLQQKGNDE

SEQ ID NO: 29943 - protein, 28 aa, Artificial Sequence
  Description of Artificial Sequence: Synthetic peptide
DEEEIRTTNPVATEQYGDVSENLQHGEL

SEQ ID NO: 29944 - protein, 28 aa, Artificial Sequence
  Description of Artificial Sequence: Synthetic peptide
DEEEISTTNPVATEQFGSVSTNEQRGLF

SEQ ID NO: 29945 - protein, 30 aa, Artificial Sequence
  Description of Artificial Sequence: Synthetic polypeptide
DEEEIRTTNPVATEQYGSVDTMNLQNGNDV

SEQ ID NO: 29946 - protein, 28 aa, Artificial Sequence
  Description of Artificial Sequence: Synthetic peptide
AEEEIVTTNPVATETYGCVATNLQRGNR

SEQ ID NO: 29947 - protein, 30 aa, Artificial Sequence
  Description of Artificial Sequence: Synthetic polypeptide
DEGEIRTTNPVATEQYGSVDSTNLQRGTFS

SEQ ID NO: 29948 - protein, 28 aa, Artificial Sequence
  Description of Artificial Sequence: Synthetic peptide
DESEIRTTNPTATECYGSVSENLQRGQR

SEQ ID NO: 29949 - protein, 28 aa, Artificial Sequence
  Description of Artificial Sequence: Synthetic peptide
DENEIVTTNPVATEQFGEVSVNLQRGNR

SEQ ID NO: 29950 - protein, 28 aa, Artificial Sequence
  Description of Artificial Sequence: Synthetic peptide
DESEIRCTNPVATEQYGCVSTNLQRGDH

SEQ ID NO: 29951 - protein, 28 aa, Artificial Sequence
  Description of Artificial Sequence: Synthetic peptide
DEEEVRTTNPIATEQYGCVATNLERGNR

SEQ ID NO: 29952 - protein, 28 aa, Artificial Sequence
  Description of Artificial Sequence: Synthetic peptide
QEQEIATTNPVATEQYGWVSENLQRGNR

SEQ ID NO: 29953 - protein, 29 aa, Artificial Sequence
  Description of Artificial Sequence: Synthetic peptide
DEQEIRTTNPVCTEQYGSVSTNLQQHGNA

SEQ ID NO: 29954 - protein, 31 aa, Artificial Sequence
  Description of Artificial Sequence: Synthetic polypeptide
DENEIRTTNPVATEQYGSVPSTDNLQVDGNR

SEQ ID NO: 29955 - protein, 28 aa, Artificial Sequence
  Description of Artificial Sequence: Synthetic peptide
YEEEICTTNPVATEVYGSVSTNLQHGNL

SEQ ID NO: 29956 - protein, 28 aa, Artificial Sequence
  Description of Artificial Sequence: Synthetic peptide
DQEEIRTTNPVATEQYGSVSENLQTGDV

SEQ ID NO: 29957 - protein, 33 aa, Artificial Sequence
  Description of Artificial Sequence: Synthetic polypeptide
DEEEIRTTNPVATEQYGSVSSTTPNLPQRGNPR

SEQ ID NO: 29958 - protein, 28 aa, Artificial Sequence
  Description of Artificial Sequence: Synthetic peptide
AEEEIGTTNPVATEQYGVVSDQLQRGNR

SEQ ID NO: 29959 - protein, 32 aa, Artificial Sequence
  Description of Artificial Sequence: Synthetic polypeptide
DEEEIRTTNPVATEQYGSYVSTTNLQRGEEDR

SEQ ID NO: 29960 - protein, 28 aa, Artificial Sequence
  Description of Artificial Sequence: Synthetic peptide
DEQEIATTNPVSTEVYGSVSENLQRGNR

SEQ ID NO: 29961 - protein, 28 aa, Artificial Sequence
  Description of Artificial Sequence: Synthetic peptide
DEEEIRTTNPVATECWGSVSENLMRGNM

SEQ ID NO: 29962 - protein, 30 aa, Artificial Sequence
  Description of Artificial Sequence: Synthetic polypeptide
AEEEIATTNPVATEQYGSVASTNLERGNDR

SEQ ID NO: 29963 - protein, 32 aa, Artificial Sequence
  Description of Artificial Sequence: Synthetic polypeptide
DEEEIRTTNPVATEQYGSVSTTDLQIREGNDR

SEQ ID NO: 29964 - protein, 28 aa, Artificial Sequence
  Description of Artificial Sequence: Synthetic peptide
DEEEIRTTNPVATEQYGSVSTEDQIGDN

SEQ ID NO: 29965 - protein, 28 aa, Artificial Sequence
  Description of Artificial Sequence: Synthetic peptide
SEEEIRATNPVATEQFGSVSTNLQQGTR

SEQ ID NO: 29966 - protein, 28 aa, Artificial Sequence
  Description of Artificial Sequence: Synthetic peptide
CESEIATTNPVATEQYGSVSESLQRGNR

SEQ ID NO: 29967 - protein, 28 aa, Artificial Sequence
  Description of Artificial Sequence: Synthetic peptide
DENEIRTTNPVATEQYGGVSTNPQRGDA

SEQ ID NO: 29968 - protein, 28 aa, Artificial Sequence
  Description of Artificial Sequence: Synthetic peptide
DEEEIRTTNPVATEMYGSVSTNEQNEDR

SEQ ID NO: 29969 - protein, 28 aa, Artificial Sequence
  Description of Artificial Sequence: Synthetic peptide
DEEEIRTVNPVATEHYGTVATNLQRGTR

SEQ ID NO: 29970 - protein, 28 aa, Artificial Sequence
  Description of Artificial Sequence: Synthetic peptide
DEEEIRTTNPAATEQYGSVSTNGAHGNH

SEQ ID NO: 29971 - protein, 28 aa, Artificial Sequence
  Description of Artificial Sequence: Synthetic peptide
DEEEIRSTNPVATESYGSVADNLQRGNV

SEQ ID NO: 29972 - protein, 30 aa, Artificial Sequence
  Description of Artificial Sequence: Synthetic polypeptide
DEEEIRTTNPVATEQWGNVSTNLQIRNGNI

SEQ ID NO: 29973 - protein, 30 aa, Artificial Sequence
  Description of Artificial Sequence: Synthetic polypeptide
DEEEIRTTNPVATEQYGSVSTNDDNGENDR

SEQ ID NO: 29974 - protein, 28 aa, Artificial Sequence
  Description of Artificial Sequence: Synthetic peptide
DEEEIATTNPVATECYGSVSTNLQVGEM

SEQ ID NO: 29975 - protein, 28 aa, Artificial Sequence
  Description of Artificial Sequence: Synthetic peptide
SEEEIVTTNPVATFQYGSVSTPLERGNR

SEQ ID NO: 29976 - protein, 28 aa, Artificial Sequence
  Description of Artificial Sequence: Synthetic peptide
DEQEIRTTNPVATEQYGSVETNDQIGER

SEQ ID NO: 29977 - protein, 28 aa, Artificial Sequence
  Description of Artificial Sequence: Synthetic peptide
DEEEIATTNPCCTEQYGSVSTDLQHGNR

SEQ ID NO: 29978 - protein, 31 aa, Artificial Sequence
  Description of Artificial Sequence: Synthetic polypeptide
DEEEIRTTNPVATEQYGSVSTNLQLVNGNDD

SEQ ID NO: 29979 - protein, 30 aa, Artificial Sequence
  Description of Artificial Sequence: Synthetic polypeptide
DEEEIATTNPVATDQYGSVSTMNLQTHGNR

SEQ ID NO: 29980 - protein, 28 aa, Artificial Sequence
  Description of Artificial Sequence: Synthetic peptide
DEEEIRTTNPVAHMQYGSVSTGLDRGNE

SEQ ID NO: 29981 - protein, 28 aa, Artificial Sequence
  Description of Artificial Sequence: Synthetic peptide
SEEEIRPTNPVATEQYGSVSTEQQRGMR

SEQ ID NO: 29982 - protein, 31 aa, Artificial Sequence
  Description of Artificial Sequence: Synthetic polypeptide
DEEEIRTTNPVATEQYGESVSTENDVQAGNR

SEQ ID NO: 29983 - protein, 29 aa, Artificial Sequence
  Description of Artificial Sequence: Synthetic peptide
DEEEIATTNPTATEQYGSVSTNLQNGDNL

SEQ ID NO: 29984 - protein, 28 aa, Artificial Sequence
  Description of Artificial Sequence: Synthetic peptide
DEEEIRTTNPVATEQYGSMSTDLQWGDN

SEQ ID NO: 29985 - protein, 29 aa, Artificial Sequence
  Description of Artificial Sequence: Synthetic peptide
DEEEIRCTNPVATEQWGSVDTNDQMRGNR

SEQ ID NO: 29986 - protein, 29 aa, Artificial Sequence
  Description of Artificial Sequence: Synthetic peptide
DEEEIATTNPVATEVYGSVSENLQHAGNR

SEQ ID NO: 29987 - protein, 28 aa, Artificial Sequence
  Description of Artificial Sequence: Synthetic peptide
DEEEIRATNPVATECYGDVSTNLQRGTT

SEQ ID NO: 29988 - protein, 28 aa, Artificial Sequence
  Description of Artificial Sequence: Synthetic peptide
DEEEIRATNPVATECFGSVSTNPQRGLR

SEQ ID NO: 29989 - protein, 29 aa, Artificial Sequence
  Description of Artificial Sequence: Synthetic peptide
DEEEIRTTNPVATEQWGSVSENQQRGPNA

SEQ ID NO: 29990 - protein, 31 aa, Artificial Sequence
  Description of Artificial Sequence: Synthetic polypeptide
DEEEIRTTNPVATEQYGSVSATNLQYGENDL

SEQ ID NO: 29991 - protein, 29 aa, Artificial Sequence
  Description of Artificial Sequence: Synthetic peptide
MEEEIRTTNPVATECYGSVSTNLEERGNS

SEQ ID NO: 29992 - protein, 29 aa, Artificial Sequence
  Description of Artificial Sequence: Synthetic peptide
NEDEISTTNPVATEQYGSVSTDLQRGNDR

SEQ ID NO: 29993 - protein, 28 aa, Artificial Sequence
  Description of Artificial Sequence: Synthetic peptide
DEEEISTTNPVATEIYGVVATNLQRGNH

SEQ ID NO: 29994 - protein, 28 aa, Artificial Sequence
  Description of Artificial Sequence: Synthetic peptide
DENEIATTNPFATEQYGSVSTNLQRGED

SEQ ID NO: 29995 - protein, 28 aa, Artificial Sequence
  Description of Artificial Sequence: Synthetic peptide
DEEEIRTTNPVATEQYGSVDTGLDDGDR

SEQ ID NO: 29996 - protein, 28 aa, Artificial Sequence
  Description of Artificial Sequence: Synthetic peptide
AEEEISTTNPVATEQYGNVSTNLQRGTQ

SEQ ID NO: 29997 - protein, 28 aa, Artificial Sequence
  Description of Artificial Sequence: Synthetic peptide
DENEIVTTNPVATEQYGSVSTNLQHGEL

SEQ ID NO: 29998 - protein, 28 aa, Artificial Sequence
  Description of Artificial Sequence: Synthetic peptide
DEEEIRTTNPVATEIYGSTSDNLQNGNM

SEQ ID NO: 29999 - protein, 28 aa, Artificial Sequence
  Description of Artificial Sequence: Synthetic peptide
DEQEIRTTNPVATEQYGSVSTDDQHGNA

SEQ ID NO: 30000 - protein, 28 aa, Artificial Sequence
  Description of Artificial Sequence: Synthetic peptide
DEEEIRTTNPVATEVYGEVSEVLQHGNR

SEQ ID NO: 30001 - protein, 28 aa, Artificial Sequence
  Description of Artificial Sequence: Synthetic peptide
DENEIRTTNPVSTEQWGSVSENLQRGNM

SEQ ID NO: 30002 - protein, 31 aa, Artificial Sequence
  Description of Artificial Sequence: Synthetic polypeptide
DEEEIRTTNPVATEQYGSVSTDLQVKGDNPR

SEQ ID NO: 30003 - protein, 29 aa, Artificial Sequence
  Description of Artificial Sequence: Synthetic peptide
DEEEIRTVNPVATESYGSVSSNLQRGEDR

SEQ ID NO: 30004 - protein, 28 aa, Artificial Sequence
  Description of Artificial Sequence: Synthetic peptide
DEAEIRTTNGVAYCQYGSVSTNLQRGDR

SEQ ID NO: 30005 - protein, 28 aa, Artificial Sequence
  Description of Artificial Sequence: Synthetic peptide
DEEEIRCTNPVATEQYGSVSTNDQQGDM

SEQ ID NO: 30006 - protein, 29 aa, Artificial Sequence
  Description of Artificial Sequence: Synthetic peptide
DEEEIRTTNPVATEQWGSVDTNLEMRGNS

SEQ ID NO: 30007 - protein, 28 aa, Artificial Sequence
  Description of Artificial Sequence: Synthetic peptide
DEEEIRTTNPVATEQYGQVSTPDQMGNQ

SEQ ID NO: 30008 - protein, 28 aa, Artificial Sequence
  Description of Artificial Sequence: Synthetic peptide
DEEEIATTNPVATEQWGQVSTNLQQGNM

SEQ ID NO: 30009 - protein, 28 aa, Artificial Sequence
  Description of Artificial Sequence: Synthetic peptide
DEEAIRTTNPVATQQYGSVDTNDQRGNP

SEQ ID NO: 30010 - protein, 28 aa, Artificial Sequence
  Description of Artificial Sequence: Synthetic peptide
DEQEIATTNPVATECYGSVSTDLQHGNR

SEQ ID NO: 30011 - protein, 29 aa, Artificial Sequence
  Description of Artificial Sequence: Synthetic peptide
DEEEIRTTNPVATEQYGSVSTELQELGES

SEQ ID NO: 30012 - protein, 28 aa, Artificial Sequence
  Description of Artificial Sequence: Synthetic peptide
DEEEIRTTNPVATEQYGSVETEDQQGER

SEQ ID NO: 30013 - protein, 31 aa, Artificial Sequence
  Description of Artificial Sequence: Synthetic polypeptide
DEEEIRTTNPVAWEQYGSVSCTNLQRGDNGN

SEQ ID NO: 30014 - protein, 28 aa, Artificial Sequence
  Description of Artificial Sequence: Synthetic peptide
HEEEINTTNPVGTEQYGEVSTNLQRDNR

SEQ ID NO: 30015 - protein, 28 aa, Artificial Sequence
  Description of Artificial Sequence: Synthetic peptide
DEEEIRTTNPVATEQYGWVSDNLQEGEA

SEQ ID NO: 30016 - protein, 30 aa, Artificial Sequence
  Description of Artificial Sequence: Synthetic polypeptide
DEEEIRTTNPVATEQYGSVSTEDQDRGDNT

SEQ ID NO: 30017 - protein, 31 aa, Artificial Sequence
  Description of Artificial Sequence: Synthetic polypeptide
DEEEIRTTNPVATEQYGSVSETNLERDGDNN

SEQ ID NO: 30018 - protein, 28 aa, Artificial Sequence
  Description of Artificial Sequence: Synthetic peptide
SEEEIRTTNPTATECFGSVSTNLQQGNR

SEQ ID NO: 30019 - protein, 28 aa, Artificial Sequence
  Description of Artificial Sequence: Synthetic peptide
DEEEIRTTNPVATEQYGSVETDDEVGNR

SEQ ID NO: 30020 - protein, 28 aa, Artificial Sequence
  Description of Artificial Sequence: Synthetic peptide
DENELRTTNPVATEQYGEVSDNLQRGNS

SEQ ID NO: 30021 - protein, 29 aa, Artificial Sequence
  Description of Artificial Sequence: Synthetic peptide
DEEEIRQTNPVATEGYGSVSTNLQRAGEK

SEQ ID NO: 30022 - protein, 28 aa, Artificial Sequence
  Description of Artificial Sequence: Synthetic peptide
DEEEIRTTNPVATEWWGSVSEPLQRGNT

SEQ ID NO: 30023 - protein, 28 aa, Artificial Sequence
  Description of Artificial Sequence: Synthetic peptide
DEEEIRTTNPVATEQYGDVSENLMHGQR

SEQ ID NO: 30024 - protein, 28 aa, Artificial Sequence
  Description of Artificial Sequence: Synthetic peptide
SEEEIRCTNPVATECYGSVSTNVQRGNH

SEQ ID NO: 30025 - protein, 29 aa, Artificial Sequence
  Description of Artificial Sequence: Synthetic peptide
REEEIRTTNPVATEQYGSSVDTNLQRGIP

SEQ ID NO: 30026 - protein, 28 aa, Artificial Sequence
  Description of Artificial Sequence: Synthetic peptide
DEHEIRTTNPVSTEQYGSVSTALQHGNT

SEQ ID NO: 30027 - protein, 28 aa, Artificial Sequence
  Description of Artificial Sequence: Synthetic peptide
SEEEIVTTNPVATEIYGSVSTNQQRGNQ

SEQ ID NO: 30028 - protein, 29 aa, Artificial Sequence
  Description of Artificial Sequence: Synthetic peptide
DEEEIRTTNPVSTEIYGIVSTNLQNRGNA

SEQ ID NO: 30029 - protein, 28 aa, Artificial Sequence
  Description of Artificial Sequence: Synthetic peptide
DENEIRTTNPVATEQWGSVSENLMQGNR

SEQ ID NO: 30030 - protein, 28 aa, Artificial Sequence
  Description of Artificial Sequence: Synthetic peptide
DEEEIRTTNPVATEQYGEISTNLQQMVR

SEQ ID NO: 30031 - protein, 28 aa, Artificial Sequence
  Description of Artificial Sequence: Synthetic peptide
DEEEIRCTNPVATEQWGSVSENLQRGTA

SEQ ID NO: 30032 - protein, 31 aa, Artificial Sequence
  Description of Artificial Sequence: Synthetic polypeptide
DEEEIRTTNPVATEQYGSVSTNLEERNGNDS

SEQ ID NO: 30033 - protein, 28 aa, Artificial Sequence
  Description of Artificial Sequence: Synthetic peptide
DEEEIRTTNPVSTEQYGSYSENLMRGNQ

SEQ ID NO: 30034 - protein, 29 aa, Artificial Sequence
  Description of Artificial Sequence: Synthetic peptide
DEEEIRTTNPVATEQYGSVSENLMIQGNQ

SEQ ID NO: 30035 - protein, 29 aa, Artificial Sequence
  Description of Artificial Sequence: Synthetic peptide
DENEIRTTNPVATEQYGSVDTNLQSGNDV

SEQ ID NO: 30036 - protein, 30 aa, Artificial Sequence
  Description of Artificial Sequence: Synthetic polypeptide
DEEEIRTTNPVATECYGSVCSTNLQRGDEL

SEQ ID NO: 30037 - protein, 30 aa, Artificial Sequence
  Description of Artificial Sequence: Synthetic polypeptide
DEEEIRTTNPVATEQYGSVSTEPLQETGNQ

SEQ ID NO: 30038 - protein, 28 aa, Artificial Sequence
  Description of Artificial Sequence: Synthetic peptide
DEEEIATTNPVATEQYGSVSTNLEQGEQ

SEQ ID NO: 30039 - protein, 28 aa, Artificial Sequence
  Description of Artificial Sequence: Synthetic peptide
DEGEICTTNPVATEQFGEVSTNLQLGNR

SEQ ID NO: 30040 - protein, 28 aa, Artificial Sequence
  Description of Artificial Sequence: Synthetic peptide
DEEEIRTTNPVATEQYGSVSTDDEIGNW

SEQ ID NO: 30041 - protein, 28 aa, Artificial Sequence
  Description of Artificial Sequence: Synthetic peptide
DENEIATTNPVATEQYGSVSTNLEVGER

SEQ ID NO: 30042 - protein, 30 aa, Artificial Sequence
  Description of Artificial Sequence: Synthetic polypeptide
DEEEIRTTNPTATEQYGSVSTNPQEREGNN

SEQ ID NO: 30043 - protein, 31 aa, Artificial Sequence
  Description of Artificial Sequence: Synthetic polypeptide
DEEEIRTTNPVATEQYGQVSTNPGNQRGNFR

SEQ ID NO: 30044 - protein, 28 aa, Artificial Sequence
  Description of Artificial Sequence: Synthetic peptide
DENEIATTNPVATECYGSVSTDLQHGNR

SEQ ID NO: 30045 - protein, 28 aa, Artificial Sequence
  Description of Artificial Sequence: Synthetic peptide
DEEEIRATNPVATEQYGSVSTNVMRMNA

SEQ ID NO: 30046 - protein, 28 aa, Artificial Sequence
  Description of Artificial Sequence: Synthetic peptide
DEEELRTTNPVSTEQYGTVSTNIQRGNT

SEQ ID NO: 30047 - protein, 30 aa, Artificial Sequence
  Description of Artificial Sequence: Synthetic polypeptide
DEEEIRTTNPVATECYGSVSTNLQNEGNDM

SEQ ID NO: 30048 - protein, 28 aa, Artificial Sequence
  Description of Artificial Sequence: Synthetic peptide
DENEIRTTNPVATELWGSVSTNLMRGNM

SEQ ID NO: 30049 - protein, 28 aa, Artificial Sequence
  Description of Artificial Sequence: Synthetic peptide
DEDEVRTTNPVATEIYGSVSTNLQRGQM

SEQ ID NO: 30050 - protein, 28 aa, Artificial Sequence
  Description of Artificial Sequence: Synthetic peptide
DEEELRTTNPVAYENYGSVSNNLERGNR

SEQ ID NO: 30051 - protein, 31 aa, Artificial Sequence
  Description of Artificial Sequence: Synthetic polypeptide
DEQEIRTTNPVATEQYGSVSATNLQDRGEDR

SEQ ID NO: 30052 - protein, 29 aa, Artificial Sequence
  Description of Artificial Sequence: Synthetic peptide
DEEEIRTTNPVATEQYGSVSDTEDQRGDP

SEQ ID NO: 30053 - protein, 28 aa, Artificial Sequence
  Description of Artificial Sequence: Synthetic peptide
DEEEVATTNPVATETYGSASTNLQRGGR

SEQ ID NO: 30054 - protein, 28 aa, Artificial Sequence
  Description of Artificial Sequence: Synthetic peptide
QEEEIRTTNPVATECYGSVSNNLERGER

SEQ ID NO: 30055 - protein, 28 aa, Artificial Sequence
  Description of Artificial Sequence: Synthetic peptide
DEEEIATTNPVCTETYGSVSTNLQSGNQ

SEQ ID NO: 30056 - protein, 28 aa, Artificial Sequence
  Description of Artificial Sequence: Synthetic peptide
SEEEIRTTNPVATEQFGSVSTNLQSGTL

SEQ ID NO: 30057 - protein, 28 aa, Artificial Sequence
  Description of Artificial Sequence: Synthetic peptide
DEQEIRTTNPCATEQYGCVATNLQRGND

SEQ ID NO: 30058 - protein, 28 aa, Artificial Sequence
  Description of Artificial Sequence: Synthetic peptide
DEEEIRTTNPVATEQYGEVSDELQVGNY

SEQ ID NO: 30059 - protein, 28 aa, Artificial Sequence
  Description of Artificial Sequence: Synthetic peptide
DEEEIRPTNPVAYEQYGSVETGLDRGNR

SEQ ID NO: 30060 - protein, 30 aa, Artificial Sequence
  Description of Artificial Sequence: Synthetic polypeptide
DEEEIRTTNPVATEQYGSVSTNLDVEGEER

SEQ ID NO: 30061 - protein, 28 aa, Artificial Sequence
  Description of Artificial Sequence: Synthetic peptide
MENEIRTTNPVATEQYGDVSTNLQNGNS

SEQ ID NO: 30062 - protein, 28 aa, Artificial Sequence
  Description of Artificial Sequence: Synthetic peptide
DEEEIRTTNPVATEGYGSVSTEDQSGNL

SEQ ID NO: 30063 - protein, 28 aa, Artificial Sequence
  Description of Artificial Sequence: Synthetic peptide
QEEEIRTTNPVATEMYGSVSTNLQHGEA

SEQ ID NO: 30064 - protein, 28 aa, Artificial Sequence
  Description of Artificial Sequence: Synthetic peptide
DEQEIRTTNPVATEQYGSVDTEEQRGER

SEQ ID NO: 30065 - protein, 28 aa, Artificial Sequence
  Description of Artificial Sequence: Synthetic peptide
DEEEIRTTNPVATECYGSVDTNLEGGNF

SEQ ID NO: 30066 - protein, 31 aa, Artificial Sequence
  Description of Artificial Sequence: Synthetic polypeptide
DEEEIRTTNPVATEQYGSVDSTNPEVQRGER

SEQ ID NO: 30067 - protein, 28 aa, Artificial Sequence
  Description of Artificial Sequence: Synthetic peptide
DEVEIYTTNPVATEQYGSVSTNLQGGDN

SEQ ID NO: 30068 - protein, 28 aa, Artificial Sequence
  Description of Artificial Sequence: Synthetic peptide
DEEEISTTNPVASEQYGSVGTQLQRGNI

SEQ ID NO: 30069 - protein, 30 aa, Artificial Sequence
  Description of Artificial Sequence: Synthetic polypeptide
DEIEIRTTNPVATEQYGSVSTGNPQVGNWR

SEQ ID NO: 30070 - protein, 29 aa, Artificial Sequence
  Description of Artificial Sequence: Synthetic peptide
CEEEIRTVNPVATEQYGSVATNLQRDGLR

SEQ ID NO: 30071 - protein, 29 aa, Artificial Sequence
  Description of Artificial Sequence: Synthetic peptide
DENEIATTNPVATEQYGSVSTNLEREGER

SEQ ID NO: 30072 - protein, 29 aa, Artificial Sequence
  Description of Artificial Sequence: Synthetic peptide
DEQEIRTTNPVATEQYGSVSENLQDVGNS

SEQ ID NO: 30073 - protein, 28 aa, Artificial Sequence
  Description of Artificial Sequence: Synthetic peptide
KEEEIAATNPVATEQYGSVSDNLQYGNR

SEQ ID NO: 30074 - protein, 28 aa, Artificial Sequence
  Description of Artificial Sequence: Synthetic peptide
DETEIRTTNPVATEQYGEVSEILQYGNR

SEQ ID NO: 30075 - protein, 28 aa, Artificial Sequence
  Description of Artificial Sequence: Synthetic peptide
DESEIATTNPVASETYGSVSTILQRGNR

SEQ ID NO: 30076 - protein, 28 aa, Artificial Sequence
  Description of Artificial Sequence: Synthetic peptide
DENEIAQTNPVSTEQYGSVSTNLQRGDR

SEQ ID NO: 30077 - protein, 28 aa, Artificial Sequence
  Description of Artificial Sequence: Synthetic peptide
DEEEIRTTNPVATELYGSVSTNDQDGDY

SEQ ID NO: 30078 - protein, 28 aa, Artificial Sequence
  Description of Artificial Sequence: Synthetic peptide
DEEEIRTTNPEATEQYGTVSVNVQRGLR

SEQ ID NO: 30079 - protein, 28 aa, Artificial Sequence
  Description of Artificial Sequence: Synthetic peptide
DENEIRTTNPCATEQYGSVSTGLQRGTD

SEQ ID NO: 30080 - protein, 30 aa, Artificial Sequence
  Description of Artificial Sequence: Synthetic polypeptide
DEEEIRTTNPVATECYGSVSTNLQDVEGNI

SEQ ID NO: 30081 - protein, 28 aa, Artificial Sequence
  Description of Artificial Sequence: Synthetic peptide
MEEEITTTNPVATEQYGFVATNLQRGNM

SEQ ID NO: 30082 - protein, 29 aa, Artificial Sequence
  Description of Artificial Sequence: Synthetic peptide
DEEEIRTTNPVATEQWGSVSENLMMQGNR

SEQ ID NO: 30083 - protein, 28 aa, Artificial Sequence
  Description of Artificial Sequence: Synthetic peptide
QEEEIRTTNPTATECYGSVSTNLQIGNV

SEQ ID NO: 30084 - protein, 30 aa, Artificial Sequence
  Description of Artificial Sequence: Synthetic polypeptide
DEEEIRTTNPVATEGYGSVSTFNLQAGVNS

SEQ ID NO: 30085 - protein, 28 aa, Artificial Sequence
  Description of Artificial Sequence: Synthetic peptide
DEEEIRTTNPVATEQYGWVPDNLQRGTI

SEQ ID NO: 30086 - protein, 28 aa, Artificial Sequence
  Description of Artificial Sequence: Synthetic peptide
DEQEVATTNPVATEMYGWVSTNLQRGNR

SEQ ID NO: 30087 - protein, 28 aa, Artificial Sequence
  Description of Artificial Sequence: Synthetic peptide
DENEIRTVNPVATEQYGSVSTDLQLGNM

SEQ ID NO: 30088 - protein, 28 aa, Artificial Sequence
  Description of Artificial Sequence: Synthetic peptide
DEEEIRTTNPVATEQYGSVSTEPIYGNN

SEQ ID NO: 30089 - protein, 29 aa, Artificial Sequence
  Description of Artificial Sequence: Synthetic peptide
DEHEICTTNPVATECYGSVSTNLQTNGNR

SEQ ID NO: 30090 - protein, 31 aa, Artificial Sequence
  Description of Artificial Sequence: Synthetic polypeptide
DEEEIRTTNPVATEQYGSVSDTDLERDGNDR

SEQ ID NO: 30091 - protein, 28 aa, Artificial Sequence
  Description of Artificial Sequence: Synthetic peptide
DEEEIRTTNPVATEQYGSVSDNLQDEES

SEQ ID NO: 30092 - protein, 31 aa, Artificial Sequence
  Description of Artificial Sequence: Synthetic polypeptide
DEEEIRTTNPVATEQYGSVSTNLQEAEGNDL

SEQ ID NO: 30093 - protein, 28 aa, Artificial Sequence
  Description of Artificial Sequence: Synthetic peptide
DEEEIRTTNPVATEQWGSVDTNEQQGNW

SEQ ID NO: 30094 - protein, 28 aa, Artificial Sequence
  Description of Artificial Sequence: Synthetic peptide
DEQEIVATNPVATEQYGVVSTNLQRGNQ

SEQ ID NO: 30095 - protein, 28 aa, Artificial Sequence
  Description of Artificial Sequence: Synthetic peptide
DEEECRTTNPCATEQYGSVSTNWQRGDH

SEQ ID NO: 30096 - protein, 28 aa, Artificial Sequence
  Description of Artificial Sequence: Synthetic peptide
SENEIATTNPVATEQYGSVSTNLQRPNF

SEQ ID NO: 30097 - protein, 28 aa, Artificial Sequence
  Description of Artificial Sequence: Synthetic peptide
DEEEIRTTNPVATECYGSVSTDLQNGES

SEQ ID NO: 30098 - protein, 29 aa, Artificial Sequence
  Description of Artificial Sequence: Synthetic peptide
DEEEIRCTNPVSTEQYGSVSTNLMMQGNR

SEQ ID NO: 30099 - protein, 28 aa, Artificial Sequence
  Description of Artificial Sequence: Synthetic peptide
DEEEIRTTNPVATEQYGFVSENWQWGNK

SEQ ID NO: 30100 - protein, 30 aa, Artificial Sequence
  Description of Artificial Sequence: Synthetic polypeptide
DEEEIRTTNPVATEQYGSVSTMNEQIGDNF

SEQ ID NO: 30101 - protein, 28 aa, Artificial Sequence
  Description of Artificial Sequence: Synthetic peptide
DEEEIRTTNPFATEQYGSVSTPDDRGNA

SEQ ID NO: 30102 - protein, 29 aa, Artificial Sequence
  Description of Artificial Sequence: Synthetic peptide
DEEEIRTTNPVATEQYGSVSEMDLQQGNM

SEQ ID NO: 30103 - protein, 30 aa, Artificial Sequence
  Description of Artificial Sequence: Synthetic polypeptide
DEEEIATTNPVATEQYGSVPSTDNLQFGND

SEQ ID NO: 30104 - protein, 29 aa, Artificial Sequence
  Description of Artificial Sequence: Synthetic peptide
DENEIRTTNPVATEQYGSVSENEQMRGNA

SEQ ID NO: 30105 - protein, 29 aa, Artificial Sequence
  Description of Artificial Sequence: Synthetic peptide
YEEEIRCTNPVATEQYGDVSATNLQRGNQ

SEQ ID NO: 30106 - protein, 28 aa, Artificial Sequence
  Description of Artificial Sequence: Synthetic peptide
DEQEIRTTNPVATEQYGEASTNLQRLGR

SEQ ID NO: 30107 - protein, 28 aa, Artificial Sequence
  Description of Artificial Sequence: Synthetic peptide
DEEEIRTTNPVATQQYGDVSTPLQNGNN

SEQ ID NO: 30108 - protein, 28 aa, Artificial Sequence
  Description of Artificial Sequence: Synthetic peptide
DEEEIRSTNPCATEPYGSVSEDLQRGNR

SEQ ID NO: 30109 - protein, 28 aa, Artificial Sequence
  Description of Artificial Sequence: Synthetic peptide
DEEEIRTTNPCATEQYGSVAMNLQRGTA

SEQ ID NO: 30110 - protein, 30 aa, Artificial Sequence
  Description of Artificial Sequence: Synthetic polypeptide
DEEEIRTTNPVATEQYGSVSTDLQENEGNM

SEQ ID NO: 30111 - protein, 32 aa, Artificial Sequence
  Description of Artificial Sequence: Synthetic polypeptide
DEEEIRTTNPVATEQYGSVDSETNLQREGEER

SEQ ID NO: 30112 - protein, 28 aa, Artificial Sequence
  Description of Artificial Sequence: Synthetic peptide
DEEEISTTNPVSSEQYGSVATNLQRGNQ

SEQ ID NO: 30113 - protein, 29 aa, Artificial Sequence
  Description of Artificial Sequence: Synthetic peptide
SEEEIRCTNPVATEQYGSVSENLQRGNDL

SEQ ID NO: 30114 - protein, 28 aa, Artificial Sequence
  Description of Artificial Sequence: Synthetic peptide
DEEEIRQTNPVATEQYGSVSTAPQNGNV

SEQ ID NO: 30115 - protein, 32 aa, Artificial Sequence
  Description of Artificial Sequence: Synthetic polypeptide
DEEEIRTTNPTATEQYGSVSTNLQLREGDNTR

SEQ ID NO: 30116 - protein, 30 aa, Artificial Sequence
  Description of Artificial Sequence: Synthetic polypeptide
DEEEIRTTNPVATELYGSVSCTMNDERGNR

SEQ ID NO: 30117 - protein, 28 aa, Artificial Sequence
  Description of Artificial Sequence: Synthetic peptide
MEQEIRTTNPVATECYGSVSENLQRGNS

SEQ ID NO: 30118 - protein, 28 aa, Artificial Sequence
  Description of Artificial Sequence: Synthetic peptide
DEQEIRTTNPVGTEQYGSVSTNLQGDNI

SEQ ID NO: 30119 - protein, 28 aa, Artificial Sequence
  Description of Artificial Sequence: Synthetic peptide
DEEEIRTTNPEATEIYGSVSTNLQGENH

SEQ ID NO: 30120 - protein, 30 aa, Artificial Sequence
  Description of Artificial Sequence: Synthetic polypeptide
DEEEIRTTNPVATEQYGSVSTNEQFGDTDR

SEQ ID NO: 30121 - protein, 30 aa, Artificial Sequence
  Description of Artificial Sequence: Synthetic polypeptide
SEEEICTTNPVATEQYGSVSEENLQMRGNR

SEQ ID NO: 30122 - protein, 30 aa, Artificial Sequence
  Description of Artificial Sequence: Synthetic polypeptide
DEEEIRTTNPTATEQYGSVSTNGEQQGDNR

SEQ ID NO: 30123 - protein, 28 aa, Artificial Sequence
  Description of Artificial Sequence: Synthetic peptide
CEEEIVTTNPVATENYGSVSTNLQHGTR

SEQ ID NO: 30124 - protein, 28 aa, Artificial Sequence
  Description of Artificial Sequence: Synthetic peptide
AEEEICTTNPVATEQWGSVSTNVQHGNR

SEQ ID NO: 30125 - protein, 28 aa, Artificial Sequence
  Description of Artificial Sequence: Synthetic peptide
DEQEIRTTNPVASEQYGCVATNLERGNR

SEQ ID NO: 30126 - protein, 28 aa, Artificial Sequence
  Description of Artificial Sequence: Synthetic peptide
DEEEIRTTNPDATEQYGSVSTPLDTGER

SEQ ID NO: 30127 - protein, 28 aa, Artificial Sequence
  Description of Artificial Sequence: Synthetic peptide
MEEEIRTTNPVATEQYGIVSENLDFGNR

SEQ ID NO: 30128 - protein, 30 aa, Artificial Sequence
  Description of Artificial Sequence: Synthetic polypeptide
DEEEIRTTNPVATEQYGSVSTMDLQMGNDH

SEQ ID NO: 30129 - protein, 28 aa, Artificial Sequence
  Description of Artificial Sequence: Synthetic peptide
AEEEIRTTNPVATEQYGVVSTNPEVGNR

SEQ ID NO: 30130 - protein, 28 aa, Artificial Sequence
  Description of Artificial Sequence: Synthetic peptide
MEEEIRTTNPVAYEQYGTVSENLQRGNA

SEQ ID NO: 30131 - protein, 30 aa, Artificial Sequence
  Description of Artificial Sequence: Synthetic polypeptide
MENEIRTTNPVATEQYGSVSTNLQERGNDE

SEQ ID NO: 30132 - protein, 28 aa, Artificial Sequence
  Description of Artificial Sequence: Synthetic peptide
NEEEIRTTNPVSTEVYGSVSTNDQLGNR

SEQ ID NO: 30133 - protein, 32 aa, Artificial Sequence
  Description of Artificial Sequence: Synthetic polypeptide
DEEEIRTTNPVATEQYGFSVISTNLQHQGDNR

SEQ ID NO: 30134 - protein, 28 aa, Artificial Sequence
  Description of Artificial Sequence: Synthetic peptide
DEEEIRTTNPVATAQYGSVSENLEPGNM

SEQ ID NO: 30135 - protein, 29 aa, Artificial Sequence
  Description of Artificial Sequence: Synthetic peptide
QEEEIRTVNPVATEQYGSVSTVLQHAGNR

SEQ ID NO: 30136 - protein, 28 aa, Artificial Sequence
  Description of Artificial Sequence: Synthetic peptide
DESEIATTNPVATEQYGSVSTNIMRGQR

SEQ ID NO: 30137 - protein, 28 aa, Artificial Sequence
  Description of Artificial Sequence: Synthetic peptide
DEEEVRSTNPVAYEQYGSVSINLQRGNF

SEQ ID NO: 30138 - protein, 31 aa, Artificial Sequence
  Description of Artificial Sequence: Synthetic polypeptide
DEEEIRTTNPVATEQYGSVSTENLEDRGENQ

SEQ ID NO: 30139 - protein, 28 aa, Artificial Sequence
  Description of Artificial Sequence: Synthetic peptide
DEEEIRTTNPVATEHYGFVSTELQERNR

SEQ ID NO: 30140 - protein, 28 aa, Artificial Sequence
  Description of Artificial Sequence: Synthetic peptide
SEEEIRTTNPVATEQFGSVSTNEQRGTN

SEQ ID NO: 30141 - protein, 28 aa, Artificial Sequence
  Description of Artificial Sequence: Synthetic peptide
DEEEIWTTNPVATEHYGAVSTNLQRPTR

SEQ ID NO: 30142 - protein, 30 aa, Artificial Sequence
  Description of Artificial Sequence: Synthetic polypeptide
DEEEIRTTNPVATELYGIVSTNLQMRGTDR

SEQ ID NO: 30143 - protein, 29 aa, Artificial Sequence
  Description of Artificial Sequence: Synthetic peptide
DEEEIRTTNPVATECYGHVSTGNLQRENL

SEQ ID NO: 30144 - protein, 28 aa, Artificial Sequence
  Description of Artificial Sequence: Synthetic peptide
DEEEIRTTNPVATEQYGSCSEDLQNENR

SEQ ID NO: 30145 - protein, 30 aa, Artificial Sequence
  Description of Artificial Sequence: Synthetic polypeptide
SEEEIRTTNPVATETYGEVSTNLQREGDNR

SEQ ID NO: 30146 - protein, 32 aa, Artificial Sequence
  Description of Artificial Sequence: Synthetic polypeptide
DEEEIRTTNPVATEQYGSVESDTNLERDGNER

SEQ ID NO: 30147 - protein, 31 aa, Artificial Sequence
  Description of Artificial Sequence: Synthetic polypeptide
SEEEIRTTNPVATEQYGSVISTNEQREGENR

SEQ ID NO: 30148 - protein, 28 aa, Artificial Sequence
  Description of Artificial Sequence: Synthetic peptide
DEEEIRATNPVATEMYGSVSTNLQSPNG

SEQ ID NO: 30149 - protein, 28 aa, Artificial Sequence
  Description of Artificial Sequence: Synthetic peptide
DEEEIRTTNPVATEQYGSVSEVPQRGPQ

SEQ ID NO: 30150 - protein, 28 aa, Artificial Sequence
  Description of Artificial Sequence: Synthetic peptide
DEEEIVTTNPVATEQYGVVSTDLERGNH

SEQ ID NO: 30151 - protein, 28 aa, Artificial Sequence
  Description of Artificial Sequence: Synthetic peptide
QEEEIATTNPVATEQYGEASENLQRGNR

SEQ ID NO: 30152 - protein, 28 aa, Artificial Sequence
  Description of Artificial Sequence: Synthetic peptide
DEEEIRTTNPVATEQYGSVSDALQMLND

SEQ ID NO: 30153 - protein, 29 aa, Artificial Sequence
  Description of Artificial Sequence: Synthetic peptide
DEEEIVTTNPVSTEQYGSVSATNLQGGNI

SEQ ID NO: 30154 - protein, 28 aa, Artificial Sequence
  Description of Artificial Sequence: Synthetic peptide
AEAEITTTNPVATENYGTVSTNLQRGNR

SEQ ID NO: 30155 - protein, 29 aa, Artificial Sequence
  Description of Artificial Sequence: Synthetic peptide
DESEIRTTNPVATEQYGSLSEGNLQRGNS

SEQ ID NO: 30156 - protein, 28 aa, Artificial Sequence
  Description of Artificial Sequence: Synthetic peptide
DEVEIATTNPTATEQYGSVSTNEQQGNR

SEQ ID NO: 30157 - protein, 28 aa, Artificial Sequence
  Description of Artificial Sequence: Synthetic peptide
DEHEIRATNPVATEIYGSVSTNLQQGNA

SEQ ID NO: 30158 - protein, 28 aa, Artificial Sequence
  Description of Artificial Sequence: Synthetic peptide
DEQEIRTTNPVSTEQYGSVSMNLQSGNM

SEQ ID NO: 30159 - protein, 28 aa, Artificial Sequence
  Description of Artificial Sequence: Synthetic peptide
CEEEIRTTNPVATEVYGSVSTNLQREQM

SEQ ID NO: 30160 - protein, 28 aa, Artificial Sequence
  Description of Artificial Sequence: Synthetic peptide
SEEEIRTTNPVATEQYGSYSTNEQQGNM

SEQ ID NO: 30161 - protein, 28 aa, Artificial Sequence
  Description of Artificial Sequence: Synthetic peptide
DEEEIRTTNPTATEQYGSVSTNEQNGTL

SEQ ID NO: 30162 - protein, 28 aa, Artificial Sequence
  Description of Artificial Sequence: Synthetic peptide
DEGEIATTNPVSTEQYGSVSCNLQHGNR

SEQ ID NO: 30163 - protein, 28 aa, Artificial Sequence
  Description of Artificial Sequence: Synthetic peptide
DEEEIATTNPVATECYGSVSENLQQGNM

SEQ ID NO: 30164 - protein, 28 aa, Artificial Sequence
  Description of Artificial Sequence: Synthetic peptide
DEEEIRSTNPVATEVYGVVSMNLQRGER

SEQ ID NO: 30165 - protein, 28 aa, Artificial Sequence
  Description of Artificial Sequence: Synthetic peptide
DEEEIRTTNPVATECYGSVSTELEYGNE

SEQ ID NO: 30166 - protein, 28 aa, Artificial Sequence
  Description of Artificial Sequence: Synthetic peptide
DEEEIKTTNPVATHQYGSVSTDLQPGNS

SEQ ID NO: 30167 - protein, 29 aa, Artificial Sequence
  Description of Artificial Sequence: Synthetic peptide
DEEEIATTNPTATEQYGSVSTNEQRGDNQ

SEQ ID NO: 30168 - protein, 28 aa, Artificial Sequence
  Description of Artificial Sequence: Synthetic peptide
DEEEIATTNPVATEIYGSVGENCQRGNR

SEQ ID NO: 30169 - protein, 31 aa, Artificial Sequence
  Description of Artificial Sequence: Synthetic polypeptide
DEEEIRTTNPVATEQYGSVSDNWLQHDGNHR

SEQ ID NO: 30170 - protein, 30 aa, Artificial Sequence
  Description of Artificial Sequence: Synthetic polypeptide
DEEEIRTTNPVATEQYGSVSMMNWQFGENR

SEQ ID NO: 30171 - protein, 28 aa, Artificial Sequence
  Description of Artificial Sequence: Synthetic peptide
DENEIATTNPVATECYGSVSTDLQIGNR

SEQ ID NO: 30172 - protein, 28 aa, Artificial Sequence
  Description of Artificial Sequence: Synthetic peptide
DEEEIRTTNPVATETYGSVSVNLQVGPH

SEQ ID NO: 30173 - protein, 31 aa, Artificial Sequence
  Description of Artificial Sequence: Synthetic polypeptide
DEEEIRTTNPVATEQYGSVSITNLVQDNGNN

SEQ ID NO: 30174 - protein, 29 aa, Artificial Sequence
  Description of Artificial Sequence: Synthetic peptide
DENEIRCTNPVATEQYGSVDTNLQQIGNR

SEQ ID NO: 30175 - protein, 28 aa, Artificial Sequence
  Description of Artificial Sequence: Synthetic peptide
DEEEIATTNPVATEQYGSVSTDLQVGEQ

SEQ ID NO: 30176 - protein, 29 aa, Artificial Sequence
  Description of Artificial Sequence: Synthetic peptide
DEEEIRPTNPVATEQYGSVSENLQHAMNR

SEQ ID NO: 30177 - protein, 29 aa, Artificial Sequence
  Description of Artificial Sequence: Synthetic peptide
DEEEIRTTNPAATEQYGSVSTNDQRGEEN

SEQ ID NO: 30178 - protein, 28 aa, Artificial Sequence
  Description of Artificial Sequence: Synthetic peptide
DEEEIRTTNPVATEQYGSVSTEDEVGND

SEQ ID NO: 30179 - protein, 30 aa, Artificial Sequence
  Description of Artificial Sequence: Synthetic polypeptide
DEEEIRTTNPVATEQYGSVSTDLQEVGEDR

SEQ ID NO: 30180 - protein, 29 aa, Artificial Sequence
  Description of Artificial Sequence: Synthetic peptide
DEEEIRTVNPVATEQYGSVAEELQRGNDR

SEQ ID NO: 30181 - protein, 28 aa, Artificial Sequence
  Description of Artificial Sequence: Synthetic peptide
DEEEIRTTNPVSTEQYGEAATNLQRGMR

SEQ ID NO: 30182 - protein, 28 aa, Artificial Sequence
  Description of Artificial Sequence: Synthetic peptide
DEEEIRTTNPVATEQYGEVSEVCQHGNR

SEQ ID NO: 30183 - protein, 28 aa, Artificial Sequence
  Description of Artificial Sequence: Synthetic peptide
SEEEIRTTNPTATEQFGSVSENLQRGTR

SEQ ID NO: 30184 - protein, 28 aa, Artificial Sequence
  Description of Artificial Sequence: Synthetic peptide
QEQEIATTNPVATEQYGEVSDNLQRGNR

SEQ ID NO: 30185 - protein, 28 aa, Artificial Sequence
  Description of Artificial Sequence: Synthetic peptide
AEEEIRTTNPDATEQYGEVSTNLQLGDR

SEQ ID NO: 30186 - protein, 28 aa, Artificial Sequence
  Description of Artificial Sequence: Synthetic peptide
QEEEIRTVNPVATEQYGSVATNLQHGNM

SEQ ID NO: 30187 - protein, 28 aa, Artificial Sequence
  Description of Artificial Sequence: Synthetic peptide
DEAEIRTTNPVATEQYGSASTNLQALNM

SEQ ID NO: 30188 - protein, 28 aa, Artificial Sequence
  Description of Artificial Sequence: Synthetic peptide
KEEEIATTNPVATEQYGDASTNLQRGNM

SEQ ID NO: 30189 - protein, 28 aa, Artificial Sequence
  Description of Artificial Sequence: Synthetic peptide
DEEEIRTTNPTATEQYGSTATNLQHGQR

SEQ ID NO: 30190 - protein, 28 aa, Artificial Sequence
  Description of Artificial Sequence: Synthetic peptide
DEEEIRSTNPVATEQYGSVSMNLERGDT

SEQ ID NO: 30191 - protein, 28 aa, Artificial Sequence
  Description of Artificial Sequence: Synthetic peptide
DEEEIRTTNPVATECYGSVSTDLERGEL

SEQ ID NO: 30192 - protein, 28 aa, Artificial Sequence
  Description of Artificial Sequence: Synthetic peptide
DEQEIAAVNPVATEQYGSVSTVLQRGNR

SEQ ID NO: 30193 - protein, 28 aa, Artificial Sequence
  Description of Artificial Sequence: Synthetic peptide
DESELRTTNPVATEQYGSASTNLQRGTI

SEQ ID NO: 30194 - protein, 28 aa, Artificial Sequence
  Description of Artificial Sequence: Synthetic peptide
DEEEITTTNPVATEMYGSVSENWQRGNG

SEQ ID NO: 30195 - protein, 28 aa, Artificial Sequence
  Description of Artificial Sequence: Synthetic peptide
DPEEIRTTNPVATEQYGSVSSNDQRGLD

SEQ ID NO: 30196 - protein, 28 aa, Artificial Sequence
  Description of Artificial Sequence: Synthetic peptide
DEEEIRTVNPVATEQYGSVCTDLQVPNR

SEQ ID NO: 30197 - protein, 29 aa, Artificial Sequence
  Description of Artificial Sequence: Synthetic peptide
DEEEIRSTNPVATEQFGSVSTNLQRAGMM

SEQ ID NO: 30198 - protein, 29 aa, Artificial Sequence
  Description of Artificial Sequence: Synthetic peptide
VEEEIRTTNPVATEMYGSMSTNLQDGGNR

SEQ ID NO: 30199 - protein, 28 aa, Artificial Sequence
  Description of Artificial Sequence: Synthetic peptide
AEEEITTTNPVATEQYGEVSTNLQLGNA

SEQ ID NO: 30200 - protein, 30 aa, Artificial Sequence
  Description of Artificial Sequence: Synthetic polypeptide
DEEEIRTTNPCSTEQYGSVSATNLQRAGGR

SEQ ID NO: 30201 - protein, 30 aa, Artificial Sequence
  Description of Artificial Sequence: Synthetic polypeptide
DEEEIRTTNPVATEQYGSVSTANPQLIGNF

SEQ ID NO: 30202 - protein, 30 aa, Artificial Sequence
  Description of Artificial Sequence: Synthetic polypeptide
CEEEITTTNPVATEQYGSVSTNGLQREGNF

SEQ ID NO: 30203 - protein, 28 aa, Artificial Sequence
  Description of Artificial Sequence: Synthetic peptide
DEQEIRTTNPVATEQYGSVETDLQIGNG

SEQ ID NO: 30204 - protein, 28 aa, Artificial Sequence
  Description of Artificial Sequence: Synthetic peptide
DENEIVTTNPVATEQYGVVSTELQFGNR

SEQ ID NO: 30205 - protein, 28 aa, Artificial Sequence
  Description of Artificial Sequence: Synthetic peptide
SEEEIRTTNPVATEQFGSVSTNLQIGTN

SEQ ID NO: 30206 - protein, 30 aa, Artificial Sequence
  Description of Artificial Sequence: Synthetic polypeptide
DEEEIRTTNPVATEQYGSVSTDDLGRGLNE

SEQ ID NO: 30207 - protein, 28 aa, Artificial Sequence
  Description of Artificial Sequence: Synthetic peptide
AENEIATTNPVATEQYGEVSENLQRGNR

SEQ ID NO: 30208 - protein, 29 aa, Artificial Sequence
  Description of Artificial Sequence: Synthetic peptide
DEEEIRTTNPVATEQYGSVDSTNPLSGNV

SEQ ID NO: 30209 - protein, 28 aa, Artificial Sequence
  Description of Artificial Sequence: Synthetic peptide
DEEEIATTNPVSTEQYGSVSENLQHGGR

SEQ ID NO: 30210 - protein, 30 aa, Artificial Sequence
  Description of Artificial Sequence: Synthetic polypeptide
AEEEIRTTNPVATEQYGDVCSTNPPQRGNR

SEQ ID NO: 30211 - protein, 32 aa, Artificial Sequence
  Description of Artificial Sequence: Synthetic polypeptide
DEEEIRTTNPVATEQYGSYVTSTPGLQRGNPR

SEQ ID NO: 30212 - protein, 28 aa, Artificial Sequence
  Description of Artificial Sequence: Synthetic peptide
DEEEISTTNPVATEQYGIVSTELQRGEE

SEQ ID NO: 30213 - protein, 29 aa, Artificial Sequence
  Description of Artificial Sequence: Synthetic peptide
QEEEIRTTNPVATEQYGSVSATNLERGEF

SEQ ID NO: 30214 - protein, 28 aa, Artificial Sequence
  Description of Artificial Sequence: Synthetic peptide
DEQEIATTNPVATEVYGWVSNNLQRGNR

SEQ ID NO: 30215 - protein, 28 aa, Artificial Sequence
  Description of Artificial Sequence: Synthetic peptide
DEEEIRTTNPVATEQYGDVSEDLQYGNA

SEQ ID NO: 30216 - protein, 32 aa, Artificial Sequence
  Description of Artificial Sequence: Synthetic polypeptide
DEEEIRTTNPVATEQYGSVSETNLPLPREGNR

SEQ ID NO: 30217 - protein, 28 aa, Artificial Sequence
  Description of Artificial Sequence: Synthetic peptide
DEGEIVTTNPVATEQYGSVSTNGLEGNR

SEQ ID NO: 30218 - protein, 28 aa, Artificial Sequence
  Description of Artificial Sequence: Synthetic peptide
DHEEIRTTNPVATEQYGSVSTNEQREEA

SEQ ID NO: 30219 - protein, 28 aa, Artificial Sequence
  Description of Artificial Sequence: Synthetic peptide
DEEEIRTTNPVATECFGSVSTNLQIGTS

SEQ ID NO: 30220 - protein, 28 aa, Artificial Sequence
  Description of Artificial Sequence: Synthetic peptide
DEEEIRTTNPVATESYGSISTNPQGGNQ

SEQ ID NO: 30221 - protein, 28 aa, Artificial Sequence
  Description of Artificial Sequence: Synthetic peptide
DEEEIRCTNPTATEQFGSVSDNLQRGNE

SEQ ID NO: 30222 - protein, 28 aa, Artificial Sequence
  Description of Artificial Sequence: Synthetic peptide
SEDEIATTNPVSTEQYGSVSTNLQQGNR

SEQ ID NO: 30223 - protein, 29 aa, Artificial Sequence
  Description of Artificial Sequence: Synthetic peptide
DEEEIATTNPVATEVYGSVSCNPLQRGND

SEQ ID NO: 30224 - protein, 29 aa, Artificial Sequence
  Description of Artificial Sequence: Synthetic peptide
DEECIRTTNPVATEQYGSWSTNLQRGDEP

SEQ ID NO: 30225 - protein, 29 aa, Artificial Sequence
  Description of Artificial Sequence: Synthetic peptide
DEEEIRTTNPVATEQYGSVSTDEVQRGDL

SEQ ID NO: 30226 - protein, 29 aa, Artificial Sequence
  Description of Artificial Sequence: Synthetic peptide
DEVEIRTTNPVATELYGSVSTNLQTAGND

SEQ ID NO: 30227 - protein, 28 aa, Artificial Sequence
  Description of Artificial Sequence: Synthetic peptide
SEEEIRTTNPTATEQYGSVSTNPQRGTI

SEQ ID NO: 30228 - protein, 28 aa, Artificial Sequence
  Description of Artificial Sequence: Synthetic peptide
DENEIRQTNPVATEQYGSVSTDDQRGNL

SEQ ID NO: 30229 - protein, 28 aa, Artificial Sequence
  Description of Artificial Sequence: Synthetic peptide
DEEEIRTTNPVATECYGTMSDNLQRGNA

SEQ ID NO: 30230 - protein, 28 aa, Artificial Sequence
  Description of Artificial Sequence: Synthetic peptide
DEEEIRTTNPIATEQFGTVSTNLQHGNV

SEQ ID NO: 30231 - protein, 28 aa, Artificial Sequence
  Description of Artificial Sequence: Synthetic peptide
MENEIRTTNPVATEQYGSVSENLQNGNM

SEQ ID NO: 30232 - protein, 29 aa, Artificial Sequence
  Description of Artificial Sequence: Synthetic peptide
DEDEIRTTNPVATEMYGSVSTINLQFGNY

SEQ ID NO: 30233 - protein, 31 aa, Artificial Sequence
  Description of Artificial Sequence: Synthetic polypeptide
DEEEIRTTNPVATEQYGSVSTNLEEVEGNDR

SEQ ID NO: 30234 - protein, 31 aa, Artificial Sequence
  Description of Artificial Sequence: Synthetic polypeptide
DEEEIRTTNPVATEQYGSVSCEMNLQQGNDR

SEQ ID NO: 30235 - protein, 28 aa, Artificial Sequence
  Description of Artificial Sequence: Synthetic peptide
DEEEIRSTNPVSTEQYGCVSTDLQRGNH

SEQ ID NO: 30236 - protein, 32 aa, Artificial Sequence
  Description of Artificial Sequence: Synthetic polypeptide
DEEEIRTTNPVATEQYGSVSTMNLPQLRGDNF

SEQ ID NO: 30237 - protein, 31 aa, Artificial Sequence
  Description of Artificial Sequence: Synthetic polypeptide
DEEEIATTNPVATEQYGSVSVTTNLQGGNPR

SEQ ID NO: 30238 - protein, 28 aa, Artificial Sequence
  Description of Artificial Sequence: Synthetic peptide
DEQEIACTNPVATEIYGWVSTNLQRGNR

SEQ ID NO: 30239 - protein, 28 aa, Artificial Sequence
  Description of Artificial Sequence: Synthetic peptide
DEEEIRTTNPVATEQYGSYSEIEQQGNR

SEQ ID NO: 30240 - protein, 28 aa, Artificial Sequence
  Description of Artificial Sequence: Synthetic peptide
SEEEIRTTNPVSTEQYGSVSMNLTWGNR

SEQ ID NO: 30241 - protein, 28 aa, Artificial Sequence
  Description of Artificial Sequence: Synthetic peptide
DEEEIRSTNPVATEQYGSVACILQRGGR

SEQ ID NO: 30242 - protein, 28 aa, Artificial Sequence
  Description of Artificial Sequence: Synthetic peptide
DENEIRTTNPVATEQWGSVSTNEMRGNM

SEQ ID NO: 30243 - protein, 28 aa, Artificial Sequence
  Description of Artificial Sequence: Synthetic peptide
DEIELATTNPVATEQYGSVATGLQRGNR

SEQ ID NO: 30244 - protein, 28 aa, Artificial Sequence
  Description of Artificial Sequence: Synthetic peptide
DEEEIRTTNPVATEQYGSVSTGPYQGNG

SEQ ID NO: 30245 - protein, 28 aa, Artificial Sequence
  Description of Artificial Sequence: Synthetic peptide
DEEEIRTTNPVATELYGSVSENLQFGTL

SEQ ID NO: 30246 - protein, 29 aa, Artificial Sequence
  Description of Artificial Sequence: Synthetic peptide
DEQEIATTNPVATEQYGSVSTNLQDRGEL

SEQ ID NO: 30247 - protein, 28 aa, Artificial Sequence
  Description of Artificial Sequence: Synthetic peptide
MEEEIRTTNPCGTEQYGSVSTNLQRLNQ

SEQ ID NO: 30248 - protein, 28 aa, Artificial Sequence
  Description of Artificial Sequence: Synthetic peptide
DEEEISTTNPVASEQYGSVSTAVQQGNR

SEQ ID NO: 30249 - protein, 30 aa, Artificial Sequence
  Description of Artificial Sequence: Synthetic polypeptide
DEQEIRTTNPVATEQYGSASTDNLQQHGNR

SEQ ID NO: 30250 - protein, 28 aa, Artificial Sequence
  Description of Artificial Sequence: Synthetic peptide
DEEEIRTTNPVATEQWGSWSTNLQEWNP

SEQ ID NO: 30251 - protein, 28 aa, Artificial Sequence
  Description of Artificial Sequence: Synthetic peptide
DEEEIATTNPVSTENYGLVSTNLQRGMR

SEQ ID NO: 30252 - protein, 28 aa, Artificial Sequence
  Description of Artificial Sequence: Synthetic peptide
DEQEIRTTNPVATEQWGSVSENEQRGNA

SEQ ID NO: 30253 - protein, 29 aa, Artificial Sequence
  Description of Artificial Sequence: Synthetic peptide
DESEVRTTNPVATEIYGAVSTNLQRGENR

SEQ ID NO: 30254 - protein, 29 aa, Artificial Sequence
  Description of Artificial Sequence: Synthetic peptide
SEEEIATTNPVATEQFGGVSTNLQDRGNR

SEQ ID NO: 30255 - protein, 28 aa, Artificial Sequence
  Description of Artificial Sequence: Synthetic peptide
DEEEIRTTNPDATEQYGSVSTDPQRGDM

SEQ ID NO: 30256 - protein, 28 aa, Artificial Sequence
  Description of Artificial Sequence: Synthetic peptide
DEEEIRATNPVATEQFGSVSENLQSGNI

SEQ ID NO: 30257 - protein, 28 aa, Artificial Sequence
  Description of Artificial Sequence: Synthetic peptide
DEEPIRTTNPVATETYGSVSTPYQRGNN

SEQ ID NO: 30258 - protein, 28 aa, Artificial Sequence
  Description of Artificial Sequence: Synthetic peptide
GEEEIRSTNPVATEQYGSVSDILQRGDR

SEQ ID NO: 30259 - protein, 28 aa, Artificial Sequence
  Description of Artificial Sequence: Synthetic peptide
DEEEIRTTNPVATEQWGSVSTNEMQGNA

SEQ ID NO: 30260 - protein, 28 aa, Artificial Sequence
  Description of Artificial Sequence: Synthetic peptide
DESEIRTTNPVSTEQYGNVATNLQRGQR

SEQ ID NO: 30261 - protein, 29 aa, Artificial Sequence
  Description of Artificial Sequence: Synthetic peptide
MEEEIRTTNPVATEVYGSVSTNLQDLGNV

SEQ ID NO: 30262 - protein, 29 aa, Artificial Sequence
  Description of Artificial Sequence: Synthetic peptide
DEEEIRTTNPVASEQYGSVCCTNPQRGDR

SEQ ID NO: 30263 - protein, 30 aa, Artificial Sequence
  Description of Artificial Sequence: Synthetic polypeptide
DEEEIRTTNPVATEQYGSVSMNDQYEGENR

SEQ ID NO: 30264 - protein, 31 aa, Artificial Sequence
  Description of Artificial Sequence: Synthetic polypeptide
DEEEIRTTNPVATEQYGSVSTEEDQVRDGNR

SEQ ID NO: 30265 - protein, 28 aa, Artificial Sequence
  Description of Artificial Sequence: Synthetic peptide
DEDEIRTTNPVATETYGSVSVNWQRGDR

SEQ ID NO: 30266 - protein, 28 aa, Artificial Sequence
  Description of Artificial Sequence: Synthetic peptide
DEQEISTTNPVATDQYGWVSTNLQRGNQ

SEQ ID NO: 30267 - protein, 28 aa, Artificial Sequence
  Description of Artificial Sequence: Synthetic peptide
MEEEIRTTNPVATEQYGSVSTDLQNGEM

SEQ ID NO: 30268 - protein, 28 aa, Artificial Sequence
  Description of Artificial Sequence: Synthetic peptide
SEEEIRTTNPVATEQYGSVSTALMRGDS

SEQ ID NO: 30269 - protein, 30 aa, Artificial Sequence
  Description of Artificial Sequence: Synthetic polypeptide
DEDEVRTTNPVATEPYGSVSATNLQRGPNR

SEQ ID NO: 30270 - protein, 28 aa, Artificial Sequence
  Description of Artificial Sequence: Synthetic peptide
DEEEIATTNPVATEVYGDVSENLQRGNQ

SEQ ID NO: 30271 - protein, 28 aa, Artificial Sequence
  Description of Artificial Sequence: Synthetic peptide
SEEEIRTTNPVATEMYGSVSTNPQSGTR

SEQ ID NO: 30272 - protein, 28 aa, Artificial Sequence
  Description of Artificial Sequence: Synthetic peptide
SEEETRTTNPVATEQYGSCSTNLQSGNA

SEQ ID NO: 30273 - protein, 28 aa, Artificial Sequence
  Description of Artificial Sequence: Synthetic peptide
DEEEIATTNPVATEQYGVVSDNDQTGNR

SEQ ID NO: 30274 - protein, 28 aa, Artificial Sequence
  Description of Artificial Sequence: Synthetic peptide
DENEIRTTNPVATECYGSVSTDLERGER

SEQ ID NO: 30275 - protein, 31 aa, Artificial Sequence
  Description of Artificial Sequence: Synthetic polypeptide
DEEEIRTTNPVATEQYGDVSTNLQQRAGNDA

SEQ ID NO: 30276 - protein, 28 aa, Artificial Sequence
  Description of Artificial Sequence: Synthetic peptide
SEEEIRATNPVATELYGWVSTNLQRGNS

SEQ ID NO: 30277 - protein, 28 aa, Artificial Sequence
  Description of Artificial Sequence: Synthetic peptide
DEDEIRTTNPVATELYGGVSTNEQRGNI

SEQ ID NO: 30278 - protein, 31 aa, Artificial Sequence
  Description of Artificial Sequence: Synthetic polypeptide
DEEEIRTTNPVATEQYGSVSTDLEIREGNDR

SEQ ID NO: 30279 - protein, 30 aa, Artificial Sequence
  Description of Artificial Sequence: Synthetic polypeptide
DEEEISTTNPVASEQYGSVSMTANLQRGND

SEQ ID NO: 30280 - protein, 28 aa, Artificial Sequence
  Description of Artificial Sequence: Synthetic peptide
DECEIYTTNPVATEQYGSVSTNLMYGNT

SEQ ID NO: 30281 - protein, 28 aa, Artificial Sequence
  Description of Artificial Sequence: Synthetic peptide
DEQEIATTNPVATEIYGWVSNNLQRGNR

SEQ ID NO: 30282 - protein, 28 aa, Artificial Sequence
  Description of Artificial Sequence: Synthetic peptide
DEEEIRTTNPAATEQFGSVSTNWQSGTR

SEQ ID NO: 30283 - protein, 30 aa, Artificial Sequence
  Description of Artificial Sequence: Synthetic polypeptide
DEEEIRGTNPVACEQWGSVSATNLQREGNR

SEQ ID NO: 30284 - protein, 30 aa, Artificial Sequence
  Description of Artificial Sequence: Synthetic polypeptide
DEEEIRTTNPVATEQYGSVDTYNLDIRGDR

SEQ ID NO: 30285 - protein, 28 aa, Artificial Sequence
  Description of Artificial Sequence: Synthetic peptide
DEEEIRTTNPVATEQYGSVSTDPQDGEW

SEQ ID NO: 30286 - protein, 28 aa, Artificial Sequence
  Description of Artificial Sequence: Synthetic peptide
DEEEIRTTNPVAHEQYGCVAENLQRGNL

SEQ ID NO: 30287 - protein, 31 aa, Artificial Sequence
  Description of Artificial Sequence: Synthetic polypeptide
DEEEIRTTNPVATEQYGSVSTNLVQVEGENV

SEQ ID NO: 30288 - protein, 28 aa, Artificial Sequence
  Description of Artificial Sequence: Synthetic peptide
DEQEIRTTNPVAYEQYGCVSNNLERGNR

SEQ ID NO: 30289 - protein, 30 aa, Artificial Sequence
  Description of Artificial Sequence: Synthetic polypeptide
DEEEIRTTNPTATEQYGSVSTNGLQFKGNV

SEQ ID NO: 30290 - protein, 28 aa, Artificial Sequence
  Description of Artificial Sequence: Synthetic peptide
AEEEITATNPVATECYGVVSTNLQRGNR

SEQ ID NO: 30291 - protein, 28 aa, Artificial Sequence
  Description of Artificial Sequence: Synthetic peptide
DEEEIRTTNPVATEQYGSVSENLDTGEM

SEQ ID NO: 30292 - protein, 28 aa, Artificial Sequence
  Description of Artificial Sequence: Synthetic peptide
NEEEIRATNPVATEQYGSVSMELQNGNR

SEQ ID NO: 30293 - protein, 28 aa, Artificial Sequence
  Description of Artificial Sequence: Synthetic peptide
DEVEIATTNPVATEQYGGVSENLQNGNR

SEQ ID NO: 30294 - protein, 28 aa, Artificial Sequence
  Description of Artificial Sequence: Synthetic peptide
DEQEIASTNPVATELYGTVSTNLQRGNR

SEQ ID NO: 30295 - protein, 28 aa, Artificial Sequence
  Description of Artificial Sequence: Synthetic peptide
DENEIATTNPVATEQYGSVSTDLQFGNN

SEQ ID NO: 30296 - protein, 31 aa, Artificial Sequence
  Description of Artificial Sequence: Synthetic polypeptide
DEEEIRTTNPVATEQYGWVCSTNGLQLKGNR

SEQ ID NO: 30297 - protein, 28 aa, Artificial Sequence
  Description of Artificial Sequence: Synthetic peptide
QEEEIRTTNPVSTELYGSVSTNLQDGNI

SEQ ID NO: 30298 - protein, 31 aa, Artificial Sequence
  Description of Artificial Sequence: Synthetic polypeptide
DEEEIRTTNPVATEQYGTVSTNLQLHKGMNR

SEQ ID NO: 30299 - protein, 29 aa, Artificial Sequence
  Description of Artificial Sequence: Synthetic peptide
DEEEIRTTNPVATECYGSVSTDLQEHGNW

SEQ ID NO: 30300 - protein, 29 aa, Artificial Sequence
  Description of Artificial Sequence: Synthetic peptide
DEEEIRTTNPVATEQWGSVDTNEQNQGNR

SEQ ID NO: 30301 - protein, 28 aa, Artificial Sequence
  Description of Artificial Sequence: Synthetic peptide
DEEEIRTTNPVATENYGSVSTYAQHGTR

SEQ ID NO: 30302 - protein, 28 aa, Artificial Sequence
  Description of Artificial Sequence: Synthetic peptide
DEEEISTTNPVATAQYGSVSTNLQNGEH

SEQ ID NO: 30303 - protein, 28 aa, Artificial Sequence
  Description of Artificial Sequence: Synthetic peptide
DEEEIRTTNPVATECYGSVSTDLERGEN

SEQ ID NO: 30304 - protein, 28 aa, Artificial Sequence
  Description of Artificial Sequence: Synthetic peptide
DEEEIHTTNPVATEQYGEVSCNVQRGQR

SEQ ID NO: 30305 - protein, 28 aa, Artificial Sequence
  Description of Artificial Sequence: Synthetic peptide
DEEEIRTTNPVATEPWGVVSDNLQRGNL

SEQ ID NO: 30306 - protein, 28 aa, Artificial Sequence
  Description of Artificial Sequence: Synthetic peptide
DEEEIRTTNPVSTEQWGIVSTNLERGNA

SEQ ID NO: 30307 - protein, 28 aa, Artificial Sequence
  Description of Artificial Sequence: Synthetic peptide
DEEEIRTTNPVATETYGEVSTMLQFGNV

SEQ ID NO: 30308 - protein, 28 aa, Artificial Sequence
  Description of Artificial Sequence: Synthetic peptide
DEEEIATTNPVATEQYGSASENLQHGQR

SEQ ID NO: 30309 - protein, 28 aa, Artificial Sequence
  Description of Artificial Sequence: Synthetic peptide
AESEIITTNPVATEQYGEVATNLQRGNR

SEQ ID NO: 30310 - protein, 28 aa, Artificial Sequence
  Description of Artificial Sequence: Synthetic peptide
DEEEIRTTNPVATEVYGEASTNLQHGGR

SEQ ID NO: 30311 - protein, 28 aa, Artificial Sequence
  Description of Artificial Sequence: Synthetic peptide
DDEEIRSTNPVATEQWGIVSTALQRGNR

SEQ ID NO: 30312 - protein, 29 aa, Artificial Sequence
  Description of Artificial Sequence: Synthetic peptide
DEEEIRTTNPTATEQYGSVSTMNEQNGNF

SEQ ID NO: 30313 - protein, 28 aa, Artificial Sequence
  Description of Artificial Sequence: Synthetic peptide
DEEEIRCTNPVSTEQYGEVSTNIQHGNR

SEQ ID NO: 30314 - protein, 28 aa, Artificial Sequence
  Description of Artificial Sequence: Synthetic peptide
DEEEIRTTNPVATELYGIVSTNLMGGNQ

SEQ ID NO: 30315 - protein, 28 aa, Artificial Sequence
  Description of Artificial Sequence: Synthetic peptide
DEHEIRTTNPVATECYGDVSTNLQHGNN

SEQ ID NO: 30316 - protein, 29 aa, Artificial Sequence
  Description of Artificial Sequence: Synthetic peptide
DENEIRTTNPVATECYGSVSTDLQRGNDD

SEQ ID NO: 30317 - protein, 29 aa, Artificial Sequence
  Description of Artificial Sequence: Synthetic peptide
DEEEIATTNPCASEQYGSVSTNLQRGNDA

SEQ ID NO: 30318 - protein, 29 aa, Artificial Sequence
  Description of Artificial Sequence: Synthetic peptide
DEEEIRTTNPVATECYGVVSTNLQQKGNA

SEQ ID NO: 30319 - protein, 28 aa, Artificial Sequence
  Description of Artificial Sequence: Synthetic peptide
DEEEIRTVNPVATEQYGWVSTNLQFGET

SEQ ID NO: 30320 - protein, 29 aa, Artificial Sequence
  Description of Artificial Sequence: Synthetic peptide
DEQEIATTNPVATECYGSVSATNLERGNR

SEQ ID NO: 30321 - protein, 28 aa, Artificial Sequence
  Description of Artificial Sequence: Synthetic peptide
DEEEIRTVNPVATEQYGSMSTNLQHGDH

SEQ ID NO: 30322 - protein, 28 aa, Artificial Sequence
  Description of Artificial Sequence: Synthetic peptide
DEQEIRTTNPVATEQYGSVSTDDEVGNR

SEQ ID NO: 30323 - protein, 28 aa, Artificial Sequence
  Description of Artificial Sequence: Synthetic peptide
DEHEIVTTNPVCTEQYGSVSTNLQHGNQ

SEQ ID NO: 30324 - protein, 28 aa, Artificial Sequence
  Description of Artificial Sequence: Synthetic peptide
DEDEIRTTNPCATEQYGCASDNLQRGNR

SEQ ID NO: 30325 - protein, 28 aa, Artificial Sequence
  Description of Artificial Sequence: Synthetic peptide
DEEEIRTTNPCASEQFGSVGTNLQAGNR

SEQ ID NO: 30326 - protein, 28 aa, Artificial Sequence
  Description of Artificial Sequence: Synthetic peptide
HENEIATTNPVATECYGSVSTDLQRGNR

SEQ ID NO: 30327 - protein, 31 aa, Artificial Sequence
  Description of Artificial Sequence: Synthetic polypeptide
DEEEIRTTNPVATEQYGSVSDTNLEPDGENR

SEQ ID NO: 30328 - protein, 28 aa, Artificial Sequence
  Description of Artificial Sequence: Synthetic peptide
DENEIATTNPVATECYGSVSTNLQAGNI

SEQ ID NO: 30329 - protein, 28 aa, Artificial Sequence
  Description of Artificial Sequence: Synthetic peptide
DEAEIRTTNPVAVEQYGSISTNLERPNR

SEQ ID NO: 30330 - protein, 29 aa, Artificial Sequence
  Description of Artificial Sequence: Synthetic peptide
QEEEICTTNPVATEQYGWVSAENLQRGNR

SEQ ID NO: 30331 - protein, 28 aa, Artificial Sequence
  Description of Artificial Sequence: Synthetic peptide
DEEEIATTNPVATECYGSVSELLQRGDR

SEQ ID NO: 30332 - protein, 29 aa, Artificial Sequence
  Description of Artificial Sequence: Synthetic peptide
KEEEIRTTNPVATEQYGSVSTNLQDTGDD

SEQ ID NO: 30333 - protein, 29 aa, Artificial Sequence
  Description of Artificial Sequence: Synthetic peptide
DEEEIRTTNPVATEQYGSVDTMDLQAGNA

SEQ ID NO: 30334 - protein, 28 aa, Artificial Sequence
  Description of Artificial Sequence: Synthetic peptide
DEEEIRTTNPIATEQYGSTGTELQRGNI

SEQ ID NO: 30335 - protein, 28 aa, Artificial Sequence
  Description of Artificial Sequence: Synthetic peptide
DEEEIRTTNPVATECYGVSSINLQRGND

SEQ ID NO: 30336 - protein, 28 aa, Artificial Sequence
  Description of Artificial Sequence: Synthetic peptide
AEEEIRQTNPVATEQYGVVSTNLQDGND

SEQ ID NO: 30337 - protein, 28 aa, Artificial Sequence
  Description of Artificial Sequence: Synthetic peptide
DEEEIATTNPTATEQYGGVSTNLQQGTR

SEQ ID NO: 30338 - protein, 28 aa, Artificial Sequence
  Description of Artificial Sequence: Synthetic peptide
DEEEIRTTNPVATEQWGSVSTNEMIGNA

SEQ ID NO: 30339 - protein, 28 aa, Artificial Sequence
  Description of Artificial Sequence: Synthetic peptide
DEEEIRTTNPVATEMYGGVSENLQQGTR

SEQ ID NO: 30340 - protein, 28 aa, Artificial Sequence
  Description of Artificial Sequence: Synthetic peptide
DEEEIVTTNPVATEQYGGVSTNVQQGQR

SEQ ID NO: 30341 - protein, 29 aa, Artificial Sequence
  Description of Artificial Sequence: Synthetic peptide
DEQEIRTTNPVATEQWGSVSTNEQNRGNQ

SEQ ID NO: 30342 - protein, 28 aa, Artificial Sequence
  Description of Artificial Sequence: Synthetic peptide
SEEEIRTTNPVATEQYGSVSENEQVGTR

SEQ ID NO: 30343 - protein, 28 aa, Artificial Sequence
  Description of Artificial Sequence: Synthetic peptide
DEDEIATTNPVATETWGSVSTNLQQGNR

SEQ ID NO: 30344 - protein, 30 aa, Artificial Sequence
  Description of Artificial Sequence: Synthetic polypeptide
DEEEIRTTNPVATEQYGSVSTDLQEQGNDN

SEQ ID NO: 30345 - protein, 28 aa, Artificial Sequence
  Description of Artificial Sequence: Synthetic peptide
DEEEIRTTNPVATECYGVVSTELQFGNQ

SEQ ID NO: 30346 - protein, 29 aa, Artificial Sequence
  Description of Artificial Sequence: Synthetic peptide
DEQEIVTTNPVATEQYGWVSADNLQRGNR

SEQ ID NO: 30347 - protein, 31 aa, Artificial Sequence
  Description of Artificial Sequence: Synthetic polypeptide
DEEEIRTTNPVATEQYGSVSTMNEQDRGDNG

SEQ ID NO: 30348 - protein, 28 aa, Artificial Sequence
  Description of Artificial Sequence: Synthetic peptide
DEECIRTTNPIATEQYGSKSTNPQAGNR

SEQ ID NO: 30349 - protein, 28 aa, Artificial Sequence
  Description of Artificial Sequence: Synthetic peptide
DEEEITATNPVATEIYGVVSTNLQRGTR

SEQ ID NO: 30350 - protein, 30 aa, Artificial Sequence
  Description of Artificial Sequence: Synthetic polypeptide
DEEEIRATNPVATEQYGSVSTAPLVQDGNR

SEQ ID NO: 30351 - protein, 28 aa, Artificial Sequence
  Description of Artificial Sequence: Synthetic peptide
DEEEVATTNPVATEQYGEVSENLQHGNR

SEQ ID NO: 30352 - protein, 30 aa, Artificial Sequence
  Description of Artificial Sequence: Synthetic polypeptide
DEEEIRTTNPVATEQYGSVSTYPLQAGEDR

SEQ ID NO: 30353 - protein, 28 aa, Artificial Sequence
  Description of Artificial Sequence: Synthetic peptide
DEQEIRCTNPVASEIYGSVATNLQRGNR

SEQ ID NO: 30354 - protein, 31 aa, Artificial Sequence
  Description of Artificial Sequence: Synthetic polypeptide
DEEEIRTTNPVATEQYGSVSTQNLQEIKGER

SEQ ID NO: 30355 - protein, 29 aa, Artificial Sequence
  Description of Artificial Sequence: Synthetic peptide
DENEIRTTNPVATECWGSVSENLQNRGNR

SEQ ID NO: 30356 - protein, 28 aa, Artificial Sequence
  Description of Artificial Sequence: Synthetic peptide
DEQEIRTTNPVATEQYGSVSENLQNGDN

SEQ ID NO: 30357 - protein, 28 aa, Artificial Sequence
  Description of Artificial Sequence: Synthetic peptide
DEEEIRTTNPTATEIYGSVSENLQHGNL

SEQ ID NO: 30358 - protein, 28 aa, Artificial Sequence
  Description of Artificial Sequence: Synthetic peptide
DEEEICTTNPVATEVYGDIATNLQRGNR

SEQ ID NO: 30359 - protein, 30 aa, Artificial Sequence
  Description of Artificial Sequence: Synthetic polypeptide
DEEEIRTTNPVATECYGSVSTNLQHNGEDR

SEQ ID NO: 30360 - protein, 28 aa, Artificial Sequence
  Description of Artificial Sequence: Synthetic peptide
DESEIKTTNPVATEQYGDVSTLLQRGTR

SEQ ID NO: 30361 - protein, 28 aa, Artificial Sequence
  Description of Artificial Sequence: Synthetic peptide
DEEEIRCTNPVATEHYGSVAMNLQRGNQ

SEQ ID NO: 30362 - protein, 28 aa, Artificial Sequence
  Description of Artificial Sequence: Synthetic peptide
DEQEIRSTNPVATEQYGVVSNNLERGNR

SEQ ID NO: 30363 - protein, 29 aa, Artificial Sequence
  Description of Artificial Sequence: Synthetic peptide
DEEEIRCTNPDATEQYGSVSTGLDRGNDR

SEQ ID NO: 30364 - protein, 31 aa, Artificial Sequence
  Description of Artificial Sequence: Synthetic polypeptide
DEEEIRTTNPVATEQYGSVSDTENLEERGNM

SEQ ID NO: 30365 - protein, 28 aa, Artificial Sequence
  Description of Artificial Sequence: Synthetic peptide
DEEEIRTTNPVATEQYGSVETPDEIGNR

SEQ ID NO: 30366 - protein, 28 aa, Artificial Sequence
  Description of Artificial Sequence: Synthetic peptide
DEEEIRTTNPVATEQYGSMSTNIQKGTQ

SEQ ID NO: 30367 - protein, 28 aa, Artificial Sequence
  Description of Artificial Sequence: Synthetic peptide
DEEEICTTNPVATECFGSVSTNLQRGTH

SEQ ID NO: 30368 - protein, 29 aa, Artificial Sequence
  Description of Artificial Sequence: Synthetic peptide
DEEEIRTTNPVATEQYGDCSTNLQNHGNM

SEQ ID NO: 30369 - protein, 28 aa, Artificial Sequence
  Description of Artificial Sequence: Synthetic peptide
DEDEIRTTNPVATEQYGSVPTNLQREEK

SEQ ID NO: 30370 - protein, 28 aa, Artificial Sequence
  Description of Artificial Sequence: Synthetic peptide
DEEEIRTTNPVATEQYGIVATELQMGNT

SEQ ID NO: 30371 - protein, 32 aa, Artificial Sequence
  Description of Artificial Sequence: Synthetic polypeptide
DEEEIRTTNPVATEQYGSVSDTDNLELRGDNR

SEQ ID NO: 30372 - protein, 31 aa, Artificial Sequence
  Description of Artificial Sequence: Synthetic polypeptide
DEEEIRTTNPVAYEQYGSVSTNPLQIRGDER

SEQ ID NO: 30373 - protein, 28 aa, Artificial Sequence
  Description of Artificial Sequence: Synthetic peptide
DEECIRTTNPVSTERYGSVSDPLQRGNR

SEQ ID NO: 30374 - protein, 29 aa, Artificial Sequence
  Description of Artificial Sequence: Synthetic peptide
DEQEIRTTNPVATEQYGHVDTNEQIRGNR

SEQ ID NO: 30375 - protein, 28 aa, Artificial Sequence
  Description of Artificial Sequence: Synthetic peptide
DEEEIRTTNPVATEQYGSVSTCPQDGED

SEQ ID NO: 30376 - protein, 30 aa, Artificial Sequence
  Description of Artificial Sequence: Synthetic polypeptide
DEEEIRTTNPVATEQYGSVSTMNEQDQGNV

SEQ ID NO: 30377 - protein, 28 aa, Artificial Sequence
  Description of Artificial Sequence: Synthetic peptide
DEEEIRTTNPVASENYGSVSMNLQRGTQ

SEQ ID NO: 30378 - protein, 28 aa, Artificial Sequence
  Description of Artificial Sequence: Synthetic peptide
DEEEIRATNPCCTEQYGSVSNNLQRGNS

SEQ ID NO: 30379 - protein, 32 aa, Artificial Sequence
  Description of Artificial Sequence: Synthetic polypeptide
DEEEIRTTNPVATEQYGSVSITDNLQGKGVNR

SEQ ID NO: 30380 - protein, 28 aa, Artificial Sequence
  Description of Artificial Sequence: Synthetic peptide
DEEEIRCTNPVATEIYGSVAMNLERGNR

SEQ ID NO: 30381 - protein, 29 aa, Artificial Sequence
  Description of Artificial Sequence: Synthetic peptide
DEQEIVTTNPVATEQYGDVSAENLQRGNR

SEQ ID NO: 30382 - protein, 31 aa, Artificial Sequence
  Description of Artificial Sequence: Synthetic polypeptide
DEEEIRTTNPVATEQYGSVHSTEGLVQMGNR

SEQ ID NO: 30383 - protein, 28 aa, Artificial Sequence
  Description of Artificial Sequence: Synthetic peptide
DEEEIRTTNPVATEQYGSVSTAPQLGEF

SEQ ID NO: 30384 - protein, 28 aa, Artificial Sequence
  Description of Artificial Sequence: Synthetic peptide
DEQEIRTTNPVSTEQYGSVSENLQHGGR

SEQ ID NO: 30385 - protein, 30 aa, Artificial Sequence
  Description of Artificial Sequence: Synthetic polypeptide
DEEEIRTTNPVATEQYGSVSTPLQENGDER

SEQ ID NO: 30386 - protein, 28 aa, Artificial Sequence
  Description of Artificial Sequence: Synthetic peptide
AEEEIRTTNPCATEIYGSVSMNLQRGTR

SEQ ID NO: 30387 - protein, 31 aa, Artificial Sequence
  Description of Artificial Sequence: Synthetic polypeptide
DEEEIRTTNPVATEQYGFVTSATNSLQRGNF

SEQ ID NO: 30388 - protein, 28 aa, Artificial Sequence
  Description of Artificial Sequence: Synthetic peptide
SEEEIRTTNPVASEQYGSVATNLQQGNV

SEQ ID NO: 30389 - protein, 29 aa, Artificial Sequence
  Description of Artificial Sequence: Synthetic peptide
DEEEIRTTNPVATEQYGDVSENLSVSGNR

SEQ ID NO: 30390 - protein, 30 aa, Artificial Sequence
  Description of Artificial Sequence: Synthetic polypeptide
DEEEIRATNPTATECYGSVSTNLQRGDNTR

SEQ ID NO: 30391 - protein, 28 aa, Artificial Sequence
  Description of Artificial Sequence: Synthetic peptide
DEEEVRTTNPVATEQYGSVATNLQRLPQ

SEQ ID NO: 30392 - protein, 30 aa, Artificial Sequence
  Description of Artificial Sequence: Synthetic polypeptide
KEEEIRTTNPVATECYGSVSTNLQDAGNDR

SEQ ID NO: 30393 - protein, 28 aa, Artificial Sequence
  Description of Artificial Sequence: Synthetic peptide
DEEEIATTNPVATEQYGSVSTDLEVGND

SEQ ID NO: 30394 - protein, 30 aa, Artificial Sequence
  Description of Artificial Sequence: Synthetic polypeptide
DEQEIRTTNPVATEQWGSVSTNLQMRNGNM

SEQ ID NO: 30395 - protein, 28 aa, Artificial Sequence
  Description of Artificial Sequence: Synthetic peptide
DEQEIAATNPVSTEQYGWVSTNLQRGNR

SEQ ID NO: 30396 - protein, 28 aa, Artificial Sequence
  Description of Artificial Sequence: Synthetic peptide
DEQEIRATNPVATEQYGSVSTNLQNGDS

SEQ ID NO: 30397 - protein, 28 aa, Artificial Sequence
  Description of Artificial Sequence: Synthetic peptide
DEEEIRTTNPCATEQYGSVGTDIQRLNR

SEQ ID NO: 30398 - protein, 28 aa, Artificial Sequence
  Description of Artificial Sequence: Synthetic peptide
SEQEIRTTNPVATEQWGSVSTNLQIGNF

SEQ ID NO: 30399 - protein, 31 aa, Artificial Sequence
  Description of Artificial Sequence: Synthetic polypeptide
DEEEIRTTNPVATEQYGSVHSTANLDQGNYR

SEQ ID NO: 30400 - protein, 28 aa, Artificial Sequence
  Description of Artificial Sequence: Synthetic peptide
DDEEIRTTNPVAYEQYGVVATNLERGNR

SEQ ID NO: 30401 - protein, 28 aa, Artificial Sequence
  Description of Artificial Sequence: Synthetic peptide
DEVEIRTTNPTATEQYGSVSTNLQHGPF

SEQ ID NO: 30402 - protein, 28 aa, Artificial Sequence
  Description of Artificial Sequence: Synthetic peptide
DENEIRTTNPVATEIYGSVSNNLQRGTW

SEQ ID NO: 30403 - protein, 29 aa, Artificial Sequence
  Description of Artificial Sequence: Synthetic peptide
DESEIRTTNPVATEQYGSVSEALQRGGMR

SEQ ID NO: 30404 - protein, 30 aa, Artificial Sequence
  Description of Artificial Sequence: Synthetic polypeptide
DEEEIRTTNPVATEQYGSVSSSELDRVGNR

SEQ ID NO: 30405 - protein, 31 aa, Artificial Sequence
  Description of Artificial Sequence: Synthetic polypeptide
DEEEIRTTNPVATEQYGSVSETNLQPGDNEE

SEQ ID NO: 30406 - protein, 28 aa, Artificial Sequence
  Description of Artificial Sequence: Synthetic peptide
DEEEIRTTNPCATENYGSVSTAGQQGNR

SEQ ID NO: 30407 - protein, 28 aa, Artificial Sequence
  Description of Artificial Sequence: Synthetic peptide
DEEEIRTTNPVATEMYGSAAENIQRGNR

SEQ ID NO: 30408 - protein, 29 aa, Artificial Sequence
  Description of Artificial Sequence: Synthetic peptide
DEEEIRTTNPVATEQYGDVGENLQGDGNR

SEQ ID NO: 30409 - protein, 29 aa, Artificial Sequence
  Description of Artificial Sequence: Synthetic peptide
DEEEIRATNPVATEQYGVMSTDLQDRGNR

SEQ ID NO: 30410 - protein, 28 aa, Artificial Sequence
  Description of Artificial Sequence: Synthetic peptide
GEEEIRATNPVATEQYGVVSTNLQQGNM

SEQ ID NO: 30411 - protein, 28 aa, Artificial Sequence
  Description of Artificial Sequence: Synthetic peptide
DEEEIRTTNPCATEPYGVVSSNEQRGNR

SEQ ID NO: 30412 - protein, 30 aa, Artificial Sequence
  Description of Artificial Sequence: Synthetic polypeptide
DEEEIRTTNPVATEQYGSVSTNEQELGNTN

SEQ ID NO: 30413 - protein, 28 aa, Artificial Sequence
  Description of Artificial Sequence: Synthetic peptide
DEEEIATTNPVATECYGSVSTNLEHGNL

SEQ ID NO: 30414 - protein, 28 aa, Artificial Sequence
  Description of Artificial Sequence: Synthetic peptide
SDQEISTTNPVATEQYGSVSTELQRGNR

SEQ ID NO: 30415 - protein, 28 aa, Artificial Sequence
  Description of Artificial Sequence: Synthetic peptide
DEEEIATVNPVATEQYGSVPENLQRGNK

SEQ ID NO: 30416 - protein, 28 aa, Artificial Sequence
  Description of Artificial Sequence: Synthetic peptide
AEEEIVSTNPVATEQYGEVSTNLQAGNR

SEQ ID NO: 30417 - protein, 30 aa, Artificial Sequence
  Description of Artificial Sequence: Synthetic polypeptide
AEEEIRTTNPVATEQYGSVSENGQVQRGNR

SEQ ID NO: 30418 - protein, 28 aa, Artificial Sequence
  Description of Artificial Sequence: Synthetic peptide
DESEIRTTNPTATECYGSVSTNLQQENR

SEQ ID NO: 30419 - protein, 31 aa, Artificial Sequence
  Description of Artificial Sequence: Synthetic polypeptide
DEEEIRTTNPVATEQYGSVSTNLQETEGNDF

SEQ ID NO: 30420 - protein, 28 aa, Artificial Sequence
  Description of Artificial Sequence: Synthetic peptide
DEQEIATTNPVCTEMYGSVATNLQRGNR

SEQ ID NO: 30421 - protein, 28 aa, Artificial Sequence
  Description of Artificial Sequence: Synthetic peptide
DEQEIRTTNPVATEQWGSVSTNEQIGNA

SEQ ID NO: 30422 - protein, 29 aa, Artificial Sequence
  Description of Artificial Sequence: Synthetic peptide
GENEIRTTNPVATEQYGSVSTNLQEDGNA

SEQ ID NO: 30423 - protein, 28 aa, Artificial Sequence
  Description of Artificial Sequence: Synthetic peptide
DEEEIRTTNPVATECYGFVSTEPQRGNA

SEQ ID NO: 30424 - protein, 31 aa, Artificial Sequence
  Description of Artificial Sequence: Synthetic polypeptide
DEEEIRTTNPVATEQYGSVSTGNGPQRGENL

SEQ ID NO: 30425 - protein, 28 aa, Artificial Sequence
  Description of Artificial Sequence: Synthetic peptide
DEAEIRTTNPVATEQYGVVSTNLDRGEH

SEQ ID NO: 30426 - protein, 30 aa, Artificial Sequence
  Description of Artificial Sequence: Synthetic polypeptide
DEEEIASTNPVATEQYGSVSEMNLQERGNR

SEQ ID NO: 30427 - protein, 28 aa, Artificial Sequence
  Description of Artificial Sequence: Synthetic peptide
SEVEIATTNPVATELYGSVNTNLQRGNR

SEQ ID NO: 30428 - protein, 28 aa, Artificial Sequence
  Description of Artificial Sequence: Synthetic peptide
DEEEIRTTNPVATEQYGSVSTDLEDGEN

SEQ ID NO: 30429 - protein, 28 aa, Artificial Sequence
  Description of Artificial Sequence: Synthetic peptide
AEEEIATTNPVATEQYGGVGTNLQRGTR

SEQ ID NO: 30430 - protein, 28 aa, Artificial Sequence
  Description of Artificial Sequence: Synthetic peptide
QEEEIMTTNPVATEQYGGVSTNLQRGDV

SEQ ID NO: 30431 - protein, 28 aa, Artificial Sequence
  Description of Artificial Sequence: Synthetic peptide
GEEEIRTTNPVATECYGSVSTELQAGNW

SEQ ID NO: 30432 - protein, 28 aa, Artificial Sequence
  Description of Artificial Sequence: Synthetic peptide
QEEEICATNPVATEQYGSASDNLQRGNR

SEQ ID NO: 30433 - protein, 28 aa, Artificial Sequence
  Description of Artificial Sequence: Synthetic peptide
DECEIRTTNPVATEQYGVVSTKLQRPND

SEQ ID NO: 30434 - protein, 28 aa, Artificial Sequence
  Description of Artificial Sequence: Synthetic peptide
DEEEIRTTNPVATEQYGSVSENLQHEEQ

SEQ ID NO: 30435 - protein, 28 aa, Artificial Sequence
  Description of Artificial Sequence: Synthetic peptide
REEEIRTTNPVCTEPYGSVSTNLQYGNM

SEQ ID NO: 30436 - protein, 28 aa, Artificial Sequence
  Description of Artificial Sequence: Synthetic peptide
QEEEIATVNPVSTEQYGEVSTNLQRGNR

SEQ ID NO: 30437 - protein, 28 aa, Artificial Sequence
  Description of Artificial Sequence: Synthetic peptide
DEQEIRTTNPVATEQYGDVSTNDQHGNA

SEQ ID NO: 30438 - protein, 28 aa, Artificial Sequence
  Description of Artificial Sequence: Synthetic peptide
DEEEIRTTNPVATECFGSVSTNPQSGNI

SEQ ID NO: 30439 - protein, 28 aa, Artificial Sequence
  Description of Artificial Sequence: Synthetic peptide
DEEEIRTTNPVATEQYGSVSTDQEDGNA

SEQ ID NO: 30440 - protein, 28 aa, Artificial Sequence
  Description of Artificial Sequence: Synthetic peptide
DEVEIRTTNPVATEQYGSVSMNWQHGNQ

SEQ ID NO: 30441 - protein, 29 aa, Artificial Sequence
  Description of Artificial Sequence: Synthetic peptide
DEVEIRTTNPVATEQYGSVSATADQRGNF

SEQ ID NO: 30442 - protein, 28 aa, Artificial Sequence
  Description of Artificial Sequence: Synthetic peptide
DEEEIRTTNPTATECYGSVSTNWQSGNH

SEQ ID NO: 30443 - protein, 28 aa, Artificial Sequence
  Description of Artificial Sequence: Synthetic peptide
DENEIRTTNPVATEWWGSVDTNLQRGNQ

SEQ ID NO: 30444 - protein, 30 aa, Artificial Sequence
  Description of Artificial Sequence: Synthetic polypeptide
MEEEIRTTNPVATEQYGSVSTNLQENEGNM

SEQ ID NO: 30445 - protein, 28 aa, Artificial Sequence
  Description of Artificial Sequence: Synthetic peptide
DEDEIRTTNPVATEQYGNVSDVLQHGNR

SEQ ID NO: 30446 - protein, 29 aa, Artificial Sequence
  Description of Artificial Sequence: Synthetic peptide
DEEEIATTNPTATEQYGSVSTNEQDQGNR

SEQ ID NO: 30447 - protein, 28 aa, Artificial Sequence
  Description of Artificial Sequence: Synthetic peptide
AEQEIRTVNPVATEVYGSVSTNLQHGNR

SEQ ID NO: 30448 - protein, 28 aa, Artificial Sequence
  Description of Artificial Sequence: Synthetic peptide
DENEIATTNPVATEVYGSVSTNLQHGNN

SEQ ID NO: 30449 - protein, 30 aa, Artificial Sequence
  Description of Artificial Sequence: Synthetic polypeptide
DEEEIATTNPVATEQYGSVSTNLQILNGER

SEQ ID NO: 30450 - protein, 29 aa, Artificial Sequence
  Description of Artificial Sequence: Synthetic peptide
KEEEIRTTNPVATEQYGSVSTNPPQNGNF

SEQ ID NO: 30451 - protein, 29 aa, Artificial Sequence
  Description of Artificial Sequence: Synthetic peptide
DEEEIRTTNPFATEQYGSVSENPQDRGNS

SEQ ID NO: 30452 - protein, 31 aa, Artificial Sequence
  Description of Artificial Sequence: Synthetic polypeptide
DEEEIRTTNPVATEQYGSYVTDTNPQRNGNR

SEQ ID NO: 30453 - protein, 31 aa, Artificial Sequence
  Description of Artificial Sequence: Synthetic polypeptide
DEEEIRTTNPVATEQWGSVSTNLQREGENDF

SEQ ID NO: 30454 - protein, 28 aa, Artificial Sequence
  Description of Artificial Sequence: Synthetic peptide
DEEEIRTTNPVATQQYGDVSTNLDNGER

SEQ ID NO: 30455 - protein, 30 aa, Artificial Sequence
  Description of Artificial Sequence: Synthetic polypeptide
DEHEIRTTNPVATEQYGSVSCEDLQRGNDR

SEQ ID NO: 30456 - protein, 29 aa, Artificial Sequence
  Description of Artificial Sequence: Synthetic peptide
DEEEIRTTNPVGTEQYGSVSTNFLGRGFP

SEQ ID NO: 30457 - protein, 28 aa, Artificial Sequence
  Description of Artificial Sequence: Synthetic peptide
DEDEIRTTNPVATEQYGSVSDTLQHGNT

SEQ ID NO: 30458 - protein, 30 aa, Artificial Sequence
  Description of Artificial Sequence: Synthetic polypeptide
GEEEIATVNPVATEQYGSVSTNLQSRAGNR

SEQ ID NO: 30459 - protein, 28 aa, Artificial Sequence
  Description of Artificial Sequence: Synthetic peptide
DEQEIATTNPVATEIYGWVSMNLQRGNR

SEQ ID NO: 30460 - protein, 29 aa, Artificial Sequence
  Description of Artificial Sequence: Synthetic peptide
DENEIRCTNPVATEQYGSVDTNLQMQGNR

SEQ ID NO: 30461 - protein, 30 aa, Artificial Sequence
  Description of Artificial Sequence: Synthetic polypeptide
DENEIRTTNPVATEQYGSVSTNLQENGNDM

SEQ ID NO: 30462 - protein, 28 aa, Artificial Sequence
  Description of Artificial Sequence: Synthetic peptide
DEMEIRTTNPVATEQYGEVSDNIQYGNR

SEQ ID NO: 30463 - protein, 28 aa, Artificial Sequence
  Description of Artificial Sequence: Synthetic peptide
DEEEIATVNPVATEVYGEASTNLQRGNR

SEQ ID NO: 30464 - protein, 28 aa, Artificial Sequence
  Description of Artificial Sequence: Synthetic peptide
DEVEIAATNPVATEMYGSVSTNLQRGNF

SEQ ID NO: 30465 - protein, 28 aa, Artificial Sequence
  Description of Artificial Sequence: Synthetic peptide
DEEEIRTTNPVATEQYGSVSEALQWGDL

SEQ ID NO: 30466 - protein, 28 aa, Artificial Sequence
  Description of Artificial Sequence: Synthetic peptide
DEGEIRTTNPVATEVYGSVSENLQRGPI

SEQ ID NO: 30467 - protein, 28 aa, Artificial Sequence
  Description of Artificial Sequence: Synthetic peptide
DENEIRTTNPVATEQYGSVSENEERGNS

SEQ ID NO: 30468 - protein, 28 aa, Artificial Sequence
  Description of Artificial Sequence: Synthetic peptide
DEEEIRTTNPVATEQYGFVIENLQSGNI

SEQ ID NO: 30469 - protein, 28 aa, Artificial Sequence
  Description of Artificial Sequence: Synthetic peptide
AENEIATTNPVATEQYGSVPTNLQRGER

SEQ ID NO: 30470 - protein, 28 aa, Artificial Sequence
  Description of Artificial Sequence: Synthetic peptide
YEEEIRTTNPVATEQYGSVSTNDEQGNM

SEQ ID NO: 30471 - protein, 28 aa, Artificial Sequence
  Description of Artificial Sequence: Synthetic peptide
DDEEIRTTNPVATECYGAVSTNDQRGDR

SEQ ID NO: 30472 - protein, 28 aa, Artificial Sequence
  Description of Artificial Sequence: Synthetic peptide
DEEEIATTNPVLTEQYGSVSTGLQQGNG

SEQ ID NO: 30473 - protein, 28 aa, Artificial Sequence
  Description of Artificial Sequence: Synthetic peptide
DEEEIATTNPVATEQYGSVSTDLQVGEN

SEQ ID NO: 30474 - protein, 28 aa, Artificial Sequence
  Description of Artificial Sequence: Synthetic peptide
QEDEIRTTNPVATEQYGEVSTVLQHGNR

SEQ ID NO: 30475 - protein, 28 aa, Artificial Sequence
  Description of Artificial Sequence: Synthetic peptide
DEEEIRTTNPVATEQYGSVSTNGDDGET

SEQ ID NO: 30476 - protein, 28 aa, Artificial Sequence
  Description of Artificial Sequence: Synthetic peptide
DEEEIRTTNPVATEQYGSVSTDDDNGNQ

SEQ ID NO: 30477 - protein, 31 aa, Artificial Sequence
  Description of Artificial Sequence: Synthetic polypeptide
DEEEIRTTNPVATEQYGSVSDTNPLQWGDPR

SEQ ID NO: 30478 - protein, 28 aa, Artificial Sequence
  Description of Artificial Sequence: Synthetic peptide
DEEEICTTNPVATEQFGEVSTNLQQGNI

SEQ ID NO: 30479 - protein, 30 aa, Artificial Sequence
  Description of Artificial Sequence: Synthetic polypeptide
DEEEIRTTNPVATEQYGSVSSTNLQQTGEE

SEQ ID NO: 30480 - protein, 28 aa, Artificial Sequence
  Description of Artificial Sequence: Synthetic peptide
DEEVIRATNPVATELYGSVSTNLQQGNQ

SEQ ID NO: 30481 - protein, 32 aa, Artificial Sequence
  Description of Artificial Sequence: Synthetic polypeptide
DEEEIRTTNPVATEQYGSVSITENLQDRDGNL

SEQ ID NO: 30482 - protein, 29 aa, Artificial Sequence
  Description of Artificial Sequence: Synthetic peptide
DEEEIRTTNPCATEHYGAVGTNLQRNGNR

SEQ ID NO: 30483 - protein, 30 aa, Artificial Sequence
  Description of Artificial Sequence: Synthetic polypeptide
DEEEIRTTNPVATEQYGSVSTDLQDNGNDF

SEQ ID NO: 30484 - protein, 30 aa, Artificial Sequence
  Description of Artificial Sequence: Synthetic polypeptide
DEEEIRTTNPVATECYGSVSTDLQDRGNDT

SEQ ID NO: 30485 - protein, 28 aa, Artificial Sequence
  Description of Artificial Sequence: Synthetic peptide
LEEEIRTTNPVAYEQYGSISTNQQHGNR

SEQ ID NO: 30486 - protein, 29 aa, Artificial Sequence
  Description of Artificial Sequence: Synthetic peptide
DEEEIRTTNPVATEVYGSVSENNEQRGPR

SEQ ID NO: 30487 - protein, 28 aa, Artificial Sequence
  Description of Artificial Sequence: Synthetic peptide
DENEIRTTNPVATEQYGSVSTNVQSGDF

SEQ ID NO: 30488 - protein, 30 aa, Artificial Sequence
  Description of Artificial Sequence: Synthetic polypeptide
DEEEIRTTNPVATEQYGSVSWTNLGRGLQN

SEQ ID NO: 30489 - protein, 30 aa, Artificial Sequence
  Description of Artificial Sequence: Synthetic polypeptide
SEEEIRTTNPTATEQYGSVSTNLQRGDNDI

SEQ ID NO: 30490 - protein, 28 aa, Artificial Sequence
  Description of Artificial Sequence: Synthetic peptide
DDSEIRTVNPVATEQYGVVSTNLQRGER

SEQ ID NO: 30491 - protein, 28 aa, Artificial Sequence
  Description of Artificial Sequence: Synthetic peptide
DEAEIRTTNPVATEVYGSVSTAPQRGNV

SEQ ID NO: 30492 - protein, 30 aa, Artificial Sequence
  Description of Artificial Sequence: Synthetic polypeptide
GEEEIRTTNPVATEQYGSVSTNLNQGKGNW

SEQ ID NO: 30493 - protein, 30 aa, Artificial Sequence
  Description of Artificial Sequence: Synthetic polypeptide
DEEEIRTTNPVATEQFGSVSTNWQREGNDE

SEQ ID NO: 30494 - protein, 28 aa, Artificial Sequence
  Description of Artificial Sequence: Synthetic peptide
DEEEIRTTNPVATEIYGSVSTELENGNT

SEQ ID NO: 30495 - protein, 28 aa, Artificial Sequence
  Description of Artificial Sequence: Synthetic peptide
DEEEIRSTNPVATEQYGVVSTIGQRGNQ

SEQ ID NO: 30496 - protein, 29 aa, Artificial Sequence
  Description of Artificial Sequence: Synthetic peptide
DEEEIRSVNPVATEQYGTVSTNLQRAGMR

SEQ ID NO: 30497 - protein, 31 aa, Artificial Sequence
  Description of Artificial Sequence: Synthetic polypeptide
SEEEIRTTNPVATEQYGSVSEANLQRGDNDR

SEQ ID NO: 30498 - protein, 30 aa, Artificial Sequence
  Description of Artificial Sequence: Synthetic polypeptide
KEEEIRTTNPVATEQYGSVSTNLQEIEGNT

SEQ ID NO: 30499 - protein, 28 aa, Artificial Sequence
  Description of Artificial Sequence: Synthetic peptide
KEEEIRATNPVATEQYGWVSENLQMGNR

SEQ ID NO: 30500 - protein, 29 aa, Artificial Sequence
  Description of Artificial Sequence: Synthetic peptide
DEEEIRTTNPVATEQYGSVSTELQEDGDY

SEQ ID NO: 30501 - protein, 30 aa, Artificial Sequence
  Description of Artificial Sequence: Synthetic polypeptide
SEEEIRSTNPVATEQYGSVSTNLQQRGVNI

SEQ ID NO: 30502 - protein, 28 aa, Artificial Sequence
  Description of Artificial Sequence: Synthetic peptide
DEEEIRTTNPTATEMYGEVSMNLQRGNM

SEQ ID NO: 30503 - protein, 28 aa, Artificial Sequence
  Description of Artificial Sequence: Synthetic peptide
DEEEIRTTNPVATEQYGDVSEDLQMGNN

SEQ ID NO: 30504 - protein, 28 aa, Artificial Sequence
  Description of Artificial Sequence: Synthetic peptide
QEEEIATTNPVSTEQYGEVSTVLQRGNR

SEQ ID NO: 30505 - protein, 29 aa, Artificial Sequence
  Description of Artificial Sequence: Synthetic peptide
QEQEIATTNPVATEQYGSVSAENLQRGNR

SEQ ID NO: 30506 - protein, 28 aa, Artificial Sequence
  Description of Artificial Sequence: Synthetic peptide
DEEEIRTTNPVATELYGSVSENEMQGNR

SEQ ID NO: 30507 - protein, 28 aa, Artificial Sequence
  Description of Artificial Sequence: Synthetic peptide
MEEEIATTNPVATECYGSVSTNLQAGNV

SEQ ID NO: 30508 - protein, 29 aa, Artificial Sequence
  Description of Artificial Sequence: Synthetic peptide
DESEIRTTNPVATEQYGSVSTNGDQRGTF

SEQ ID NO: 30509 - protein, 28 aa, Artificial Sequence
  Description of Artificial Sequence: Synthetic peptide
DEAEIRTTNPVATEQYGSVSDCLDQGNL

SEQ ID NO: 30510 - protein, 33 aa, Artificial Sequence
  Description of Artificial Sequence: Synthetic polypeptide
DEEEIRTTNPVATEQYGSVISTCNGPQRGINTR

SEQ ID NO: 30511 - protein, 29 aa, Artificial Sequence
  Description of Artificial Sequence: Synthetic peptide
SEEEIRTTNPTATEQYGSVSTNPQFGTTR

SEQ ID NO: 30512 - protein, 28 aa, Artificial Sequence
  Description of Artificial Sequence: Synthetic peptide
DEEEVKTTNIVATEGYGSVSTNTQHGNR

SEQ ID NO: 30513 - protein, 29 aa, Artificial Sequence
  Description of Artificial Sequence: Synthetic peptide
DENEIRTTNPVATECYGSASTNLQSNGNM

SEQ ID NO: 30514 - protein, 28 aa, Artificial Sequence
  Description of Artificial Sequence: Synthetic peptide
DEEEITATNPIATEQYGEVSTPLQRGNA

SEQ ID NO: 30515 - protein, 29 aa, Artificial Sequence
  Description of Artificial Sequence: Synthetic peptide
DEGEIRTTNPAATEQYGSVSTNPQTNGNN

SEQ ID NO: 30516 - protein, 28 aa, Artificial Sequence
  Description of Artificial Sequence: Synthetic peptide
AEEEIATTNPVATEVYGVTSTNLMRGNR

SEQ ID NO: 30517 - protein, 28 aa, Artificial Sequence
  Description of Artificial Sequence: Synthetic peptide
DEAEINTTNPVATECYGEVSTNLQRPPR

SEQ ID NO: 30518 - protein, 28 aa, Artificial Sequence
  Description of Artificial Sequence: Synthetic peptide
SEEEIRTTNPTATEQYGEVSTNPQRGTA

SEQ ID NO: 30519 - protein, 28 aa, Artificial Sequence
  Description of Artificial Sequence: Synthetic peptide
DEEEIRTTNPEATEQYGSVSTDEQYGES

SEQ ID NO: 30520 - protein, 32 aa, Artificial Sequence
  Description of Artificial Sequence: Synthetic polypeptide
DEEEIRTTNPVATEQYGSVSTMNPQLNEGDNR

SEQ ID NO: 30521 - protein, 28 aa, Artificial Sequence
  Description of Artificial Sequence: Synthetic peptide
DEDEISCTNPVATECYGSVSTNLQRGTF

SEQ ID NO: 30522 - protein, 28 aa, Artificial Sequence
  Description of Artificial Sequence: Synthetic peptide
SEEEIRTTNPVATAQYGSVSVGPYRGNR

SEQ ID NO: 30523 - protein, 28 aa, Artificial Sequence
  Description of Artificial Sequence: Synthetic peptide
DENEIGTTNPVATEQYGSVSEELLRGNV

SEQ ID NO: 30524 - protein, 28 aa, Artificial Sequence
  Description of Artificial Sequence: Synthetic peptide
DEDEISTTNPVATEMWGSISENLQRGNR

SEQ ID NO: 30525 - protein, 28 aa, Artificial Sequence
  Description of Artificial Sequence: Synthetic peptide
QENEIVTTNPVATEGYGSVSTNLMRGER

SEQ ID NO: 30526 - protein, 28 aa, Artificial Sequence
  Description of Artificial Sequence: Synthetic peptide
DEEEIATTNPVAWEQYGSVEENPQRGDR

SEQ ID NO: 30527 - protein, 30 aa, Artificial Sequence
  Description of Artificial Sequence: Synthetic polypeptide
DEEEIRTTNPVSTEQYGEVSATNLQHAGGR

SEQ ID NO: 30528 - protein, 30 aa, Artificial Sequence
  Description of Artificial Sequence: Synthetic polypeptide
SEVEIRTTNPTATEQYGGVSTNLQREGNTR

SEQ ID NO: 30529 - protein, 28 aa, Artificial Sequence
  Description of Artificial Sequence: Synthetic peptide
DESEIRTTNPVSTEQYGEVSCNLQHGGR

SEQ ID NO: 30530 - protein, 28 aa, Artificial Sequence
  Description of Artificial Sequence: Synthetic peptide
DEEEIRATNPVATEMYGSVCTNLQVGPQ

SEQ ID NO: 30531 - protein, 29 aa, Artificial Sequence
  Description of Artificial Sequence: Synthetic peptide
DEEEIRTTNPVSTEQYGEVADNLQRGGER

SEQ ID NO: 30532 - protein, 33 aa, Artificial Sequence
  Description of Artificial Sequence: Synthetic polypeptide
DEEEIRTTNPVATEQYGSVSSTTPNLPNRGNPR

SEQ ID NO: 30533 - protein, 28 aa, Artificial Sequence
  Description of Artificial Sequence: Synthetic peptide
DEEEIRATNPTATEQFGEVSENLQLGNR

SEQ ID NO: 30534 - protein, 31 aa, Artificial Sequence
  Description of Artificial Sequence: Synthetic polypeptide
DEEEIATTNPTATEQYGSVSTMNEQDRGDNR

SEQ ID NO: 30535 - protein, 28 aa, Artificial Sequence
  Description of Artificial Sequence: Synthetic peptide
DEVEITTTNPVATEQYGSVSENLETGNG

SEQ ID NO: 30536 - protein, 29 aa, Artificial Sequence
  Description of Artificial Sequence: Synthetic peptide
DEEVIRTTNPVATEQYGSVSDNLQRMVAL

SEQ ID NO: 30537 - protein, 29 aa, Artificial Sequence
  Description of Artificial Sequence: Synthetic peptide
DEEEIATVNPVATEQFGSVSTPQQRGENR

SEQ ID NO: 30538 - protein, 32 aa, Artificial Sequence
  Description of Artificial Sequence: Synthetic polypeptide
SEEEIRTTNPVATEQYGSVSTANGLQREGTLR

SEQ ID NO: 30539 - protein, 30 aa, Artificial Sequence
  Description of Artificial Sequence: Synthetic polypeptide
DEEEIRTTNPEATEQYGCSVSTCLNPGENR

SEQ ID NO: 30540 - protein, 28 aa, Artificial Sequence
  Description of Artificial Sequence: Synthetic peptide
DEEEIVTTNPCATEGYGLVSTQLQHGNR

SEQ ID NO: 30541 - protein, 30 aa, Artificial Sequence
  Description of Artificial Sequence: Synthetic polypeptide
DEQEIRTTNPVATEQYGSVDSTNGLQVGEF

SEQ ID NO: 30542 - protein, 31 aa, Artificial Sequence
  Description of Artificial Sequence: Synthetic polypeptide
DEEEIRTTNPVATEQYGSVSTTGLVEPGDNR

SEQ ID NO: 30543 - protein, 28 aa, Artificial Sequence
  Description of Artificial Sequence: Synthetic peptide
SEEEIRATNPTATEQFGGVSTNLQQGNR

SEQ ID NO: 30544 - protein, 29 aa, Artificial Sequence
  Description of Artificial Sequence: Synthetic peptide
DEEEIRTTNPVCTEQYGSISIEDLQRGNM

SEQ ID NO: 30545 - protein, 31 aa, Artificial Sequence
  Description of Artificial Sequence: Synthetic polypeptide
DEEEIRTTNPVATEQYGSVSTGLEEREGENQ

SEQ ID NO: 30546 - protein, 28 aa, Artificial Sequence
  Description of Artificial Sequence: Synthetic peptide
DEEEIRTVNPVATEQYGVVSADLQIGDR

SEQ ID NO: 30547 - protein, 29 aa, Artificial Sequence
  Description of Artificial Sequence: Synthetic peptide
SEECIRTTNPVATEQYWSVSTNPQRGDNF

SEQ ID NO: 30548 - protein, 28 aa, Artificial Sequence
  Description of Artificial Sequence: Synthetic peptide
GEHEIATTNPVATEQYGSVSTEDQRGER

SEQ ID NO: 30549 - protein, 28 aa, Artificial Sequence
  Description of Artificial Sequence: Synthetic peptide
DEEEIRTTNPVATEQYGSVSTSQGDGDS

SEQ ID NO: 30550 - protein, 28 aa, Artificial Sequence
  Description of Artificial Sequence: Synthetic peptide
MENEIRSTNPVATEQYGSVSTNLIHGNQ

SEQ ID NO: 30551 - protein, 29 aa, Artificial Sequence
  Description of Artificial Sequence: Synthetic peptide
DEEEIRTVNPVATEIYGSVCTNVQRAGNM

SEQ ID NO: 30552 - protein, 28 aa, Artificial Sequence
  Description of Artificial Sequence: Synthetic peptide
SEEEIAATNPVATEQYGSVSENLQQGNF

SEQ ID NO: 30553 - protein, 32 aa, Artificial Sequence
  Description of Artificial Sequence: Synthetic polypeptide
DEEEIRTTNPVATEQYGEVMSDTNLPQREGNN

SEQ ID NO: 30554 - protein, 28 aa, Artificial Sequence
  Description of Artificial Sequence: Synthetic peptide
DEHEIRTTNPVATEQYGVVAENLQGGNI

SEQ ID NO: 30555 - protein, 28 aa, Artificial Sequence
  Description of Artificial Sequence: Synthetic peptide
DEEEICTTNPVATEQYGSVMEHLQKGNM

SEQ ID NO: 30556 - protein, 28 aa, Artificial Sequence
  Description of Artificial Sequence: Synthetic peptide
QEAEIRTTNPVATEGYGCVSCNLQRGNM

SEQ ID NO: 30557 - protein, 28 aa, Artificial Sequence
  Description of Artificial Sequence: Synthetic peptide
FEGEIRTTNPVATEQYGHVSDMLQRGNM

SEQ ID NO: 30558 - protein, 28 aa, Artificial Sequence
  Description of Artificial Sequence: Synthetic peptide
DEQEIRTTNPDATEQYGSVSTDDQREER

SEQ ID NO: 30559 - protein, 28 aa, Artificial Sequence
  Description of Artificial Sequence: Synthetic peptide
DEMEIATTNPVATEQYGSVSTDLDEMNR

SEQ ID NO: 30560 - protein, 30 aa, Artificial Sequence
  Description of Artificial Sequence: Synthetic polypeptide
DEVEIATTNPVATEQYGSVSTCNLQNGPNE

SEQ ID NO: 30561 - protein, 31 aa, Artificial Sequence
  Description of Artificial Sequence: Synthetic polypeptide
DEEEIRTTNPVATEQYGSVATNNLQLRKGEY

SEQ ID NO: 30562 - protein, 29 aa, Artificial Sequence
  Description of Artificial Sequence: Synthetic peptide
DEEEIRTTNPCATEQYGTVSTDLQQSGNQ

SEQ ID NO: 30563 - protein, 30 aa, Artificial Sequence
  Description of Artificial Sequence: Synthetic polypeptide
DEEEIRTTNPVATECYGVVSDTNLQVHGNI

SEQ ID NO: 30564 - protein, 28 aa, Artificial Sequence
  Description of Artificial Sequence: Synthetic peptide
DEQEIRTTNPVATEHYGSVSTNLNVGGH

SEQ ID NO: 30565 - protein, 28 aa, Artificial Sequence
  Description of Artificial Sequence: Synthetic peptide
DEEEIRTTNIEATEQYGSVMTNLDDGDR

SEQ ID NO: 30566 - protein, 28 aa, Artificial Sequence
  Description of Artificial Sequence: Synthetic peptide
DEEEIRTTNPTGTEFYGTVSTNWQRGNA

SEQ ID NO: 30567 - protein, 31 aa, Artificial Sequence
  Description of Artificial Sequence: Synthetic polypeptide
DEEEIRTTNPVATEQYGSVSYPGDQLRGNDR

SEQ ID NO: 30568 - protein, 28 aa, Artificial Sequence
  Description of Artificial Sequence: Synthetic peptide
DEEEIRTTNPCATEVYGSTAMNLQRGNI

SEQ ID NO: 30569 - protein, 28 aa, Artificial Sequence
  Description of Artificial Sequence: Synthetic peptide
DESEIRTVNPVATEWYGSTSSNLQRGNI

SEQ ID NO: 30570 - protein, 32 aa, Artificial Sequence
  Description of Artificial Sequence: Synthetic polypeptide
DEEEIRTTNPVATEQYGSVSTMNGDQDRGPNH

SEQ ID NO: 30571 - protein, 29 aa, Artificial Sequence
  Description of Artificial Sequence: Synthetic peptide
DDSEIRTTNPVAVEVYGSVSTNLQDTGNR

SEQ ID NO: 30572 - protein, 28 aa, Artificial Sequence
  Description of Artificial Sequence: Synthetic peptide
DEQEIRTTNPVATEQYGSVSTDLEAGED

SEQ ID NO: 30573 - protein, 28 aa, Artificial Sequence
  Description of Artificial Sequence: Synthetic peptide
DEEEIRTTNPVCTEQYGSVSTEEEVGNY

SEQ ID NO: 30574 - protein, 32 aa, Artificial Sequence
  Description of Artificial Sequence: Synthetic polypeptide
DEEEIRTTNPVATEQYGSVSTTDPLLRNGDNR

SEQ ID NO: 30575 - protein, 28 aa, Artificial Sequence
  Description of Artificial Sequence: Synthetic peptide
SEVEIRTTNPVATEQFGEVSENLQRGDR

SEQ ID NO: 30576 - protein, 28 aa, Artificial Sequence
  Description of Artificial Sequence: Synthetic peptide
DEEEIRTTNPVAIEQYGSVQTAHDRGNE

SEQ ID NO: 30577 - protein, 32 aa, Artificial Sequence
  Description of Artificial Sequence: Synthetic polypeptide
DEEEIRTTNPVATEQYGSVDSTNLEEDEGDNR

SEQ ID NO: 30578 - protein, 30 aa, Artificial Sequence
  Description of Artificial Sequence: Synthetic polypeptide
DEEEIRTTNPEATEQYGSVSTEPLPQRGEA

SEQ ID NO: 30579 - protein, 29 aa, Artificial Sequence
  Description of Artificial Sequence: Synthetic peptide
DECEIRTTNPVATEQYGVSASTGSQRGNH

SEQ ID NO: 30580 - protein, 28 aa, Artificial Sequence
  Description of Artificial Sequence: Synthetic peptide
AEEEIATTNPVATEQYGWVSTNQQVGER

SEQ ID NO: 30581 - protein, 28 aa, Artificial Sequence
  Description of Artificial Sequence: Synthetic peptide
DEAEIATTNPVATEQYGDVSTNIQFGNF

SEQ ID NO: 30582 - protein, 28 aa, Artificial Sequence
  Description of Artificial Sequence: Synthetic peptide
DEDEIRTTNPVASEIWGSVSTNLQRGMI

SEQ ID NO: 30583 - protein, 28 aa, Artificial Sequence
  Description of Artificial Sequence: Synthetic peptide
DEEEIRTTNPAATECFGSVSTNWQHGNE

SEQ ID NO: 30584 - protein, 29 aa, Artificial Sequence
  Description of Artificial Sequence: Synthetic peptide
DENEIRTTNPVATECWGIVSENLQNRGNR

SEQ ID NO: 30585 - protein, 28 aa, Artificial Sequence
  Description of Artificial Sequence: Synthetic peptide
KEHEIATTNPVATEQYGDVSENLQRENR

SEQ ID NO: 30586 - protein, 29 aa, Artificial Sequence
  Description of Artificial Sequence: Synthetic peptide
DEIEICTTNPVATEQYGTVSVTNLQGGNI

SEQ ID NO: 30587 - protein, 28 aa, Artificial Sequence
  Description of Artificial Sequence: Synthetic peptide
DEQEIATTNPVATEQYGVVSTDLQNGNS

SEQ ID NO: 30588 - protein, 28 aa, Artificial Sequence
  Description of Artificial Sequence: Synthetic peptide
DEEEIRTTNPVATEQYGSVETEEDLGER

SEQ ID NO: 30589 - protein, 28 aa, Artificial Sequence
  Description of Artificial Sequence: Synthetic peptide
GEEEIRTTNPVATECYGVVSTDLQQGNI

SEQ ID NO: 30590 - protein, 29 aa, Artificial Sequence
  Description of Artificial Sequence: Synthetic peptide
REEEVKTTNPCATEQYGSVSTNLQDRGTR

SEQ ID NO: 30591 - protein, 29 aa, Artificial Sequence
  Description of Artificial Sequence: Synthetic peptide
DEEEIRPTNPVATEQYGVVSEELQDRGNT

SEQ ID NO: 30592 - protein, 28 aa, Artificial Sequence
  Description of Artificial Sequence: Synthetic peptide
YEEEIRTTNPVATEQYGSASEDEQRGDR

SEQ ID NO: 30593 - protein, 32 aa, Artificial Sequence
  Description of Artificial Sequence: Synthetic polypeptide
DEEEIRTTNPTATEQYGSVSTNLQDREGDNDV

SEQ ID NO: 30594 - protein, 28 aa, Artificial Sequence
  Description of Artificial Sequence: Synthetic peptide
DENEIVTTNPVATEQYGVVSTELQSGNW

SEQ ID NO: 30595 - protein, 28 aa, Artificial Sequence
  Description of Artificial Sequence: Synthetic peptide
DEQEIRTTNPVATEQYGEASTVLQRGGM

SEQ ID NO: 30596 - protein, 28 aa, Artificial Sequence
  Description of Artificial Sequence: Synthetic peptide
DEEEIACTNPVSTEMYGSVSTNLQTGNQ

SEQ ID NO: 30597 - protein, 30 aa, Artificial Sequence
  Description of Artificial Sequence: Synthetic polypeptide
DEEEIRCTNPVATEQYGAVSMGNLQRDGDR

SEQ ID NO: 30598 - protein, 28 aa, Artificial Sequence
  Description of Artificial Sequence: Synthetic peptide
NEEEIRTTNIVATEEYGSVSSNLQAGNT

SEQ ID NO: 30599 - protein, 32 aa, Artificial Sequence
  Description of Artificial Sequence: Synthetic polypeptide
DEEEIRTTNPVATEQYGSVSTMNPQLREGDNF

SEQ ID NO: 30600 - protein, 33 aa, Artificial Sequence
  Description of Artificial Sequence: Synthetic polypeptide
DEEEIRTTNPVATEQYGSVSTTDNGLVQRGEND

SEQ ID NO: 30601 - protein, 28 aa, Artificial Sequence
  Description of Artificial Sequence: Synthetic peptide
DEEEIAATNPVATEMFGSVSTNLQQGDR

SEQ ID NO: 30602 - protein, 28 aa, Artificial Sequence
  Description of Artificial Sequence: Synthetic peptide
MEEEIRTTNPVATESYGDVPTTLQRGNI

SEQ ID NO: 30603 - protein, 30 aa, Artificial Sequence
  Description of Artificial Sequence: Synthetic polypeptide
DEEEIRTTNPVSTEQYGIVSTNLQNRAGDI

SEQ ID NO: 30604 - protein, 28 aa, Artificial Sequence
  Description of Artificial Sequence: Synthetic peptide
SEEEIRATNPTATEQFGSVSTNLQQGTR

SEQ ID NO: 30605 - protein, 30 aa, Artificial Sequence
  Description of Artificial Sequence: Synthetic polypeptide
DEEEIETTNPVATEQYGSVNSTPLQREGES

SEQ ID NO: 30606 - protein, 28 aa, Artificial Sequence
  Description of Artificial Sequence: Synthetic peptide
MEQEIRTTNPVATECYGSVSENLQSGNE

SEQ ID NO: 30607 - protein, 28 aa, Artificial Sequence
  Description of Artificial Sequence: Synthetic peptide
SEEEIRTTNPVATEQYGDVGANLQRGPF

SEQ ID NO: 30608 - protein, 28 aa, Artificial Sequence
  Description of Artificial Sequence: Synthetic peptide
DEEEIRTTNIVATEQFGSVSENEQTGNF

SEQ ID NO: 30609 - protein, 29 aa, Artificial Sequence
  Description of Artificial Sequence: Synthetic peptide
QENEIRTTNPVATEQYGEVGATNIQRGNR

SEQ ID NO: 30610 - protein, 30 aa, Artificial Sequence
  Description of Artificial Sequence: Synthetic polypeptide
DEEEIRTTNPTATEQYGSVSTMNEQQGDNQ

SEQ ID NO: 30611 - protein, 28 aa, Artificial Sequence
  Description of Artificial Sequence: Synthetic peptide
DENEIGTVNPVATEQYGSVSENHQRGNQ

SEQ ID NO: 30612 - protein, 29 aa, Artificial Sequence
  Description of Artificial Sequence: Synthetic peptide
DEEEIRCTNPVATECWGSVSTNLQMQGTR

SEQ ID NO: 30613 - protein, 32 aa, Artificial Sequence
  Description of Artificial Sequence: Synthetic polypeptide
DEEEIRTTNPVATEQYGSVSETNLEDRDGENE

SEQ ID NO: 30614 - protein, 28 aa, Artificial Sequence
  Description of Artificial Sequence: Synthetic peptide
DEYEIRTTNPVATEQYGSVDEELQLGNN

SEQ ID NO: 30615 - protein, 28 aa, Artificial Sequence
  Description of Artificial Sequence: Synthetic peptide
DEEEIRSTNPVASEQYGVVANNLQRGTR

SEQ ID NO: 30616 - protein, 29 aa, Artificial Sequence
  Description of Artificial Sequence: Synthetic peptide
AEIEIATTNPVGTEAYGSVSTNLQSRGNR

SEQ ID NO: 30617 - protein, 28 aa, Artificial Sequence
  Description of Artificial Sequence: Synthetic peptide
DEEEIRTTNPVATCCYGEVSENEQRDNR

SEQ ID NO: 30618 - protein, 29 aa, Artificial Sequence
  Description of Artificial Sequence: Synthetic peptide
DEGEITTTNPVATECYGSVSTGNLQQGNP

SEQ ID NO: 30619 - protein, 28 aa, Artificial Sequence
  Description of Artificial Sequence: Synthetic peptide
DEEEIRTTNIVATEQFGSVSTNIQHGMK

SEQ ID NO: 30620 - protein, 30 aa, Artificial Sequence
  Description of Artificial Sequence: Synthetic polypeptide
DEEEIRTTNPVATEQYGSVSEELQIRSQND

SEQ ID NO: 30621 - protein, 28 aa, Artificial Sequence
  Description of Artificial Sequence: Synthetic peptide
DEEEIRATNPVSSEQYGAVSTNLQEGMR

SEQ ID NO: 30622 - protein, 28 aa, Artificial Sequence
  Description of Artificial Sequence: Synthetic peptide
DEEEIRTTNPVCTEQYGSASTDDQHGNA

SEQ ID NO: 30623 - protein, 29 aa, Artificial Sequence
  Description of Artificial Sequence: Synthetic peptide
DEEEIRTTNPVATEQWGSVSENEQWRGTL

SEQ ID NO: 30624 - protein, 28 aa, Artificial Sequence
  Description of Artificial Sequence: Synthetic peptide
DEEEIWTTNPVATEQYGSVFQPFQRGNA

SEQ ID NO: 30625 - protein, 31 aa, Artificial Sequence
  Description of Artificial Sequence: Synthetic polypeptide
DEEEIRTTNPVATEQYGSWSTWNLQVRDENE

SEQ ID NO: 30626 - protein, 28 aa, Artificial Sequence
  Description of Artificial Sequence: Synthetic peptide
DEHEIVTVNPVATEQYGTVSTNLQHGNQ

SEQ ID NO: 30627 - protein, 28 aa, Artificial Sequence
  Description of Artificial Sequence: Synthetic peptide
DEEEIGCTNPVATEQYGNVSENLMRGDR

SEQ ID NO: 30628 - protein, 28 aa, Artificial Sequence
  Description of Artificial Sequence: Synthetic peptide
DEAEIGTTNPVATEWYGTISENLQRGNR

SEQ ID NO: 30629 - protein, 29 aa, Artificial Sequence
  Description of Artificial Sequence: Synthetic peptide
DEEEIATTNPVGTEWYGEVSTNLQSRGNH

SEQ ID NO: 30630 - protein, 28 aa, Artificial Sequence
  Description of Artificial Sequence: Synthetic peptide
DEEEIRTVNPVATEIYGCVSTAIQRGNL

SEQ ID NO: 30631 - protein, 32 aa, Artificial Sequence
  Description of Artificial Sequence: Synthetic polypeptide
DEEEIRQTNPVATEQYGSVSVTNGLVEDRGNR

SEQ ID NO: 30632 - protein, 28 aa, Artificial Sequence
  Description of Artificial Sequence: Synthetic peptide
NEEEIRTTNPVATEQYGAVSMNWEFGNR

SEQ ID NO: 30633 - protein, 31 aa, Artificial Sequence
  Description of Artificial Sequence: Synthetic polypeptide
DEQEIRTTNPVATEQYGSVASTINDTQVGNR

SEQ ID NO: 30634 - protein, 28 aa, Artificial Sequence
  Description of Artificial Sequence: Synthetic peptide
HELEIATTNPVATEQYGSASTNIQTGNR

SEQ ID NO: 30635 - protein, 29 aa, Artificial Sequence
  Description of Artificial Sequence: Synthetic peptide
DEQEIATTNPVATEQYGVVSTNLQLKGNH

SEQ ID NO: 30636 - protein, 30 aa, Artificial Sequence
  Description of Artificial Sequence: Synthetic polypeptide
SEEEIRTTNPVATEQYGSVSTNPQLRGTTI

SEQ ID NO: 30637 - protein, 28 aa, Artificial Sequence
  Description of Artificial Sequence: Synthetic peptide
DEEEIVATNPVATEVYGSVSADLQRGPR

SEQ ID NO: 30638 - protein, 28 aa, Artificial Sequence
  Description of Artificial Sequence: Synthetic peptide
DEFEIATTNIVATEQYGEVSDNLQRGTR

SEQ ID NO: 30639 - protein, 30 aa, Artificial Sequence
  Description of Artificial Sequence: Synthetic polypeptide
MENEIRTTNPVATEQYGSVSTNLQDRGTDM

SEQ ID NO: 30640 - protein, 28 aa, Artificial Sequence
  Description of Artificial Sequence: Synthetic peptide
SEEELRTTNPCATEQYGCVSTNLQPPNR

SEQ ID NO: 30641 - protein, 28 aa, Artificial Sequence
  Description of Artificial Sequence: Synthetic peptide
QENEIRTTNPVASEQYGDVSTNLQHGNH

SEQ ID NO: 30642 - protein, 28 aa, Artificial Sequence
  Description of Artificial Sequence: Synthetic peptide
DEMEICTTNPCATEQYGDVSENLQRGNN

SEQ ID NO: 30643 - protein, 28 aa, Artificial Sequence
  Description of Artificial Sequence: Synthetic peptide
AEDEIRTTNPVCTEHYGWVSTNLQRGER

SEQ ID NO: 30644 - protein, 30 aa, Artificial Sequence
  Description of Artificial Sequence: Synthetic polypeptide
DEDEVRTTNPVATEPYGSVSATNLQRGPQR

SEQ ID NO: 30645 - protein, 28 aa, Artificial Sequence
  Description of Artificial Sequence: Synthetic peptide
DEDEIATTNPVATEQYGIVGTNLQRLTR

SEQ ID NO: 30646 - protein, 28 aa, Artificial Sequence
  Description of Artificial Sequence: Synthetic peptide
MEQEIRTTNPVATEQYGSVSENLEHGNA

SEQ ID NO: 30647 - protein, 31 aa, Artificial Sequence
  Description of Artificial Sequence: Synthetic polypeptide
DEECIRTTNPVATECCYYGSVSTPLQIRGNR

SEQ ID NO: 30648 - protein, 28 aa, Artificial Sequence
  Description of Artificial Sequence: Synthetic peptide
DENEIATTNPVATEQYGSASENLMHGNR

SEQ ID NO: 30649 - protein, 29 aa, Artificial Sequence
  Description of Artificial Sequence: Synthetic peptide
AEQEIATTNPVATEQYGIVSADNLQRGNR

SEQ ID NO: 30650 - protein, 28 aa, Artificial Sequence
  Description of Artificial Sequence: Synthetic peptide
AEEEIRTTNPTAYEQYGEVSLNLQRGNE

SEQ ID NO: 30651 - protein, 28 aa, Artificial Sequence
  Description of Artificial Sequence: Synthetic peptide
KEEEIATTNPVATEQYGEVSTNLQNEER

SEQ ID NO: 30652 - protein, 28 aa, Artificial Sequence
  Description of Artificial Sequence: Synthetic peptide
DENEIAQTNPVATEQYGSVSTDQQIGNR

SEQ ID NO: 30653 - protein, 28 aa, Artificial Sequence
  Description of Artificial Sequence: Synthetic peptide
NEHEIRTTNPVATEQYGHVSTDEQMGNR

SEQ ID NO: 30654 - protein, 30 aa, Artificial Sequence
  Description of Artificial Sequence: Synthetic polypeptide
DEEEIRTTNPTATEMYGSVISENEPQRGNR

SEQ ID NO: 30655 - protein, 28 aa, Artificial Sequence
  Description of Artificial Sequence: Synthetic peptide
DEEEIRSTNPVAYEQYGSVSTALMPGTR

SEQ ID NO: 30656 - protein, 28 aa, Artificial Sequence
  Description of Artificial Sequence: Synthetic peptide
QEQEIRTTNPVATEPYGSVSEALQRGNS

SEQ ID NO: 30657 - protein, 28 aa, Artificial Sequence
  Description of Artificial Sequence: Synthetic peptide
DEQEIATTNPVATEQYGVVSEELQAGNR

SEQ ID NO: 30658 - protein, 28 aa, Artificial Sequence
  Description of Artificial Sequence: Synthetic peptide
DEQEIRTTNPVATEQWGSVSENEMRGNA

SEQ ID NO: 30659 - protein, 28 aa, Artificial Sequence
  Description of Artificial Sequence: Synthetic peptide
DENEIATTNPVATECYGSVSTDLQHGER

SEQ ID NO: 30660 - protein, 30 aa, Artificial Sequence
  Description of Artificial Sequence: Synthetic polypeptide
DEQEIRTTNPVATEQYGSVSATFNPEEGNR

SEQ ID NO: 30661 - protein, 30 aa, Artificial Sequence
  Description of Artificial Sequence: Synthetic polypeptide
DEEEIRTTNPVATEQYGSVASTNQLREGET

SEQ ID NO: 30662 - protein, 29 aa, Artificial Sequence
  Description of Artificial Sequence: Synthetic peptide
DENEIRTTNPVATEQWGSVSENLMMRGNF

SEQ ID NO: 30663 - protein, 28 aa, Artificial Sequence
  Description of Artificial Sequence: Synthetic peptide
GEEEIRTTNPVATEVFGSVSTVLQNNNR

SEQ ID NO: 30664 - protein, 29 aa, Artificial Sequence
  Description of Artificial Sequence: Synthetic peptide
HEEEIRTTNPVATEQYGAVATDNPQRGER

SEQ ID NO: 30665 - protein, 28 aa, Artificial Sequence
  Description of Artificial Sequence: Synthetic peptide
DEEEIRTTNPFATEQYGSVSTCLDGGET

SEQ ID NO: 30666 - protein, 28 aa, Artificial Sequence
  Description of Artificial Sequence: Synthetic peptide
DEEEIRTTNPVATEQWGIVSENEQQGNA

SEQ ID NO: 30667 - protein, 29 aa, Artificial Sequence
  Description of Artificial Sequence: Synthetic peptide
DEEEIRTTNPVATEQYGAVSTEWGQHGND

SEQ ID NO: 30668 - protein, 28 aa, Artificial Sequence
  Description of Artificial Sequence: Synthetic peptide
DEEEIRTTNPVATEQYWSVSTPDFDGER

SEQ ID NO: 30669 - protein, 28 aa, Artificial Sequence
  Description of Artificial Sequence: Synthetic peptide
VENEIRTTNPVATECYGSVSTNLQYGEW

SEQ ID NO: 30670 - protein, 28 aa, Artificial Sequence
  Description of Artificial Sequence: Synthetic peptide
SDEEIATTNPVATEMYGSVSTNLMRGNS

SEQ ID NO: 30671 - protein, 28 aa, Artificial Sequence
  Description of Artificial Sequence: Synthetic peptide
DTVEIRTTNPVATEQYGSVSVNDQQGNF

SEQ ID NO: 30672 - protein, 28 aa, Artificial Sequence
  Description of Artificial Sequence: Synthetic peptide
DEQEIRTTNPVATEQYGSVSTDLEIGEF

SEQ ID NO: 30673 - protein, 28 aa, Artificial Sequence
  Description of Artificial Sequence: Synthetic peptide
DDEEIRTTNPVAYEQYGVVASNLERGNR

SEQ ID NO: 30674 - protein, 28 aa, Artificial Sequence
  Description of Artificial Sequence: Synthetic peptide
DENEIRTTNPVATEWYGSVSENEMRGTR

SEQ ID NO: 30675 - protein, 28 aa, Artificial Sequence
  Description of Artificial Sequence: Synthetic peptide
DEEEVRCTNPVATEIYGCVATNLERGNR

SEQ ID NO: 30676 - protein, 28 aa, Artificial Sequence
  Description of Artificial Sequence: Synthetic peptide
DEQEIRTTNPTATEIYGSVSTALQRGEI

SEQ ID NO: 30677 - protein, 30 aa, Artificial Sequence
  Description of Artificial Sequence: Synthetic polypeptide
DEEEIRTTNPVATEQYGSVSDNPQVSGLNP

SEQ ID NO: 30678 - protein, 29 aa, Artificial Sequence
  Description of Artificial Sequence: Synthetic peptide
DEQEIRTTNPVATESYGEVSDNLQRSNVR

SEQ ID NO: 30679 - protein, 28 aa, Artificial Sequence
  Description of Artificial Sequence: Synthetic peptide
DEQEIATTNPVATEQYGSVSTELQPGEL

SEQ ID NO: 30680 - protein, 30 aa, Artificial Sequence
  Description of Artificial Sequence: Synthetic polypeptide
DEEEIRTTNPTATEQYGSVSTMNEQNGDNL

SEQ ID NO: 30681 - protein, 28 aa, Artificial Sequence
  Description of Artificial Sequence: Synthetic peptide
SEEEIRTTNPTATEQFGSVSTNLQFGTF

SEQ ID NO: 30682 - protein, 28 aa, Artificial Sequence
  Description of Artificial Sequence: Synthetic peptide
AEEEIRTTNPVCTEQFGECSTNLQRGNI

SEQ ID NO: 30683 - protein, 30 aa, Artificial Sequence
  Description of Artificial Sequence: Synthetic polypeptide
DEQEIRTTNPVATECYGSVSATNLQHGNDL

SEQ ID NO: 30684 - protein, 33 aa, Artificial Sequence
  Description of Artificial Sequence: Synthetic polypeptide
DEEEIRTTNPVATEQYGSVSETGNGLQVYDGNR

SEQ ID NO: 30685 - protein, 28 aa, Artificial Sequence
  Description of Artificial Sequence: Synthetic peptide
DEQEIRTTNPCATEQYGSVSTELQFGED

SEQ ID NO: 30686 - protein, 31 aa, Artificial Sequence
  Description of Artificial Sequence: Synthetic polypeptide
DEEEIRTTNPVATEQFGSVSTNLPQQGINDN

SEQ ID NO: 30687 - protein, 28 aa, Artificial Sequence
  Description of Artificial Sequence: Synthetic peptide
DDEEIRATNPVASEQYGVVAMNLQRGNR

SEQ ID NO: 30688 - protein, 28 aa, Artificial Sequence
  Description of Artificial Sequence: Synthetic peptide
DESEIRTVNPVATECYGAVSTNLQRLNQ

SEQ ID NO: 30689 - protein, 28 aa, Artificial Sequence
  Description of Artificial Sequence: Synthetic peptide
DEDEIRTTNPVATECYGSVATNLEIGND

SEQ ID NO: 30690 - protein, 28 aa, Artificial Sequence
  Description of Artificial Sequence: Synthetic peptide
DEEEIRTTNPVATEQYGSWSTELDDDER

SEQ ID NO: 30691 - protein, 29 aa, Artificial Sequence
  Description of Artificial Sequence: Synthetic peptide
DEEEIRTTNPVATEQYGDVSENLQHAGQQ

SEQ ID NO: 30692 - protein, 31 aa, Artificial Sequence
  Description of Artificial Sequence: Synthetic polypeptide
DEMEIATTNPVATEQYGSVSSTVNNLQRGND

SEQ ID NO: 30693 - protein, 28 aa, Artificial Sequence
  Description of Artificial Sequence: Synthetic peptide
DEQEIRTTNPVATEQYGSVETDLERGEF

SEQ ID NO: 30694 - protein, 28 aa, Artificial Sequence
  Description of Artificial Sequence: Synthetic peptide
DEEEIATTNPVATEQYGSVSTAQESGNA

SEQ ID NO: 30695 - protein, 29 aa, Artificial Sequence
  Description of Artificial Sequence: Synthetic peptide
LEEEIRATNPVASEQFGSVSTNLQQRGPR

SEQ ID NO: 30696 - protein, 28 aa, Artificial Sequence
  Description of Artificial Sequence: Synthetic peptide
DEEEIRTTNIVATEQYGSVETDDDIGNR

SEQ ID NO: 30697 - protein, 28 aa, Artificial Sequence
  Description of Artificial Sequence: Synthetic peptide
DEEEIRTTNPVATEQYGSVSTCQEIDNL

SEQ ID NO: 30698 - protein, 28 aa, Artificial Sequence
  Description of Artificial Sequence: Synthetic peptide
DENEIRTTNPVSTEQYGEAPTNPQRGNR

SEQ ID NO: 30699 - protein, 28 aa, Artificial Sequence
  Description of Artificial Sequence: Synthetic peptide
DEEEIATTNPVATEQYGSVSTPQELGND

SEQ ID NO: 30700 - protein, 30 aa, Artificial Sequence
  Description of Artificial Sequence: Synthetic polypeptide
DEEEIRTTNPVATEQYGSVSTCDQQCNGNF

SEQ ID NO: 30701 - protein, 28 aa, Artificial Sequence
  Description of Artificial Sequence: Synthetic peptide
DESEIRTTNPVSTEQYGSVDSALQNGNR

SEQ ID NO: 30702 - protein, 28 aa, Artificial Sequence
  Description of Artificial Sequence: Synthetic peptide
DEFEISATNPVATEQYGTVSDNLQRGNF

SEQ ID NO: 30703 - protein, 28 aa, Artificial Sequence
  Description of Artificial Sequence: Synthetic peptide
QEEEIATTNPVATEQYGSVSMALQQGND

SEQ ID NO: 30704 - protein, 31 aa, Artificial Sequence
  Description of Artificial Sequence: Synthetic polypeptide
SEEEIRTTNPVATEQYGSVSTMNEQDQGNDR

SEQ ID NO: 30705 - protein, 30 aa, Artificial Sequence
  Description of Artificial Sequence: Synthetic polypeptide
DEEEIRATNPISTEIYGSVSATNLQREGNR

SEQ ID NO: 30706 - protein, 30 aa, Artificial Sequence
  Description of Artificial Sequence: Synthetic polypeptide
SEEEIRTTNPVATEQYGSVSECNEQHGNDR

SEQ ID NO: 30707 - protein, 28 aa, Artificial Sequence
  Description of Artificial Sequence: Synthetic peptide
DEGEIVTTNPVATEQYGTVSTNEQYGNH

SEQ ID NO: 30708 - protein, 29 aa, Artificial Sequence
  Description of Artificial Sequence: Synthetic peptide
DENEIRTTNPVATEQYGIVSTNEQWTGNL

SEQ ID NO: 30709 - protein, 28 aa, Artificial Sequence
  Description of Artificial Sequence: Synthetic peptide
AEEEIICTNPVATECYGSVATNDQRGNR

SEQ ID NO: 30710 - protein, 31 aa, Artificial Sequence
  Description of Artificial Sequence: Synthetic polypeptide
DEEEIRTTNPVATEQYGSVTETGGPQREGNR

SEQ ID NO: 30711 - protein, 30 aa, Artificial Sequence
  Description of Artificial Sequence: Synthetic polypeptide
DEETIRTTNPVATEQYGSVATNLQDEFVNR

SEQ ID NO: 30712 - protein, 31 aa, Artificial Sequence
  Description of Artificial Sequence: Synthetic polypeptide
DEEEIRTTNPVATEQYGSVSTANEQELGNTN

SEQ ID NO: 30713 - protein, 30 aa, Artificial Sequence
  Description of Artificial Sequence: Synthetic polypeptide
DEEEIRTTNPVATECYGSVSTDWQVNGNDR

SEQ ID NO: 30714 - protein, 31 aa, Artificial Sequence
  Description of Artificial Sequence: Synthetic polypeptide
DEEEIRTTNPVATEQYGSVDVTNNDQIRGNI

SEQ ID NO: 30715 - protein, 31 aa, Artificial Sequence
  Description of Artificial Sequence: Synthetic polypeptide
DEEEIRTTNPVATECYGSVSTNLQHEGEEDR

SEQ ID NO: 30716 - protein, 33 aa, Artificial Sequence
  Description of Artificial Sequence: Synthetic polypeptide
DEEEIRTTNPVATEQYGSVESDTNGLQVDGNDR

SEQ ID NO: 30717 - protein, 31 aa, Artificial Sequence
  Description of Artificial Sequence: Synthetic polypeptide
DEQEIRTTNPVATEEYGSVSTPNPLEDRGNR

SEQ ID NO: 30718 - protein, 30 aa, Artificial Sequence
  Description of Artificial Sequence: Synthetic polypeptide
DEEEIRTTNPVATECYGSVSTNLQHEGEDD

SEQ ID NO: 30719 - protein, 31 aa, Artificial Sequence
  Description of Artificial Sequence: Synthetic polypeptide
DEEEIRCTNPVATEQYGTVSTNLQVRAGNDD

SEQ ID NO: 30720 - protein, 28 aa, Artificial Sequence
  Description of Artificial Sequence: Synthetic peptide
DENEIVTTNPVATEQYGDVSENLQHGQR

SEQ ID NO: 30721 - protein, 29 aa, Artificial Sequence
  Description of Artificial Sequence: Synthetic peptide
DEEEIRTTNPVATEQYGDVSENLQIHEER

SEQ ID NO: 30722 - protein, 31 aa, Artificial Sequence
  Description of Artificial Sequence: Synthetic polypeptide
DEQEIRTTNPVATEQYGSVSTDLQEREGEDR

SEQ ID NO: 30723 - protein, 29 aa, Artificial Sequence
  Description of Artificial Sequence: Synthetic peptide
DEVEIRTTNPVATEQYGEVSEMNLQHGND

SEQ ID NO: 30724 - protein, 30 aa, Artificial Sequence
  Description of Artificial Sequence: Synthetic polypeptide
DEEEIRTTNPVATECYGSVSTNLEERKGEI

SEQ ID NO: 30725 - protein, 31 aa, Artificial Sequence
  Description of Artificial Sequence: Synthetic polypeptide
DEQEIRTTNPVATEQYGSVSTNPLEDEGNDR

SEQ ID NO: 30726 - protein, 30 aa, Artificial Sequence
  Description of Artificial Sequence: Synthetic polypeptide
DEEEIRTTNPVATEQYGVVSTELQIQGNDL

SEQ ID NO: 30727 - protein, 28 aa, Artificial Sequence
  Description of Artificial Sequence: Synthetic peptide
VEEEVRATNPVATEQYGCVSMNLQRGNQ

SEQ ID NO: 30728 - protein, 28 aa, Artificial Sequence
  Description of Artificial Sequence: Synthetic peptide
DEEEIRATNPVSTEQYGEVSTVLQHGMR

SEQ ID NO: 30729 - protein, 29 aa, Artificial Sequence
  Description of Artificial Sequence: Synthetic peptide
QENEICTTNPVATEQYGDVSAENLQRGNR

SEQ ID NO: 30730 - protein, 28 aa, Artificial Sequence
  Description of Artificial Sequence: Synthetic peptide
SENEIRTTNPVSTELWGSVSTNLQRGDR

SEQ ID NO: 30731 - protein, 30 aa, Artificial Sequence
  Description of Artificial Sequence: Synthetic polypeptide
DEEEIATTNPVATEQYGEVSTNPQRGDTDR

SEQ ID NO: 30732 - protein, 28 aa, Artificial Sequence
  Description of Artificial Sequence: Synthetic peptide
DEEEIRTTNPVSTECYGEVSANLQRING

SEQ ID NO: 30733 - protein, 28 aa, Artificial Sequence
  Description of Artificial Sequence: Synthetic peptide
AEEEICTTNPVATEPYGNVCENLQRGNR

SEQ ID NO: 30734 - protein, 28 aa, Artificial Sequence
  Description of Artificial Sequence: Synthetic peptide
SEEEIRTTNPAATECFGCVSTNLQQGNR

SEQ ID NO: 30735 - protein, 28 aa, Artificial Sequence
  Description of Artificial Sequence: Synthetic peptide
DEQEITTTNPVATEQYGCVSANWQRGNG

SEQ ID NO: 30736 - protein, 28 aa, Artificial Sequence
  Description of Artificial Sequence: Synthetic peptide
QEQEIATTNPVATEQYGEASENLQRGNR

SEQ ID NO: 30737 - protein, 30 aa, Artificial Sequence
  Description of Artificial Sequence: Synthetic polypeptide
DEEEIRTTNPVATEQYGSVSTNPQENGEDF

SEQ ID NO: 30738 - protein, 29 aa, Artificial Sequence
  Description of Artificial Sequence: Synthetic peptide
DEEEIRTTNPVATEQYGSVSDNLQISEDG

SEQ ID NO: 30739 - protein, 29 aa, Artificial Sequence
  Description of Artificial Sequence: Synthetic peptide
DEQEIRTTNPCAYEQYGCVSMNLQREGNR

SEQ ID NO: 30740 - protein, 31 aa, Artificial Sequence
  Description of Artificial Sequence: Synthetic polypeptide
DEEEIRTTNPTATEQYGSVSTGNPQDNEGNR

SEQ ID NO: 30741 - protein, 28 aa, Artificial Sequence
  Description of Artificial Sequence: Synthetic peptide
SEEEIRTTNPVATEQYGEVSENLQSGDL

SEQ ID NO: 30742 - protein, 28 aa, Artificial Sequence
  Description of Artificial Sequence: Synthetic peptide
DEEEIRTTNPVATEQFGVCSENLQRGDF

SEQ ID NO: 30743 - protein, 28 aa, Artificial Sequence
  Description of Artificial Sequence: Synthetic peptide
DEDEISTTNPVATEQYGVVSDNLQTGNH

SEQ ID NO: 30744 - protein, 28 aa, Artificial Sequence
  Description of Artificial Sequence: Synthetic peptide
QEAEIVTTNPVATEQYGSVSTALQYGNE

SEQ ID NO: 30745 - protein, 28 aa, Artificial Sequence
  Description of Artificial Sequence: Synthetic peptide
DEEEIAQTNPVATEQYGVVSENLEVGNR

SEQ ID NO: 30746 - protein, 28 aa, Artificial Sequence
  Description of Artificial Sequence: Synthetic peptide
DESEIVTTNPVATESYGESSTNLQRGGR

SEQ ID NO: 30747 - protein, 28 aa, Artificial Sequence
  Description of Artificial Sequence: Synthetic peptide
DEEEIRTTNPVSTEIYGSVSENLQFGEH

SEQ ID NO: 30748 - protein, 28 aa, Artificial Sequence
  Description of Artificial Sequence: Synthetic peptide
AENEIRQTNPVATEQYGSVSENLEVGNR

SEQ ID NO: 30749 - protein, 28 aa, Artificial Sequence
  Description of Artificial Sequence: Synthetic peptide
QEEEIRATNIVATEQYGSASDNLQRGQR

SEQ ID NO: 30750 - protein, 28 aa, Artificial Sequence
  Description of Artificial Sequence: Synthetic peptide
SEEEIRTTNPTATEQYGSVSTNPQVGTL

SEQ ID NO: 30751 - protein, 28 aa, Artificial Sequence
  Description of Artificial Sequence: Synthetic peptide
DEEEIATTNPTATEQYGGVSENLQRGDS

SEQ ID NO: 30752 - protein, 30 aa, Artificial Sequence
  Description of Artificial Sequence: Synthetic polypeptide
QEEEIRTTNPVATEQYGSVSTDLQESGNDN

SEQ ID NO: 30753 - protein, 30 aa, Artificial Sequence
  Description of Artificial Sequence: Synthetic polypeptide
DEEEIATVNPVATEQYGEVSTNLQSRAGGR

SEQ ID NO: 30754 - protein, 28 aa, Artificial Sequence
  Description of Artificial Sequence: Synthetic peptide
QEEEITTTNPVATECYGSVSENLQREER

SEQ ID NO: 30755 - protein, 28 aa, Artificial Sequence
  Description of Artificial Sequence: Synthetic peptide
DEEEIRTTNPEATEQYGSVSTEEDRGET

SEQ ID NO: 30756 - protein, 28 aa, Artificial Sequence
  Description of Artificial Sequence: Synthetic peptide
DECEIRCTNPVATEGYGDVSTNLQMGNN

SEQ ID NO: 30757 - protein, 28 aa, Artificial Sequence
  Description of Artificial Sequence: Synthetic peptide
DENEIRTTNPTATEQYGSVSTNVQSGDF

SEQ ID NO: 30758 - protein, 28 aa, Artificial Sequence
  Description of Artificial Sequence: Synthetic peptide
AEEEIRTTNPVATEQYGSVSTAEIFGNQ

SEQ ID NO: 30759 - protein, 28 aa, Artificial Sequence
  Description of Artificial Sequence: Synthetic peptide
DENEIATTNPVATECYGSVSTDLEVGNR

SEQ ID NO: 30760 - protein, 28 aa, Artificial Sequence
  Description of Artificial Sequence: Synthetic peptide
VEQEIRTTNPVATEMYGCVATDLQRGNR

SEQ ID NO: 30761 - protein, 28 aa, Artificial Sequence
  Description of Artificial Sequence: Synthetic peptide
DEEEIVTTNPVATEQYGSASENIQRGGA

SEQ ID NO: 30762 - protein, 28 aa, Artificial Sequence
  Description of Artificial Sequence: Synthetic peptide
DEEEIACTNPVASEQYGTVSTNLQQGNE

SEQ ID NO: 30763 - protein, 28 aa, Artificial Sequence
  Description of Artificial Sequence: Synthetic peptide
DEDEVRTTNPIATEMYGAVSTNLERGNR

SEQ ID NO: 30764 - protein, 32 aa, Artificial Sequence
  Description of Artificial Sequence: Synthetic polypeptide
DEEEIRTTNPVATEQYGSVSTCNLQEIGDNDA

SEQ ID NO: 30765 - protein, 30 aa, Artificial Sequence
  Description of Artificial Sequence: Synthetic polypeptide
DEQEIRTTNPVATEQYGSVSTNPPQGGINA

SEQ ID NO: 30766 - protein, 30 aa, Artificial Sequence
  Description of Artificial Sequence: Synthetic polypeptide
DEEEIRTTNPVATEQYGSVSTNLEEYNGEF

SEQ ID NO: 30767 - protein, 28 aa, Artificial Sequence
  Description of Artificial Sequence: Synthetic peptide
AENEIATTNPVATEQYGEASENLQRGNR

SEQ ID NO: 30768 - protein, 28 aa, Artificial Sequence
  Description of Artificial Sequence: Synthetic peptide
CESEIVTTNPVATEQYGEVATNLQRGTR

SEQ ID NO: 30769 - protein, 28 aa, Artificial Sequence
  Description of Artificial Sequence: Synthetic peptide
SEEEIRTTNPVATEQFGGVSTNPQHGNG

SEQ ID NO: 30770 - protein, 31 aa, Artificial Sequence
  Description of Artificial Sequence: Synthetic polypeptide
DEEEIRTTNPVATEQYGSVSTDLQEDGENDC

SEQ ID NO: 30771 - protein, 28 aa, Artificial Sequence
  Description of Artificial Sequence: Synthetic peptide
DEEEIRTTNPVATEQYGNVETDGQWGNQ

SEQ ID NO: 30772 - protein, 30 aa, Artificial Sequence
  Description of Artificial Sequence: Synthetic polypeptide
DEEEIRTTNPVSTEQYGTVSTENLQQNGNH

SEQ ID NO: 30773 - protein, 29 aa, Artificial Sequence
  Description of Artificial Sequence: Synthetic peptide
DEEEIRCTNPVSTEQWGIVSTNLQRAGTR

SEQ ID NO: 30774 - protein, 31 aa, Artificial Sequence
  Description of Artificial Sequence: Synthetic polypeptide
NEEEIRTTNPVATEQYGSVDTMNLQQFAGNR

SEQ ID NO: 30775 - protein, 28 aa, Artificial Sequence
  Description of Artificial Sequence: Synthetic peptide
DDDELATTNPVSTEQYGSVSTNLMRGNR

SEQ ID NO: 30776 - protein, 28 aa, Artificial Sequence
  Description of Artificial Sequence: Synthetic peptide
EEEEIATTNPVATEQYGEGSTNLQSGQR

SEQ ID NO: 30777 - protein, 31 aa, Artificial Sequence
  Description of Artificial Sequence: Synthetic polypeptide
YEEEIRTVNPVATEQYGSVSTCNLQQRGNDT

SEQ ID NO: 30778 - protein, 33 aa, Artificial Sequence
  Description of Artificial Sequence: Synthetic polypeptide
DEEELRTTNPVATEQYGSVDSTNLDQTRQGNDR

SEQ ID NO: 30779 - protein, 28 aa, Artificial Sequence
  Description of Artificial Sequence: Synthetic peptide
DEGEIRATNPVATEVYGDVSTNIQRGNF

SEQ ID NO: 30780 - protein, 29 aa, Artificial Sequence
  Description of Artificial Sequence: Synthetic peptide
DEEEIRTTNPVATEQWGSVSTNEMNQGNM

SEQ ID NO: 30781 - protein, 30 aa, Artificial Sequence
  Description of Artificial Sequence: Synthetic polypeptide
DENEIRTTNPVATEQWGSVSTNLQIQGNDF

SEQ ID NO: 30782 - protein, 30 aa, Artificial Sequence
  Description of Artificial Sequence: Synthetic polypeptide
DEAEIASTNPVATEQYGSVSEMNLQERGNR

SEQ ID NO: 30783 - protein, 30 aa, Artificial Sequence
  Description of Artificial Sequence: Synthetic polypeptide
DEQEIRQTNPVATEQYGSVSTEGPQREGNR

SEQ ID NO: 30784 - protein, 31 aa, Artificial Sequence
  Description of Artificial Sequence: Synthetic polypeptide
DEEEIRATNPVATEQYGSVATNLDDREGNDR

SEQ ID NO: 30785 - protein, 28 aa, Artificial Sequence
  Description of Artificial Sequence: Synthetic peptide
DEEEIRTTNPVATEQYGSASENLMHFQR

SEQ ID NO: 30786 - protein, 32 aa, Artificial Sequence
  Description of Artificial Sequence: Synthetic polypeptide
DEEEIRTTNPVATEQYGSVTSTDGLNQNRGNG

SEQ ID NO: 30787 - protein, 28 aa, Artificial Sequence
  Description of Artificial Sequence: Synthetic peptide
DEEEIRSTNPVSTEQYGTVAMNLQRGNQ

SEQ ID NO: 30788 - protein, 28 aa, Artificial Sequence
  Description of Artificial Sequence: Synthetic peptide
DEEEIRTTNPTATEQYGSVSTGPYQGNG

SEQ ID NO: 30789 - protein, 30 aa, Artificial Sequence
  Description of Artificial Sequence: Synthetic polypeptide
DEEEIRTTNPVATECYGSVSITDLQEVGNN

SEQ ID NO: 30790 - protein, 28 aa, Artificial Sequence
  Description of Artificial Sequence: Synthetic peptide
DEIEISTTNPVATEQYGAVATTLQRGTR

SEQ ID NO: 30791 - protein, 28 aa, Artificial Sequence
  Description of Artificial Sequence: Synthetic peptide
QEHEIRTTNPVATEQYGVVSENLQDGNV

SEQ ID NO: 30792 - protein, 28 aa, Artificial Sequence
  Description of Artificial Sequence: Synthetic peptide
DEQEIATVNPVSTEQYGSASENLQRGNR

SEQ ID NO: 30793 - protein, 28 aa, Artificial Sequence
  Description of Artificial Sequence: Synthetic peptide
DENEIVATNPVATEIYGSVSTNLQHGNM

SEQ ID NO: 30794 - protein, 28 aa, Artificial Sequence
  Description of Artificial Sequence: Synthetic peptide
GEEEISTTNPVATEQYGSVSMNLQNGDS

SEQ ID NO: 30795 - protein, 28 aa, Artificial Sequence
  Description of Artificial Sequence: Synthetic peptide
DEEEIATTNPVATECYGSVSTDLEHGNL

SEQ ID NO: 30796 - protein, 28 aa, Artificial Sequence
  Description of Artificial Sequence: Synthetic peptide
DELEIRTTNPVGTEQYGSISTNWQQGNQ

SEQ ID NO: 30797 - protein, 28 aa, Artificial Sequence
  Description of Artificial Sequence: Synthetic peptide
DEEEIRTTNPVATECYGSVSMDLEHGNM

SEQ ID NO: 30798 - protein, 29 aa, Artificial Sequence
  Description of Artificial Sequence: Synthetic peptide
QEQEIATTNPVATEQYGEVSAENLQRGNR

SEQ ID NO: 30799 - protein, 28 aa, Artificial Sequence
  Description of Artificial Sequence: Synthetic peptide
DEEEIRTVNPVASEQYGSASTDLQNGNM

SEQ ID NO: 30800 - protein, 29 aa, Artificial Sequence
  Description of Artificial Sequence: Synthetic peptide
DENEIRTTNPVATEQYGSASANLQCHGNH

SEQ ID NO: 30801 - protein, 28 aa, Artificial Sequence
  Description of Artificial Sequence: Synthetic peptide
DEEEIRTVNPVATENYGSVSNNDQDGMR

SEQ ID NO: 30802 - protein, 28 aa, Artificial Sequence
  Description of Artificial Sequence: Synthetic peptide
SEEEIRCTNPVATEQYGSVSTELERGDQ

SEQ ID NO: 30803 - protein, 28 aa, Artificial Sequence
  Description of Artificial Sequence: Synthetic peptide
QEQEIATTNPVSTEVYGSVSTNLQHGNR

SEQ ID NO: 30804 - protein, 28 aa, Artificial Sequence
  Description of Artificial Sequence: Synthetic peptide
DEVEIRTTNPTATEQYGSVSENEQNGNF

SEQ ID NO: 30805 - protein, 28 aa, Artificial Sequence
  Description of Artificial Sequence: Synthetic peptide
DEEEIRTTNPTATEQYGSCSDNAQGQNR

SEQ ID NO: 30806 - protein, 28 aa, Artificial Sequence
  Description of Artificial Sequence: Synthetic peptide
DEQEIGTTNIVATEQFGEVSTVLQRGNR

SEQ ID NO: 30807 - protein, 28 aa, Artificial Sequence
  Description of Artificial Sequence: Synthetic peptide
DENEIRTTNPVATECWGSVSENEQRGNW

SEQ ID NO: 30808 - protein, 28 aa, Artificial Sequence
  Description of Artificial Sequence: Synthetic peptide
DEEEIASTNPVATEQYGVMSTNLQWGER

SEQ ID NO: 30809 - protein, 28 aa, Artificial Sequence
  Description of Artificial Sequence: Synthetic peptide
DEEEIRLTNIVATEQYGEVSTMSQRGTR

SEQ ID NO: 30810 - protein, 28 aa, Artificial Sequence
  Description of Artificial Sequence: Synthetic peptide
AESEIGTTNPVSTEQYGSVSENLQRGGR

SEQ ID NO: 30811 - protein, 28 aa, Artificial Sequence
  Description of Artificial Sequence: Synthetic peptide
NEEEICTTNPVGTEQWGSVCTNVQRGNR

SEQ ID NO: 30812 - protein, 28 aa, Artificial Sequence
  Description of Artificial Sequence: Synthetic peptide
DENEIRTTNPVATEQYGEAATVLQRGGR

SEQ ID NO: 30813 - protein, 29 aa, Artificial Sequence
  Description of Artificial Sequence: Synthetic peptide
DEEEISSTNPVATEQYGDVISTNLQNGNA

SEQ ID NO: 30814 - protein, 28 aa, Artificial Sequence
  Description of Artificial Sequence: Synthetic peptide
DEEEIRTTNPASTEHYGSVSDNVQRGNY

SEQ ID NO: 30815 - protein, 28 aa, Artificial Sequence
  Description of Artificial Sequence: Synthetic peptide
DEEEIRTTNIFATEQYGSVEIILQDGNR

SEQ ID NO: 30816 - protein, 28 aa, Artificial Sequence
  Description of Artificial Sequence: Synthetic peptide
DEEEIRTTNPIATEQYGTTGTELQRGNI

SEQ ID NO: 30817 - protein, 29 aa, Artificial Sequence
  Description of Artificial Sequence: Synthetic peptide
DENEIATTNPVATEQYGSASENLQRAGNQ

SEQ ID NO: 30818 - protein, 28 aa, Artificial Sequence
  Description of Artificial Sequence: Synthetic peptide
DEEEIRATNPIATENYGAVAMNLQRGNR

SEQ ID NO: 30819 - protein, 32 aa, Artificial Sequence
  Description of Artificial Sequence: Synthetic polypeptide
DENEIRTTNPVATEQYGSVSITEELQREGENR

SEQ ID NO: 30820 - protein, 28 aa, Artificial Sequence
  Description of Artificial Sequence: Synthetic peptide
DEEEIRATNPVATECYGVVSTNLQWGDV

SEQ ID NO: 30821 - protein, 28 aa, Artificial Sequence
  Description of Artificial Sequence: Synthetic peptide
SEEEIRTTNPVATEQFGDVSENEQRGNQ

SEQ ID NO: 30822 - protein, 28 aa, Artificial Sequence
  Description of Artificial Sequence: Synthetic peptide
DEEEIITTNIVATEQYGSVSTNGIAGFR

SEQ ID NO: 30823 - protein, 28 aa, Artificial Sequence
  Description of Artificial Sequence: Synthetic peptide
DEEEIRTTNIVRTEQYGSVSDNTQRSNS

SEQ ID NO: 30824 - protein, 28 aa, Artificial Sequence
  Description of Artificial Sequence: Synthetic peptide
DEDEVRCVNPVATEPYGSVATNLQRGNR

SEQ ID NO: 30825 - protein, 28 aa, Artificial Sequence
  Description of Artificial Sequence: Synthetic peptide
DEEEVRTTNIIATESYGGVSTNLQRGNM

SEQ ID NO: 30826 - protein, 28 aa, Artificial Sequence
  Description of Artificial Sequence: Synthetic peptide
DEQEIRTTNPVATEQYGSVETEDQMGNS

SEQ ID NO: 30827 - protein, 29 aa, Artificial Sequence
  Description of Artificial Sequence: Synthetic peptide
DEEEIRTTNPVSTEMYGSVSANMQRGDNF

SEQ ID NO: 30828 - protein, 29 aa, Artificial Sequence
  Description of Artificial Sequence: Synthetic peptide
AEEEIRSTNPVATEQYGFVSENLQSRGDR

SEQ ID NO: 30829 - protein, 32 aa, Artificial Sequence
  Description of Artificial Sequence: Synthetic polypeptide
DEEEIRTTNPVATEQYGSVDSDENLEDREGNR

SEQ ID NO: 30830 - protein, 28 aa, Artificial Sequence
  Description of Artificial Sequence: Synthetic peptide
DEQEIRTVNPVSTEVYGEVSTNLQHGNR

SEQ ID NO: 30831 - protein, 28 aa, Artificial Sequence
  Description of Artificial Sequence: Synthetic peptide
DEEEITTTNPVATEQYGEVSCVLQMSNR

SEQ ID NO: 30832 - protein, 28 aa, Artificial Sequence
  Description of Artificial Sequence: Synthetic peptide
SEEEISTTNPVATEQYGCVSTNPARGNF

SEQ ID NO: 30833 - protein, 30 aa, Artificial Sequence
  Description of Artificial Sequence: Synthetic polypeptide
DEEEIRTTNPVATEQYGSVSTIEPLQDGEW

SEQ ID NO: 30834 - protein, 28 aa, Artificial Sequence
  Description of Artificial Sequence: Synthetic peptide
DEEEIVTTNPDATEQYGSVSTVDQNGNF

SEQ ID NO: 30835 - protein, 28 aa, Artificial Sequence
  Description of Artificial Sequence: Synthetic peptide
HEEEIRTTNPIATEAYGSVSTTPQRGNH

SEQ ID NO: 30836 - protein, 28 aa, Artificial Sequence
  Description of Artificial Sequence: Synthetic peptide
DEAEIKTTNPVATEVYGEVSENLQRGQR

SEQ ID NO: 30837 - protein, 30 aa, Artificial Sequence
  Description of Artificial Sequence: Synthetic polypeptide
DEEEIRTTNPVCTEQYGSVSCTDLQNGNDF

SEQ ID NO: 30838 - protein, 28 aa, Artificial Sequence
  Description of Artificial Sequence: Synthetic peptide
DEQEIRTTNPEATEQYGSVSTDDERGNL

SEQ ID NO: 30839 - protein, 28 aa, Artificial Sequence
  Description of Artificial Sequence: Synthetic peptide
SLEEIRTTNPVAWEQFGSVSTGEQRGNR

SEQ ID NO: 30840 - protein, 28 aa, Artificial Sequence
  Description of Artificial Sequence: Synthetic peptide
DEQEIRTTNPVATECYGSVSTNLEHGEL

SEQ ID NO: 30841 - protein, 30 aa, Artificial Sequence
  Description of Artificial Sequence: Synthetic polypeptide
QEEEIVTTNPVATEQYGSVSTNLQIQEGNH

SEQ ID NO: 30842 - protein, 30 aa, Artificial Sequence
  Description of Artificial Sequence: Synthetic polypeptide
DEGEIRTTNPVATEQYGAVSTNEQRQGNTF

SEQ ID NO: 30843 - protein, 28 aa, Artificial Sequence
  Description of Artificial Sequence: Synthetic peptide
DEEEIRVTNPVATEQYGEVPDNLQTGNN

SEQ ID NO: 30844 - protein, 28 aa, Artificial Sequence
  Description of Artificial Sequence: Synthetic peptide
SEEEIAATNPVATEQFGGVSENLQRGNR

SEQ ID NO: 30845 - protein, 28 aa, Artificial Sequence
  Description of Artificial Sequence: Synthetic peptide
SEEEIRTTNPVATECYGSYHDNLQRGNV

SEQ ID NO: 30846 - protein, 28 aa, Artificial Sequence
  Description of Artificial Sequence: Synthetic peptide
DEEEIRTTNPVATEQYGSVSTCEDDGDY

SEQ ID NO: 30847 - protein, 28 aa, Artificial Sequence
  Description of Artificial Sequence: Synthetic peptide
DENEITTTNPVATEIYGVVSTNLQHGNN

SEQ ID NO: 30848 - protein, 32 aa, Artificial Sequence
  Description of Artificial Sequence: Synthetic polypeptide
DEEEIRTTNPVATEQYGSVSTTPLVQLEGENR

SEQ ID NO: 30849 - protein, 31 aa, Artificial Sequence
  Description of Artificial Sequence: Synthetic polypeptide
DEQEIRTTNPVATEQYGSVDCTMELQCRGNR

SEQ ID NO: 30850 - protein, 31 aa, Artificial Sequence
  Description of Artificial Sequence: Synthetic polypeptide
SEEEIRTTNPVATEQYGSVSTNPPQREGENS

SEQ ID NO: 30851 - protein, 28 aa, Artificial Sequence
  Description of Artificial Sequence: Synthetic peptide
SEEEITTTNPIATEQYGGVSTNLQGGNF

SEQ ID NO: 30852 - protein, 28 aa, Artificial Sequence
  Description of Artificial Sequence: Synthetic peptide
AENEIATTNPFATEQYGSASTNLQRGER

SEQ ID NO: 30853 - protein, 28 aa, Artificial Sequence
  Description of Artificial Sequence: Synthetic peptide
DEEEIATTNPVATEQYGDVSENLMHGQR

SEQ ID NO: 30854 - protein, 31 aa, Artificial Sequence
  Description of Artificial Sequence: Synthetic polypeptide
DEEEIRTTNPVATEQYGSVSITNPDQSGDER

SEQ ID NO: 30855 - protein, 28 aa, Artificial Sequence
  Description of Artificial Sequence: Synthetic peptide
DEEEIRTTNPDATEQYGSVSTDLNWENA

SEQ ID NO: 30856 - protein, 28 aa, Artificial Sequence
  Description of Artificial Sequence: Synthetic peptide
DEEEIACTNPVATEQWGGVSENIQRGNR

SEQ ID NO: 30857 - protein, 29 aa, Artificial Sequence
  Description of Artificial Sequence: Synthetic peptide
DEEEIRTVNPCATEQWGSVSTNVQNRGER

SEQ ID NO: 30858 - protein, 29 aa, Artificial Sequence
  Description of Artificial Sequence: Synthetic peptide
DEEEIRATNPVATEMYGSMATNLQDGNDR

SEQ ID NO: 30859 - protein, 28 aa, Artificial Sequence
  Description of Artificial Sequence: Synthetic peptide
DEHEIRTTNPVATEQYGWVSENQQQGNC

SEQ ID NO: 30860 - protein, 29 aa, Artificial Sequence
  Description of Artificial Sequence: Synthetic peptide
DEEEIRTTNPVATEMYGEVISENPQRGNF

SEQ ID NO: 30861 - protein, 30 aa, Artificial Sequence
  Description of Artificial Sequence: Synthetic polypeptide
NENEISTTNPVATEQYGSVSTNLQQREGNH

SEQ ID NO: 30862 - protein, 28 aa, Artificial Sequence
  Description of Artificial Sequence: Synthetic peptide
QENEIGTTNPVATEIYGDVSTNLQNGNR

SEQ ID NO: 30863 - protein, 30 aa, Artificial Sequence
  Description of Artificial Sequence: Synthetic polypeptide
DEEEIRTTNPVATEQWGNVSDNLMWRGDNR

SEQ ID NO: 30864 - protein, 28 aa, Artificial Sequence
  Description of Artificial Sequence: Synthetic peptide
DEEEIRTTNPVATEQYWSVETNLDPGEP

SEQ ID NO: 30865 - protein, 33 aa, Artificial Sequence
  Description of Artificial Sequence: Synthetic polypeptide
DEEEIRTTNPVATEQYGSVDSDTNLPEERGENR

SEQ ID NO: 30866 - protein, 28 aa, Artificial Sequence
  Description of Artificial Sequence: Synthetic peptide
GEDEIATTNPVATEQYGTVSTNLQRQNN

SEQ ID NO: 30867 - protein, 28 aa, Artificial Sequence
  Description of Artificial Sequence: Synthetic peptide
DEEEIRTTNPVASELYGVVSMNLQRGTQ

SEQ ID NO: 30868 - protein, 30 aa, Artificial Sequence
  Description of Artificial Sequence: Synthetic polypeptide
DEEEVRSVNPVATEQYGSVSTELQPRGNDR

SEQ ID NO: 30869 - protein, 28 aa, Artificial Sequence
  Description of Artificial Sequence: Synthetic peptide
DEGEIRTTNPVATEQYGQVSTPLYRGTD

SEQ ID NO: 30870 - protein, 28 aa, Artificial Sequence
  Description of Artificial Sequence: Synthetic peptide
DESEITTTNPCATEIYGVVSTNLQRGNL

SEQ ID NO: 30871 - protein, 28 aa, Artificial Sequence
  Description of Artificial Sequence: Synthetic peptide
DEEEIRATNPVSTEQYGSVSTNVAVGDR

SEQ ID NO: 30872 - protein, 28 aa, Artificial Sequence
  Description of Artificial Sequence: Synthetic peptide
DEEEIRCTNPVAYEIYGGVSMNLERGNR

SEQ ID NO: 30873 - protein, 28 aa, Artificial Sequence
  Description of Artificial Sequence: Synthetic peptide
DEDEIATTNPVATEVYGSVSENLQRGTT

SEQ ID NO: 30874 - protein, 29 aa, Artificial Sequence
  Description of Artificial Sequence: Synthetic peptide
DEDEIRTTNPVSTEQYGSVSAEQLQRENR

SEQ ID NO: 30875 - protein, 30 aa, Artificial Sequence
  Description of Artificial Sequence: Synthetic polypeptide
DEEEIRPTNPVATEQYGSVATNVQTRGNPL

SEQ ID NO: 30876 - protein, 28 aa, Artificial Sequence
  Description of Artificial Sequence: Synthetic peptide
DEGEIRCTNPVCTEQYGSVSTNLQNENF

SEQ ID NO: 30877 - protein, 28 aa, Artificial Sequence
  Description of Artificial Sequence: Synthetic peptide
MEEEIATTNPVATEQYGSMSDNLERGNK

SEQ ID NO: 30878 - protein, 28 aa, Artificial Sequence
  Description of Artificial Sequence: Synthetic peptide
DEQEIRTTNPVASEIYGCVSNNLERGNR

SEQ ID NO: 30879 - protein, 28 aa, Artificial Sequence
  Description of Artificial Sequence: Synthetic peptide
DEEQIRTTNPVAYQQYGSVSTGDQPGNR

SEQ ID NO: 30880 - protein, 28 aa, Artificial Sequence
  Description of Artificial Sequence: Synthetic peptide
DEEEIKTTNIRATEQYGTVSTNEQRGNT

SEQ ID NO: 30881 - protein, 28 aa, Artificial Sequence
  Description of Artificial Sequence: Synthetic peptide
DEEEIAQTNPVATEQYGVVSTGDERGNR

SEQ ID NO: 30882 - protein, 30 aa, Artificial Sequence
  Description of Artificial Sequence: Synthetic polypeptide
DEQEIRTTNPVATEQYGSVSTNPLQEGEEN

SEQ ID NO: 30883 - protein, 29 aa, Artificial Sequence
  Description of Artificial Sequence: Synthetic peptide
DENEIRTTNPVATECYGSVSTNLQHENDM

SEQ ID NO: 30884 - protein, 28 aa, Artificial Sequence
  Description of Artificial Sequence: Synthetic peptide
DEQEIRTTNPVATEQYGSVETNDERENF

SEQ ID NO: 30885 - protein, 30 aa, Artificial Sequence
  Description of Artificial Sequence: Synthetic polypeptide
DEEEIRQTNPVATECYGSVPENLVQRGNDR

SEQ ID NO: 30886 - protein, 28 aa, Artificial Sequence
  Description of Artificial Sequence: Synthetic peptide
DEQEIATTNPVATEQYGSVDEDLQHGNR

SEQ ID NO: 30887 - protein, 29 aa, Artificial Sequence
  Description of Artificial Sequence: Synthetic peptide
DENEIRTTNPVATEQYGSVSENEMMRGNA

SEQ ID NO: 30888 - protein, 29 aa, Artificial Sequence
  Description of Artificial Sequence: Synthetic peptide
DEEEIRCTNPVATEVYGSVATNLQSGAPR

SEQ ID NO: 30889 - protein, 28 aa, Artificial Sequence
  Description of Artificial Sequence: Synthetic peptide
SEEEIRTTNPAATEQYGSVSVNLQVGDA

SEQ ID NO: 30890 - protein, 30 aa, Artificial Sequence
  Description of Artificial Sequence: Synthetic polypeptide
DEEEIRTTNPVATEQYGSVSEMNLQQGDTN

SEQ ID NO: 30891 - protein, 28 aa, Artificial Sequence
  Description of Artificial Sequence: Synthetic peptide
DEEEVRTTNPVATEPWGSVTADLQRGNR

SEQ ID NO: 30892 - protein, 28 aa, Artificial Sequence
  Description of Artificial Sequence: Synthetic peptide
DEQEIATTNPVSTEQYGEASTVLQRGNR

SEQ ID NO: 30893 - protein, 28 aa, Artificial Sequence
  Description of Artificial Sequence: Synthetic peptide
DENEIATTNPVASEQYGVVSTNLQIGNN

SEQ ID NO: 30894 - protein, 28 aa, Artificial Sequence
  Description of Artificial Sequence: Synthetic peptide
DENEITTTNPVATEMWGSVSENLQRGNI

SEQ ID NO: 30895 - protein, 28 aa, Artificial Sequence
  Description of Artificial Sequence: Synthetic peptide
KENEIATTNPVATEQYGVVSTNLQAGNE

SEQ ID NO: 30896 - protein, 30 aa, Artificial Sequence
  Description of Artificial Sequence: Synthetic polypeptide
DENEIYTTNPVATEQYGSVSTALQRNGNFH

SEQ ID NO: 30897 - protein, 31 aa, Artificial Sequence
  Description of Artificial Sequence: Synthetic polypeptide
DEEEIRTTNPVATEQYGSVSTVHLPQDGVNA

SEQ ID NO: 30898 - protein, 28 aa, Artificial Sequence
  Description of Artificial Sequence: Synthetic peptide
SEVEIMTTNIVSTEQYGSVSENLQRGNR

SEQ ID NO: 30899 - protein, 28 aa, Artificial Sequence
  Description of Artificial Sequence: Synthetic peptide
DEEEIRTTNPVASEHWGSTSDNLQRGGR

SEQ ID NO: 30900 - protein, 28 aa, Artificial Sequence
  Description of Artificial Sequence: Synthetic peptide
SEEEIATTNPVACEPYGSVSNNLQPGNR

SEQ ID NO: 30901 - protein, 28 aa, Artificial Sequence
  Description of Artificial Sequence: Synthetic peptide
SEEEIRATNPVATECYGEVSENLQRGNQ

SEQ ID NO: 30902 - protein, 30 aa, Artificial Sequence
  Description of Artificial Sequence: Synthetic polypeptide
DEEEIVTTNPVATEQYGVVSTNLQHKGNDL

SEQ ID NO: 30903 - protein, 31 aa, Artificial Sequence
  Description of Artificial Sequence: Synthetic polypeptide
KDEEIRTTNPVATEQYGSVSTNLQPRDGDND

SEQ ID NO: 30904 - protein, 28 aa, Artificial Sequence
  Description of Artificial Sequence: Synthetic peptide
AEEEIGTTNPVATEIYGDVSTNLQMGQR

SEQ ID NO: 30905 - protein, 28 aa, Artificial Sequence
  Description of Artificial Sequence: Synthetic peptide
DEEEIRTTNPVSTELYGSVSTNEQGGDM

SEQ ID NO: 30906 - protein, 28 aa, Artificial Sequence
  Description of Artificial Sequence: Synthetic peptide
DEEEIRTTNPEATEQYGSASTDPQFGNY

SEQ ID NO: 30907 - protein, 28 aa, Artificial Sequence
  Description of Artificial Sequence: Synthetic peptide
GEEEIRTTNPVATEIYGVVSTDLERGNM

SEQ ID NO: 30908 - protein, 28 aa, Artificial Sequence
  Description of Artificial Sequence: Synthetic peptide
KEEEIRTTNIVATEQYGSVSTHLQYGEE

SEQ ID NO: 30909 - protein, 28 aa, Artificial Sequence
  Description of Artificial Sequence: Synthetic peptide
DEWEIRTTNPVATEQYGSVHEGDQRGND

SEQ ID NO: 30910 - protein, 28 aa, Artificial Sequence
  Description of Artificial Sequence: Synthetic peptide
TEEQIRGTNIVAYEQYGSVSTNLQRSNR

SEQ ID NO: 30911 - protein, 29 aa, Artificial Sequence
  Description of Artificial Sequence: Synthetic peptide
AETEIRTTNPVATEQYGWVSENLQRAGGR

SEQ ID NO: 30912 - protein, 28 aa, Artificial Sequence
  Description of Artificial Sequence: Synthetic peptide
DEEEIRTVNIVATQYYGSVSTNEQRGNK

SEQ ID NO: 30913 - protein, 28 aa, Artificial Sequence
  Description of Artificial Sequence: Synthetic peptide
GEEEIASTNPVATEMYGEVSTNLQRGGR

SEQ ID NO: 30914 - protein, 28 aa, Artificial Sequence
  Description of Artificial Sequence: Synthetic peptide
DETEIRTTNSVATEYYGWTSTNLQRGNN

SEQ ID NO: 30915 - protein, 31 aa, Artificial Sequence
  Description of Artificial Sequence: Synthetic polypeptide
DEEEIRPTNPVATEQYGSVDSTCDLQRGDER

SEQ ID NO: 30916 - protein, 31 aa, Artificial Sequence
  Description of Artificial Sequence: Synthetic polypeptide
DEEEIRTTNPDATEQYGSVASTGLVIREGNR

SEQ ID NO: 30917 - protein, 28 aa, Artificial Sequence
  Description of Artificial Sequence: Synthetic peptide
DDEEIRTTNIVATENYGSYSTCHQRGNR

SEQ ID NO: 30918 - protein, 28 aa, Artificial Sequence
  Description of Artificial Sequence: Synthetic peptide
DEEEIRTTNPTATEQYGEVSENEQNGNE

SEQ ID NO: 30919 - protein, 28 aa, Artificial Sequence
  Description of Artificial Sequence: Synthetic peptide
SEGEIATTNPTATEQYGSVSENLQRGNL

SEQ ID NO: 30920 - protein, 31 aa, Artificial Sequence
  Description of Artificial Sequence: Synthetic polypeptide
DEEEIRTVNPVATETFGSVSTNLQHRTGNDR

SEQ ID NO: 30921 - protein, 29 aa, Artificial Sequence
  Description of Artificial Sequence: Synthetic peptide
DEEEIRTTNPVATEQYGSVETEPDQRGEE

SEQ ID NO: 30922 - protein, 28 aa, Artificial Sequence
  Description of Artificial Sequence: Synthetic peptide
DEQEIATTNPVCTEQYGDVSENLQHGNR

SEQ ID NO: 30923 - protein, 28 aa, Artificial Sequence
  Description of Artificial Sequence: Synthetic peptide
DEEEITTTNPVATENYGAVADQLQRGNR

SEQ ID NO: 30924 - protein, 28 aa, Artificial Sequence
  Description of Artificial Sequence: Synthetic peptide
DELEIGTTNPVATEQYGDVSTNLQHENT

SEQ ID NO: 30925 - protein, 28 aa, Artificial Sequence
  Description of Artificial Sequence: Synthetic peptide
DEVEIRTTNPVATEQYGWVSSNWQSGNV

SEQ ID NO: 30926 - protein, 30 aa, Artificial Sequence
  Description of Artificial Sequence: Synthetic polypeptide
DENEIRATNPVGTEQYGSVSTDLQERKGNR

SEQ ID NO: 30927 - protein, 31 aa, Artificial Sequence
  Description of Artificial Sequence: Synthetic polypeptide
DEEEIRTTNPVATECYGSVSTELQEREGEDR

SEQ ID NO: 30928 - protein, 28 aa, Artificial Sequence
  Description of Artificial Sequence: Synthetic peptide
DEEEIRATNPVATEQFGVVSANWQNGNR

SEQ ID NO: 30929 - protein, 28 aa, Artificial Sequence
  Description of Artificial Sequence: Synthetic peptide
SEVEIATTNPVATEQYGEVPTNLQRENR

SEQ ID NO: 30930 - protein, 29 aa, Artificial Sequence
  Description of Artificial Sequence: Synthetic peptide
QEQEIATTNPVATEQYGDVSAENLQRGNR

SEQ ID NO: 30931 - protein, 31 aa, Artificial Sequence
  Description of Artificial Sequence: Synthetic polypeptide
DEEEIRTTNPVATERYGIVSTNLQDRAGFNS

SEQ ID NO: 30932 - protein, 28 aa, Artificial Sequence
  Description of Artificial Sequence: Synthetic peptide
DEEEIRTTNPVATEQYGYVSTADDFGNQ

SEQ ID NO: 30933 - protein, 30 aa, Artificial Sequence
  Description of Artificial Sequence: Synthetic polypeptide
SEVEIATTNPVATEQYGSVSENGLQREGNR

SEQ ID NO: 30934 - protein, 31 aa, Artificial Sequence
  Description of Artificial Sequence: Synthetic polypeptide
DEQEIRTTNPVATEQYGSVSTENLQEREGEF

SEQ ID NO: 30935 - protein, 28 aa, Artificial Sequence
  Description of Artificial Sequence: Synthetic peptide
DENEIRTTNPVATEQYGDVSENEMRGDR

SEQ ID NO: 30936 - protein, 28 aa, Artificial Sequence
  Description of Artificial Sequence: Synthetic peptide
DEEEIRTVNPVATEGYGEVSNLLQRGMR

SEQ ID NO: 30937 - protein, 28 aa, Artificial Sequence
  Description of Artificial Sequence: Synthetic peptide
DEQEIATTNPTATQQYGDVSTNLQRGNH

SEQ ID NO: 30938 - protein, 28 aa, Artificial Sequence
  Description of Artificial Sequence: Synthetic peptide
DEVEIRTTNPVATEQYGDVSEELQAGND

SEQ ID NO: 30939 - protein, 30 aa, Artificial Sequence
  Description of Artificial Sequence: Synthetic polypeptide
DEEEIRTTNPVATEQYGSQVCSTDLMTGNG

SEQ ID NO: 30940 - protein, 28 aa, Artificial Sequence
  Description of Artificial Sequence: Synthetic peptide
DEQEIATTNPVATEGYGSAATVLQRGNR

SEQ ID NO: 30941 - protein, 28 aa, Artificial Sequence
  Description of Artificial Sequence: Synthetic peptide
DEHEIRTTNPVATEQYGDVSEVVQRGNA

SEQ ID NO: 30942 - protein, 30 aa, Artificial Sequence
  Description of Artificial Sequence: Synthetic polypeptide
DEEEIMTTNPVATEQYGSVPSTNLQWKGEA

SEQ ID NO: 30943 - protein, 28 aa, Artificial Sequence
  Description of Artificial Sequence: Synthetic peptide
DEIEIRNTNAVAQEVYGSVSTDLQRGNR

SEQ ID NO: 30944 - protein, 28 aa, Artificial Sequence
  Description of Artificial Sequence: Synthetic peptide
DEEEIRTVNPVATEQYGSTSNVLQRGQM

SEQ ID NO: 30945 - protein, 28 aa, Artificial Sequence
  Description of Artificial Sequence: Synthetic peptide
DEEEVRATNPVATEQYGCVANNLQRGNQ

SEQ ID NO: 30946 - protein, 28 aa, Artificial Sequence
  Description of Artificial Sequence: Synthetic peptide
DEQEIRTTNPVATEQYGSVETPDDRGER

SEQ ID NO: 30947 - protein, 28 aa, Artificial Sequence
  Description of Artificial Sequence: Synthetic peptide
AEEEIRTTNPVATEVYGEVGTNLQHGQR

SEQ ID NO: 30948 - protein, 28 aa, Artificial Sequence
  Description of Artificial Sequence: Synthetic peptide
DENEIRTTNPVATEQWGSVDTNEQIGNM

SEQ ID NO: 30949 - protein, 28 aa, Artificial Sequence
  Description of Artificial Sequence: Synthetic peptide
DEQEIATVNPVATEVYGSVSEVLQRGNR

SEQ ID NO: 30950 - protein, 28 aa, Artificial Sequence
  Description of Artificial Sequence: Synthetic peptide
DEEEIATTNPTATEQYGSVSENEMRFNR

SEQ ID NO: 30951 - protein, 31 aa, Artificial Sequence
  Description of Artificial Sequence: Synthetic polypeptide
DENEIRTTNPVATEQYGSVSTNLQESEGNDF

SEQ ID NO: 30952 - protein, 30 aa, Artificial Sequence
  Description of Artificial Sequence: Synthetic polypeptide
DEEEIRTTNPVATEQYGSVSHGDTQRGLMR

SEQ ID NO: 30953 - protein, 28 aa, Artificial Sequence
  Description of Artificial Sequence: Synthetic peptide
DEVEIATTNPVATEIYGSVSTNEQRGDF

SEQ ID NO: 30954 - protein, 29 aa, Artificial Sequence
  Description of Artificial Sequence: Synthetic peptide
DENEIRTTNPVATEQYGVVSTDLQIAGNA

SEQ ID NO: 30955 - protein, 28 aa, Artificial Sequence
  Description of Artificial Sequence: Synthetic peptide
DENEIATTNPVATEQYGDASENLQRENR

SEQ ID NO: 30956 - protein, 30 aa, Artificial Sequence
  Description of Artificial Sequence: Synthetic polypeptide
DEEEIRTTNPTSTEQYGSASTNGLQRGNTS

SEQ ID NO: 30957 - protein, 28 aa, Artificial Sequence
  Description of Artificial Sequence: Synthetic peptide
DEEEIRTTNPVSTEQYGEISTNIQHGMR

SEQ ID NO: 30958 - protein, 28 aa, Artificial Sequence
  Description of Artificial Sequence: Synthetic peptide
DEEEIRITNIVATEQYGNVITNCQRGNA

SEQ ID NO: 30959 - protein, 28 aa, Artificial Sequence
  Description of Artificial Sequence: Synthetic peptide
DEEEIATTNPVSTEVYGEVSENLQRGGR

SEQ ID NO: 30960 - protein, 33 aa, Artificial Sequence
  Description of Artificial Sequence: Synthetic polypeptide
DEEEIRTTNPVATEQYGSVDSTPPLQIRGENPR

SEQ ID NO: 30961 - protein, 30 aa, Artificial Sequence
  Description of Artificial Sequence: Synthetic polypeptide
YEEEIRTTNPVATEVYGSVSTNWQERAGND

SEQ ID NO: 30962 - protein, 28 aa, Artificial Sequence
  Description of Artificial Sequence: Synthetic peptide
DEEESRTTNIVATEQYGVVSSNIQRGAR

SEQ ID NO: 30963 - protein, 28 aa, Artificial Sequence
  Description of Artificial Sequence: Synthetic peptide
DDEEIRATNPVATEMYGAVGNNLQRGNR

SEQ ID NO: 30964 - protein, 28 aa, Artificial Sequence
  Description of Artificial Sequence: Synthetic peptide
AEEEIAATNPVATENYGWVATNLQRGNR

SEQ ID NO: 30965 - protein, 29 aa, Artificial Sequence
  Description of Artificial Sequence: Synthetic peptide
DEEEIRTTNPAATETYGTVSVNPQRGVNR

SEQ ID NO: 30966 - protein, 28 aa, Artificial Sequence
  Description of Artificial Sequence: Synthetic peptide
SEEEIRTTNPVATEQYGTMSDNLQKDNR

SEQ ID NO: 30967 - protein, 28 aa, Artificial Sequence
  Description of Artificial Sequence: Synthetic peptide
DEEEIRTTNPVATEQYGDVAANWQRGTF

SEQ ID NO: 30968 - protein, 28 aa, Artificial Sequence
  Description of Artificial Sequence: Synthetic peptide
DEEEIRTTNPVATEQYGIASYNLMRGTQ

SEQ ID NO: 30969 - protein, 29 aa, Artificial Sequence
  Description of Artificial Sequence: Synthetic peptide
DENEIATTNPVATEQYGDVSENLQRAGNQ

SEQ ID NO: 30970 - protein, 31 aa, Artificial Sequence
  Description of Artificial Sequence: Synthetic polypeptide
DEQEIRTTNPVATEQYGSVDSTENPDQRGNF

SEQ ID NO: 30971 - protein, 29 aa, Artificial Sequence
  Description of Artificial Sequence: Synthetic peptide
DEVEISTTNPVATEQYGSVSATADQRGNF

SEQ ID NO: 30972 - protein, 28 aa, Artificial Sequence
  Description of Artificial Sequence: Synthetic peptide
DENEIRTTNPVATECYGSVSTDLQQGEM

SEQ ID NO: 30973 - protein, 28 aa, Artificial Sequence
  Description of Artificial Sequence: Synthetic peptide
DEEEISTTNPVATEVWGSVSDNEQQGNR

SEQ ID NO: 30974 - protein, 28 aa, Artificial Sequence
  Description of Artificial Sequence: Synthetic peptide
DEDEIRTTNPVSTEQWGQVSENLQRGNH

SEQ ID NO: 30975 - protein, 30 aa, Artificial Sequence
  Description of Artificial Sequence: Synthetic polypeptide
DEEEITTTNPVATEQYGSVSTGNPEIRGNF

SEQ ID NO: 30976 - protein, 28 aa, Artificial Sequence
  Description of Artificial Sequence: Synthetic peptide
DEDEIRTTNPVATEPYGEAATNVQRGNR

SEQ ID NO: 30977 - protein, 28 aa, Artificial Sequence
  Description of Artificial Sequence: Synthetic peptide
DEGEIECTNPVATEQYGTVSTNLQRGMM

SEQ ID NO: 30978 - protein, 28 aa, Artificial Sequence
  Description of Artificial Sequence: Synthetic peptide
DDEEIRATNPIAYEVYGCVSTNLQRGNR

SEQ ID NO: 30979 - protein, 28 aa, Artificial Sequence
  Description of Artificial Sequence: Synthetic peptide
DETEIGTVNPVATEGYGSVSENLQRGTR

SEQ ID NO: 30980 - protein, 28 aa, Artificial Sequence
  Description of Artificial Sequence: Synthetic peptide
DEGEIMTTNPVATEMYGSVSTNWQRGTI

SEQ ID NO: 30981 - protein, 28 aa, Artificial Sequence
  Description of Artificial Sequence: Synthetic peptide
DEQEISTTNPVATEIYGSVSDNQQRGNY

SEQ ID NO: 30982 - protein, 29 aa, Artificial Sequence
  Description of Artificial Sequence: Synthetic peptide
DEQEIRTTNPVATEQWGSVSENLMIQGNR

SEQ ID NO: 30983 - protein, 29 aa, Artificial Sequence
  Description of Artificial Sequence: Synthetic peptide
DEEEIRCTNPVATEQYGSVSTALPAIENR

SEQ ID NO: 30984 - protein, 28 aa, Artificial Sequence
  Description of Artificial Sequence: Synthetic peptide
DEEEIRTTNPVATEQYGSVETDDERGEE

SEQ ID NO: 30985 - protein, 28 aa, Artificial Sequence
  Description of Artificial Sequence: Synthetic peptide
NEQEIATTNPVATETYGWVSTNLQRGNQ

SEQ ID NO: 30986 - protein, 32 aa, Artificial Sequence
  Description of Artificial Sequence: Synthetic polypeptide
DEEEIRTTNPVATEQYGSVTSETNLTERGENP

SEQ ID NO: 30987 - protein, 30 aa, Artificial Sequence
  Description of Artificial Sequence: Synthetic polypeptide
DEEEIRTTNPVATEQYWGSVEETNLEHENR

SEQ ID NO: 30988 - protein, 28 aa, Artificial Sequence
  Description of Artificial Sequence: Synthetic peptide
DEIEIATTNPVAEEQYGSVSDNIQHGNR

SEQ ID NO: 30989 - protein, 28 aa, Artificial Sequence
  Description of Artificial Sequence: Synthetic peptide
DEEEIRTTNPVATEQYGSVDTEEDDGNS

SEQ ID NO: 30990 - protein, 32 aa, Artificial Sequence
  Description of Artificial Sequence: Synthetic polypeptide
DEEEIRTTNPVATEQYGSVSATNLQDDNGNDD

SEQ ID NO: 30991 - protein, 28 aa, Artificial Sequence
  Description of Artificial Sequence: Synthetic peptide
CEEEIKTTNPVATEGYGSVSDNLQRPNH

SEQ ID NO: 30992 - protein, 28 aa, Artificial Sequence
  Description of Artificial Sequence: Synthetic peptide
QEEEISTTNPVACEQYGDVSTNLQRPNW

SEQ ID NO: 30993 - protein, 28 aa, Artificial Sequence
  Description of Artificial Sequence: Synthetic peptide
DEEQIRTTNPVAYEQYWSVSTGLDPGNR

SEQ ID NO: 30994 - protein, 29 aa, Artificial Sequence
  Description of Artificial Sequence: Synthetic peptide
DENEIRTTNPVATEQYGSVSTEDENRGNT

SEQ ID NO: 30995 - protein, 28 aa, Artificial Sequence
  Description of Artificial Sequence: Synthetic peptide
KEEEIRTTNIVATEQYGSVSTNLEVGEA

SEQ ID NO: 30996 - protein, 28 aa, Artificial Sequence
  Description of Artificial Sequence: Synthetic peptide
DEQEIRTTNPVATECYGVVSTELQNGNS

SEQ ID NO: 30997 - protein, 28 aa, Artificial Sequence
  Description of Artificial Sequence: Synthetic peptide
DEVEIAATNPVATEQYGGVSENLQRGNF

SEQ ID NO: 30998 - protein, 31 aa, Artificial Sequence
  Description of Artificial Sequence: Synthetic polypeptide
DEEEIRTTNPVATEQYGSVSTNLEERGEEDS

SEQ ID NO: 30999 - protein, 30 aa, Artificial Sequence
  Description of Artificial Sequence: Synthetic polypeptide
DEEEIRTTNPVATEQYGSVSTNLEEVGEDI

SEQ ID NO: 31000 - protein, 29 aa, Artificial Sequence
  Description of Artificial Sequence: Synthetic peptide
DEEEIITTNPVATEQWGSVPAENLQRGNM

SEQ ID NO: 31001 - protein, 28 aa, Artificial Sequence
  Description of Artificial Sequence: Synthetic peptide
DEEEITNTNEVATEQYGSTRTHLQRGNR

SEQ ID NO: 31002 - protein, 30 aa, Artificial Sequence
  Description of Artificial Sequence: Synthetic polypeptide
DEVEIRATNPVATEQYGSVSMNLQERGNDC

SEQ ID NO: 31003 - protein, 28 aa, Artificial Sequence
  Description of Artificial Sequence: Synthetic peptide
DEEEIRTTNPVATECYGIYSTNDERGNW

SEQ ID NO: 31004 - protein, 32 aa, Artificial Sequence
  Description of Artificial Sequence: Synthetic polypeptide
DEEEIRTTNPVATEQYGSVSATNLQGKGENDG

SEQ ID NO: 31005 - protein, 28 aa, Artificial Sequence
  Description of Artificial Sequence: Synthetic peptide
QENEIATTNPVATEQYGSVSTELQNGNA

SEQ ID NO: 31006 - protein, 30 aa, Artificial Sequence
  Description of Artificial Sequence: Synthetic polypeptide
DEMEIRTTNPVATEHYGSVSTNLQDHGNDN

SEQ ID NO: 31007 - protein, 28 aa, Artificial Sequence
  Description of Artificial Sequence: Synthetic peptide
DEEEIRTTNPVATEQYGSVIENEQDENI

SEQ ID NO: 31008 - protein, 29 aa, Artificial Sequence
  Description of Artificial Sequence: Synthetic peptide
DEEEIATTNPTATEQYGSVSTMNPQHGNS

SEQ ID NO: 31009 - protein, 28 aa, Artificial Sequence
  Description of Artificial Sequence: Synthetic peptide
SEEEIATTNPVATEMFGSVSENLQRGTR

SEQ ID NO: 31010 - protein, 28 aa, Artificial Sequence
  Description of Artificial Sequence: Synthetic peptide
SEEEICTTNPTATEQYGSVSENLQRGTL

SEQ ID NO: 31011 - protein, 28 aa, Artificial Sequence
  Description of Artificial Sequence: Synthetic peptide
DEGEICTTNPAATEQFGSVSTNEQFGNR

SEQ ID NO: 31012 - protein, 28 aa, Artificial Sequence
  Description of Artificial Sequence: Synthetic peptide
DEEEIRTTNPCATEQYGSTGTNLEGGNI

SEQ ID NO: 31013 - protein, 29 aa, Artificial Sequence
  Description of Artificial Sequence: Synthetic peptide
DEGEISTTNPVATEQYGSVGENLQSRGER

SEQ ID NO: 31014 - protein, 28 aa, Artificial Sequence
  Description of Artificial Sequence: Synthetic peptide
DEDEIRTTNPVSTEHYGSVSTNLMHFNR

SEQ ID NO: 31015 - protein, 28 aa, Artificial Sequence
  Description of Artificial Sequence: Synthetic peptide
DEEEICATNPCATEQYGCVSTNLERENR

SEQ ID NO: 31016 - protein, 28 aa, Artificial Sequence
  Description of Artificial Sequence: Synthetic peptide
DENEIATTNPVATEQYGSVSTNLEVGEL

SEQ ID NO: 31017 - protein, 28 aa, Artificial Sequence
  Description of Artificial Sequence: Synthetic peptide
DEMEIATTNPVAVEQYGSVSENVQRGNM

SEQ ID NO: 31018 - protein, 28 aa, Artificial Sequence
  Description of Artificial Sequence: Synthetic peptide
SEEEIRTTNPVATEQYGSVSTGQQGGDN

SEQ ID NO: 31019 - protein, 28 aa, Artificial Sequence
  Description of Artificial Sequence: Synthetic peptide
DENEIRTTNPVATEQYGSVSEDLQTGDA

SEQ ID NO: 31020 - protein, 28 aa, Artificial Sequence
  Description of Artificial Sequence: Synthetic peptide
DESEIRTTNPTATECYGVVSENLQRGQR

SEQ ID NO: 31021 - protein, 28 aa, Artificial Sequence
  Description of Artificial Sequence: Synthetic peptide
DEEEIRTTNPVSTEVYGEASTNLQHGGR

SEQ ID NO: 31022 - protein, 29 aa, Artificial Sequence
  Description of Artificial Sequence: Synthetic peptide
DEEEIRTTNPVATEQYGSVACTTSQHGER

SEQ ID NO: 31023 - protein, 28 aa, Artificial Sequence
  Description of Artificial Sequence: Synthetic peptide
IEEEIRCTNPVATQQYGSVWTNDQRGNH

SEQ ID NO: 31024 - protein, 28 aa, Artificial Sequence
  Description of Artificial Sequence: Synthetic peptide
DEEEITTTNPVATEQYGTVSENLMTFNR

SEQ ID NO: 31025 - protein, 32 aa, Artificial Sequence
  Description of Artificial Sequence: Synthetic polypeptide
DEEEIRTTNPVATEPYGISVSTVNLQDRIKNR

SEQ ID NO: 31026 - protein, 28 aa, Artificial Sequence
  Description of Artificial Sequence: Synthetic peptide
SEDEIRTTNPVASEQYGTVSENLQTGNR

SEQ ID NO: 31027 - protein, 28 aa, Artificial Sequence
  Description of Artificial Sequence: Synthetic peptide
DEEEIRTTNPVATELWGSVSENDQIGNF

SEQ ID NO: 31028 - protein, 30 aa, Artificial Sequence
  Description of Artificial Sequence: Synthetic polypeptide
DEEEIRTTNPVATEQYGESVETDLDRGVDR

SEQ ID NO: 31029 - protein, 28 aa, Artificial Sequence
  Description of Artificial Sequence: Synthetic peptide
DEEEIRTTNPVATEHFGSVGTNLMRGTI

SEQ ID NO: 31030 - protein, 28 aa, Artificial Sequence
  Description of Artificial Sequence: Synthetic peptide
DEQEIACTNPVATEQYGEVSTVLQRGGR

SEQ ID NO: 31031 - protein, 28 aa, Artificial Sequence
  Description of Artificial Sequence: Synthetic peptide
DEGEIRATNPTATEQFGGVSTNLQRGDR

SEQ ID NO: 31032 - protein, 28 aa, Artificial Sequence
  Description of Artificial Sequence: Synthetic peptide
NEEEIKTTNIVSTEQYGSVSTNLQIGTR

SEQ ID NO: 31033 - protein, 28 aa, Artificial Sequence
  Description of Artificial Sequence: Synthetic peptide
DEEEISTTNPVATEQYGSVSENSMAMNR

SEQ ID NO: 31034 - protein, 30 aa, Artificial Sequence
  Description of Artificial Sequence: Synthetic polypeptide
DEHEIRTTNPVATEQYGDVSCTNLQCHGNA

SEQ ID NO: 31035 - protein, 28 aa, Artificial Sequence
  Description of Artificial Sequence: Synthetic peptide
DEEEIRTTNPVATEQYGFASTGLQHGME

SEQ ID NO: 31036 - protein, 28 aa, Artificial Sequence
  Description of Artificial Sequence: Synthetic peptide
NEEEIRATNPVATENYGSVATNLQRGTQ

SEQ ID NO: 31037 - protein, 28 aa, Artificial Sequence
  Description of Artificial Sequence: Synthetic peptide
DEMEIATTNPVATEQYGSVSYNHQLGND

SEQ ID NO: 31038 - protein, 28 aa, Artificial Sequence
  Description of Artificial Sequence: Synthetic peptide
DEEEIATTNPVATEVYGVVSEADQRGNR

SEQ ID NO: 31039 - protein, 30 aa, Artificial Sequence
  Description of Artificial Sequence: Synthetic polypeptide
DENEIATTNPVATEQYGSVSTNLEDRNGER

SEQ ID NO: 31040 - protein, 32 aa, Artificial Sequence
  Description of Artificial Sequence: Synthetic polypeptide
DEEEIRTTNPVATEQYGSVESTPGLQIYGENR

SEQ ID NO: 31041 - protein, 28 aa, Artificial Sequence
  Description of Artificial Sequence: Synthetic peptide
AETEIVTTNPVATETWGSVSDNLQRGNR

SEQ ID NO: 31042 - protein, 30 aa, Artificial Sequence
  Description of Artificial Sequence: Synthetic polypeptide
DQEEIRTTNPVATHQYGSVSTNGVQNGNHR

SEQ ID NO: 31043 - protein, 28 aa, Artificial Sequence
  Description of Artificial Sequence: Synthetic peptide
DESEIATTNPVATEGYGVVATNLQRGNI

SEQ ID NO: 31044 - protein, 28 aa, Artificial Sequence
  Description of Artificial Sequence: Synthetic peptide
DEDEIRTVNPVATEQYGVVADNLQRGNM

SEQ ID NO: 31045 - protein, 28 aa, Artificial Sequence
  Description of Artificial Sequence: Synthetic peptide
MENEIRTTNPVAVEQYGSVSENLQVGNN

SEQ ID NO: 31046 - protein, 28 aa, Artificial Sequence
  Description of Artificial Sequence: Synthetic peptide
NEEEIRTTNPVSSETYGSVATNLQRGNQ

SEQ ID NO: 31047 - protein, 31 aa, Artificial Sequence
  Description of Artificial Sequence: Synthetic polypeptide
DEEEIRTTNPVATEQYGSVSCTMDLQYGNDN

SEQ ID NO: 31048 - protein, 28 aa, Artificial Sequence
  Description of Artificial Sequence: Synthetic peptide
DEEEIRTTNPVATELYGSVATNEQNGDN

SEQ ID NO: 31049 - protein, 30 aa, Artificial Sequence
  Description of Artificial Sequence: Synthetic polypeptide
DEEEIRATNPVATEVYGSVSDTEPLQYGNR

SEQ ID NO: 31050 - protein, 28 aa, Artificial Sequence
  Description of Artificial Sequence: Synthetic peptide
AEEEISATNPVSTEQYGVVSTNLQRGGR

SEQ ID NO: 31051 - protein, 29 aa, Artificial Sequence
  Description of Artificial Sequence: Synthetic peptide
KEEEIRTTNPVATECYGSVSTNLQSEGEF

SEQ ID NO: 31052 - protein, 28 aa, Artificial Sequence
  Description of Artificial Sequence: Synthetic peptide
DEESIRATNPTATEQYGLVSTGLQRGNG

SEQ ID NO: 31053 - protein, 29 aa, Artificial Sequence
  Description of Artificial Sequence: Synthetic peptide
DEEEVRCTNPVATEIYGCVSTNLERNGNR

SEQ ID NO: 31054 - protein, 31 aa, Artificial Sequence
  Description of Artificial Sequence: Synthetic polypeptide
DEEEIRTTNPVATEQYGSVESTDPDQEHGNR

SEQ ID NO: 31055 - protein, 29 aa, Artificial Sequence
  Description of Artificial Sequence: Synthetic peptide
MEESIRTTNPVATEQYGSVSTNLQVLNLM

SEQ ID NO: 31056 - protein, 31 aa, Artificial Sequence
  Description of Artificial Sequence: Synthetic polypeptide
DEQEIATTNPVATEQYGSVSTNLCCRNGNDR

SEQ ID NO: 31057 - protein, 28 aa, Artificial Sequence
  Description of Artificial Sequence: Synthetic peptide
DEAEIATTNPVATEQAGEVSDNLQRGNL

SEQ ID NO: 31058 - protein, 28 aa, Artificial Sequence
  Description of Artificial Sequence: Synthetic peptide
DENEIATVNPVATEQYGEVSTLLQRGGR

SEQ ID NO: 31059 - protein, 28 aa, Artificial Sequence
  Description of Artificial Sequence: Synthetic peptide
DEEEIRATNPVAYEVYGSTSENLQRGNE

SEQ ID NO: 31060 - protein, 28 aa, Artificial Sequence
  Description of Artificial Sequence: Synthetic peptide
SEGEIRTVNPVATEQYGEVSENLQQGNR

SEQ ID NO: 31061 - protein, 29 aa, Artificial Sequence
  Description of Artificial Sequence: Synthetic peptide
DEEEIRTTNPVASEQYGSVSTDLQIVGEL

SEQ ID NO: 31062 - protein, 32 aa, Artificial Sequence
  Description of Artificial Sequence: Synthetic polypeptide
DEEEIMTTNPVATEQYGSVSCTNLQQVAGNDR

SEQ ID NO: 31063 - protein, 28 aa, Artificial Sequence
  Description of Artificial Sequence: Synthetic peptide
DEEEVRTTNPVAWEQYGCVDTNLQRGDV

SEQ ID NO: 31064 - protein, 32 aa, Artificial Sequence
  Description of Artificial Sequence: Synthetic polypeptide
DEEEIRTTNPVATEQYGSVSCNNLQTRNGNDE

SEQ ID NO: 31065 - protein, 29 aa, Artificial Sequence
  Description of Artificial Sequence: Synthetic peptide
DEEEIATTNPVSTEMYGEVSATNLQRGMR

SEQ ID NO: 31066 - protein, 31 aa, Artificial Sequence
  Description of Artificial Sequence: Synthetic polypeptide
DEEEIRTTNPVATEQYGSVSATDGLEREGND

SEQ ID NO: 31067 - protein, 30 aa, Artificial Sequence
  Description of Artificial Sequence: Synthetic polypeptide
DEEEIRTTNPVATECYGSVSTDLQENGNDI

SEQ ID NO: 31068 - protein, 28 aa, Artificial Sequence
  Description of Artificial Sequence: Synthetic peptide
VEQEIRTTNPVACEQYGSVSENLQLGNH

SEQ ID NO: 31069 - protein, 28 aa, Artificial Sequence
  Description of Artificial Sequence: Synthetic peptide
DEEEIRTTNPVATECYGSVSTDLEQGEQ

SEQ ID NO: 31070 - protein, 28 aa, Artificial Sequence
  Description of Artificial Sequence: Synthetic peptide
DEEEIRTTNIVATEHYGSVSANLQIMNT

SEQ ID NO: 31071 - protein, 30 aa, Artificial Sequence
  Description of Artificial Sequence: Synthetic polypeptide
DEEEIRCTNPVASEMYGAVSATNLQREGNR

SEQ ID NO: 31072 - protein, 28 aa, Artificial Sequence
  Description of Artificial Sequence: Synthetic peptide
DEEEIATVNPVATEQYGEVSENIQRGNL

SEQ ID NO: 31073 - protein, 30 aa, Artificial Sequence
  Description of Artificial Sequence: Synthetic polypeptide
DEQEIRTTNPVATEIYGCVSATNLERNGNR

SEQ ID NO: 31074 - protein, 31 aa, Artificial Sequence
  Description of Artificial Sequence: Synthetic polypeptide
DEEEIRTTNPVSTEWYGNVSTNLQRAGENDR

SEQ ID NO: 31075 - protein, 28 aa, Artificial Sequence
  Description of Artificial Sequence: Synthetic peptide
DEEEIATTNPTATEQFGSVSENLQQGTR

SEQ ID NO: 31076 - protein, 31 aa, Artificial Sequence
  Description of Artificial Sequence: Synthetic polypeptide
DEEEIRTTNPVATEQFGVVSTNWQLRGPNDR

SEQ ID NO: 31077 - protein, 28 aa, Artificial Sequence
  Description of Artificial Sequence: Synthetic peptide
DEEEIRTTNIVATCQYGSVSDNEGRGNS

SEQ ID NO: 31078 - protein, 30 aa, Artificial Sequence
  Description of Artificial Sequence: Synthetic polypeptide
DEEEIRTTNPVATEIYGCVAATNLEREGNR

SEQ ID NO: 31079 - protein, 32 aa, Artificial Sequence
  Description of Artificial Sequence: Synthetic polypeptide
DEEEIRTTNPVATEQYGSVSDTPNLQDNGDNP

SEQ ID NO: 31080 - protein, 32 aa, Artificial Sequence
  Description of Artificial Sequence: Synthetic polypeptide
DEEEIRTTNPVATEQYGHSVHQTNLQIRGENP

SEQ ID NO: 31081 - protein, 32 aa, Artificial Sequence
  Description of Artificial Sequence: Synthetic polypeptide
DEEEIRTTNPVATEQYGSVSTNNLTQNDGMNV

SEQ ID NO: 31082 - protein, 28 aa, Artificial Sequence
  Description of Artificial Sequence: Synthetic peptide
DEEEIRTTNPVSTEVYGTVSVNLQHGPR

SEQ ID NO: 31083 - protein, 30 aa, Artificial Sequence
  Description of Artificial Sequence: Synthetic polypeptide
MEEEIRTTNPVATEQYGSVSTDLQNEGNDS

SEQ ID NO: 31084 - protein, 28 aa, Artificial Sequence
  Description of Artificial Sequence: Synthetic peptide
DCEEIRTTNIVATEIYGDVSSNLQHGNR

SEQ ID NO: 31085 - protein, 32 aa, Artificial Sequence
  Description of Artificial Sequence: Synthetic polypeptide
DEEEIRTTNPVATEQYWSVSTPNPLQRGDEPR

SEQ ID NO: 31086 - protein, 28 aa, Artificial Sequence
  Description of Artificial Sequence: Synthetic peptide
DESEIRTVNPVATECYGSVSTNLQHGEM

SEQ ID NO: 31087 - protein, 31 aa, Artificial Sequence
  Description of Artificial Sequence: Synthetic polypeptide
DEEEIRTTNPVATEQYGSVSITCAPQEKGNR

SEQ ID NO: 31088 - protein, 28 aa, Artificial Sequence
  Description of Artificial Sequence: Synthetic peptide
DEEEIRTTNPVATEQYGSVDTPEQWENE

SEQ ID NO: 31089 - protein, 29 aa, Artificial Sequence
  Description of Artificial Sequence: Synthetic peptide
DEEEIRTTNPVATEQYGTVDSALQWGNDR

SEQ ID NO: 31090 - protein, 30 aa, Artificial Sequence
  Description of Artificial Sequence: Synthetic polypeptide
DEQEIRTTNPVATEIYGCVDATNLQREGNR

SEQ ID NO: 31091 - protein, 29 aa, Artificial Sequence
  Description of Artificial Sequence: Synthetic peptide
MEQEIRTTNPVATEQYGWVSTDLQELGNR

SEQ ID NO: 31092 - protein, 28 aa, Artificial Sequence
  Description of Artificial Sequence: Synthetic peptide
DEQEIRTTNPEATEQYGSVETNLDPGNQ

SEQ ID NO: 31093 - protein, 31 aa, Artificial Sequence
  Description of Artificial Sequence: Synthetic polypeptide
DEEEIRTTNPVATEQYGSVSCTEDLEERGNE

SEQ ID NO: 31094 - protein, 28 aa, Artificial Sequence
  Description of Artificial Sequence: Synthetic peptide
QENEIRTTNPVSTEGYGSVSTNLQRGEK

SEQ ID NO: 31095 - protein, 28 aa, Artificial Sequence
  Description of Artificial Sequence: Synthetic peptide
DEGEIATTNPVATEQYGEVSTNLIQGNQ

SEQ ID NO: 31096 - protein, 28 aa, Artificial Sequence
  Description of Artificial Sequence: Synthetic peptide
DENEICTTNPVATEQYGDTSTNLQYGNA

SEQ ID NO: 31097 - protein, 28 aa, Artificial Sequence
  Description of Artificial Sequence: Synthetic peptide
VEEEITTTNPVATEQYGVVGSNLQRGNQ

SEQ ID NO: 31098 - protein, 28 aa, Artificial Sequence
  Description of Artificial Sequence: Synthetic peptide
DETEIATTNPVSSEQYGAVSTNLQRGNQ

SEQ ID NO: 31099 - protein, 29 aa, Artificial Sequence
  Description of Artificial Sequence: Synthetic peptide
DEEEIRTTNPVATEQYGDVSEANLQHGPI

SEQ ID NO: 31100 - protein, 28 aa, Artificial Sequence
  Description of Artificial Sequence: Synthetic peptide
NEEEINGTNPVATEQYGCVSENLQRGNM

SEQ ID NO: 31101 - protein, 32 aa, Artificial Sequence
  Description of Artificial Sequence: Synthetic polypeptide
DEEEIRTTNPEATEQYGSVISTENEQRGINTR

SEQ ID NO: 31102 - protein, 28 aa, Artificial Sequence
  Description of Artificial Sequence: Synthetic peptide
DEDELASTNPCATEQYGQVSTNLQRGNR

SEQ ID NO: 31103 - protein, 31 aa, Artificial Sequence
  Description of Artificial Sequence: Synthetic polypeptide
DEEEIRTTNPVATEQYGSVESATELQHGDNH

SEQ ID NO: 31104 - protein, 28 aa, Artificial Sequence
  Description of Artificial Sequence: Synthetic peptide
MEEEINTTNPVATEQYGECSTNLQFGNK

SEQ ID NO: 31105 - protein, 29 aa, Artificial Sequence
  Description of Artificial Sequence: Synthetic peptide
DENEIRTTNPVATEQYGSVSENEMMRGNF

SEQ ID NO: 31106 - protein, 28 aa, Artificial Sequence
  Description of Artificial Sequence: Synthetic peptide
DEQEIATTNPVATEQYGDVSEDLQHGNR

SEQ ID NO: 31107 - protein, 28 aa, Artificial Sequence
  Description of Artificial Sequence: Synthetic peptide
DEEEIRTTNIVATNQYGSVITNLQNGQD

SEQ ID NO: 31108 - protein, 28 aa, Artificial Sequence
  Description of Artificial Sequence: Synthetic peptide
QEEEIRTTNPVACEVYGSVGTNWQRGNH

SEQ ID NO: 31109 - protein, 33 aa, Artificial Sequence
  Description of Artificial Sequence: Synthetic polypeptide
DEEEIRTTNPVATEQYGSVDSETNLQDRGDNDW

SEQ ID NO: 31110 - protein, 31 aa, Artificial Sequence
  Description of Artificial Sequence: Synthetic polypeptide
DEEEIRTTNPVATEQYGSVSTEPLVQDVGDR

SEQ ID NO: 31111 - protein, 29 aa, Artificial Sequence
  Description of Artificial Sequence: Synthetic peptide
DEVEIRTTNPVATEHFGSVSENLQLRGNF

SEQ ID NO: 31112 - protein, 32 aa, Artificial Sequence
  Description of Artificial Sequence: Synthetic polypeptide
DEEEIRTTNPVATEQYGSVSCTMDLQCGGNDR

SEQ ID NO: 31113 - protein, 31 aa, Artificial Sequence
  Description of Artificial Sequence: Synthetic polypeptide
DEHEITTTNPCATEQYGSVSTMNLQRFGNDR

SEQ ID NO: 31114 - protein, 28 aa, Artificial Sequence
  Description of Artificial Sequence: Synthetic peptide
DEEEIATTNPVATEGYGSVSENQQVGTR

SEQ ID NO: 31115 - protein, 29 aa, Artificial Sequence
  Description of Artificial Sequence: Synthetic peptide
DAEEIRTTNPVATEQYGSVSHEVLQRGGI

SEQ ID NO: 31116 - protein, 28 aa, Artificial Sequence
  Description of Artificial Sequence: Synthetic peptide
VEEEIRTTNPVATEQYGVMSTNLEAGER

SEQ ID NO: 31117 - protein, 31 aa, Artificial Sequence
  Description of Artificial Sequence: Synthetic polypeptide
DEEEIRTTNPVATEQYGVVSETELQSKGENR

SEQ ID NO: 31118 - protein, 30 aa, Artificial Sequence
  Description of Artificial Sequence: Synthetic polypeptide
DEEQIRTTNPVATEIYGSVSTGLQLREGNP

SEQ ID NO: 31119 - protein, 28 aa, Artificial Sequence
  Description of Artificial Sequence: Synthetic peptide
DEEEIRTTNPVATEQYGSVFENDCHGNC

SEQ ID NO: 31120 - protein, 28 aa, Artificial Sequence
  Description of Artificial Sequence: Synthetic peptide
DEEEINSTNPVATEQYGNCSTVLQRGQR

SEQ ID NO: 31121 - protein, 28 aa, Artificial Sequence
  Description of Artificial Sequence: Synthetic peptide
DEMEIATTNPVATEIYGSTSTTLQRLNR

SEQ ID NO: 31122 - protein, 28 aa, Artificial Sequence
  Description of Artificial Sequence: Synthetic peptide
DEQEIATTNPVATECYGSVSTDLERGNL

SEQ ID NO: 31123 - protein, 29 aa, Artificial Sequence
  Description of Artificial Sequence: Synthetic peptide
DEEEIATTNPVATEQYGDVGENLQCRGNM

SEQ ID NO: 31124 - protein, 28 aa, Artificial Sequence
  Description of Artificial Sequence: Synthetic peptide
MEQEIRTTNPVATEQYGSVSDNLQHGEF

SEQ ID NO: 31125 - protein, 28 aa, Artificial Sequence
  Description of Artificial Sequence: Synthetic peptide
DENEIATTNIVATEQFGDVSTNLQRGGR

SEQ ID NO: 31126 - protein, 28 aa, Artificial Sequence
  Description of Artificial Sequence: Synthetic peptide
SEEEIRTTNPFATALYGSVSTGEQRGNR

SEQ ID NO: 31127 - protein, 28 aa, Artificial Sequence
  Description of Artificial Sequence: Synthetic peptide
AEEELRTTNPVATEAYGSASTNWQRGNQ

SEQ ID NO: 31128 - protein, 32 aa, Artificial Sequence
  Description of Artificial Sequence: Synthetic polypeptide
DEEEIRTTNPVATEQYGSVSCTMDLQCRGNDL

SEQ ID NO: 31129 - protein, 28 aa, Artificial Sequence
  Description of Artificial Sequence: Synthetic peptide
DEVEIATTNPVATECYGTVSTDLQHGNR

SEQ ID NO: 31130 - protein, 28 aa, Artificial Sequence
  Description of Artificial Sequence: Synthetic peptide
DEEEIRTTNPVATEQYGIVSEALQPLNF

SEQ ID NO: 31131 - protein, 28 aa, Artificial Sequence
  Description of Artificial Sequence: Synthetic peptide
AEHEIISTNPVATEQYGDVATNLQRGNR

SEQ ID NO: 31132 - protein, 28 aa, Artificial Sequence
  Description of Artificial Sequence: Synthetic peptide
DEQEIATTNPVATEQYGDVSTDLQHGNA

SEQ ID NO: 31133 - protein, 28 aa, Artificial Sequence
  Description of Artificial Sequence: Synthetic peptide
AEEEIVSTNPVATEGYGSASTNLQHGNR

SEQ ID NO: 31134 - protein, 31 aa, Artificial Sequence
  Description of Artificial Sequence: Synthetic polypeptide
SEEEIRTTNPVATECFGSVISTNLQRGINDR

SEQ ID NO: 31135 - protein, 29 aa, Artificial Sequence
  Description of Artificial Sequence: Synthetic peptide
DEVEIAATNPTATEQFGSVSTNLQREGNR

SEQ ID NO: 31136 - protein, 28 aa, Artificial Sequence
  Description of Artificial Sequence: Synthetic peptide
DETEIRATNPVATEHWGSVSTNLQRGML

SEQ ID NO: 31137 - protein, 28 aa, Artificial Sequence
  Description of Artificial Sequence: Synthetic peptide
DEEEIRATNPTATECYGSVNTNLCRENR

SEQ ID NO: 31138 - protein, 28 aa, Artificial Sequence
  Description of Artificial Sequence: Synthetic peptide
SEEEIRTTNPEATEQYGTVSDNVQRGTR

SEQ ID NO: 31139 - protein, 29 aa, Artificial Sequence
  Description of Artificial Sequence: Synthetic peptide
DEEEIRTTNPVATEWYGSVDTNLQWLGTS

SEQ ID NO: 31140 - protein, 32 aa, Artificial Sequence
  Description of Artificial Sequence: Synthetic polypeptide
DEEEIRTTNPVATEQYGSVSDTTNLQIVEGNE

SEQ ID NO: 31141 - protein, 28 aa, Artificial Sequence
  Description of Artificial Sequence: Synthetic peptide
DDDEIRCTNPVAVEQYGSVSTDLQGGNR

SEQ ID NO: 31142 - protein, 31 aa, Artificial Sequence
  Description of Artificial Sequence: Synthetic polypeptide
DEEEIRTTNPVATEQYGSVSTCPPVQRKGNA

SEQ ID NO: 31143 - protein, 28 aa, Artificial Sequence
  Description of Artificial Sequence: Synthetic peptide
DETEIRTTNPAATEHYGSVATNLQGGTR

SEQ ID NO: 31144 - protein, 28 aa, Artificial Sequence
  Description of Artificial Sequence: Synthetic peptide
DEEMIRTTNPVATEQYGCVETNGQPPNR

SEQ ID NO: 31145 - protein, 29 aa, Artificial Sequence
  Description of Artificial Sequence: Synthetic peptide
SEEEIRTTNPVATEQFGSVSTNLQEIGTE

SEQ ID NO: 31146 - protein, 30 aa, Artificial Sequence
  Description of Artificial Sequence: Synthetic polypeptide
SDEEIRTTNPVSTEQYGSVSTNLQVNGNDR

SEQ ID NO: 31147 - protein, 28 aa, Artificial Sequence
  Description of Artificial Sequence: Synthetic peptide
NEEEIRPTNPVATEQFGSVSTNLDRPIR

SEQ ID NO: 31148 - protein, 30 aa, Artificial Sequence
  Description of Artificial Sequence: Synthetic polypeptide
DEEEIRTTNPVAYWQYGSVDCTNLLMRGNR

SEQ ID NO: 31149 - protein, 30 aa, Artificial Sequence
  Description of Artificial Sequence: Synthetic polypeptide
DEEEIRTTNPIATEQYGSVATNLQMRKELR

SEQ ID NO: 31150 - protein, 28 aa, Artificial Sequence
  Description of Artificial Sequence: Synthetic peptide
DEEEIRTTNPEATEQYGSVSTDDEHGNQ

SEQ ID NO: 31151 - protein, 28 aa, Artificial Sequence
  Description of Artificial Sequence: Synthetic peptide
DEEEIRTTNCVATEQWGSVSTNIETGQR

SEQ ID NO: 31152 - protein, 30 aa, Artificial Sequence
  Description of Artificial Sequence: Synthetic polypeptide
DEQEIRTTNPVATEQYGSVSTDLQDHEGER

SEQ ID NO: 31153 - protein, 29 aa, Artificial Sequence
  Description of Artificial Sequence: Synthetic peptide
DEMEITCTNPVSTEQYGSVSTNLQHAGNR

SEQ ID NO: 31154 - protein, 30 aa, Artificial Sequence
  Description of Artificial Sequence: Synthetic polypeptide
DEEEIVTTNPVATEQYGSVSTELQEANGDR

SEQ ID NO: 31155 - protein, 28 aa, Artificial Sequence
  Description of Artificial Sequence: Synthetic peptide
SEEEIRTTNPVATEQYGSVSENPQVGTF

SEQ ID NO: 31156 - protein, 28 aa, Artificial Sequence
  Description of Artificial Sequence: Synthetic peptide
DEEEIRTTNPFASEQYGAVSTNLMPGNI

SEQ ID NO: 31157 - protein, 28 aa, Artificial Sequence
  Description of Artificial Sequence: Synthetic peptide
DEEEIRTTNPVATEQYGSVDEGPNRGDR

SEQ ID NO: 31158 - protein, 28 aa, Artificial Sequence
  Description of Artificial Sequence: Synthetic peptide
DEDEICCTNPVATEQFGSVSTNWQQGNR

SEQ ID NO: 31159 - protein, 28 aa, Artificial Sequence
  Description of Artificial Sequence: Synthetic peptide
DEEEIRTTNIFATEQYGSVETDLQRGEI

SEQ ID NO: 31160 - protein, 28 aa, Artificial Sequence
  Description of Artificial Sequence: Synthetic peptide
DEEEIVTTNPVATEMYGEVSTVLQHGQR

SEQ ID NO: 31161 - protein, 28 aa, Artificial Sequence
  Description of Artificial Sequence: Synthetic peptide
SEEEIRTTNPVCTEQYGGVSADLQRGDR

SEQ ID NO: 31162 - protein, 28 aa, Artificial Sequence
  Description of Artificial Sequence: Synthetic peptide
KEEEIRTTNPVATEQYGSVSENLQHEEM

SEQ ID NO: 31163 - protein, 28 aa, Artificial Sequence
  Description of Artificial Sequence: Synthetic peptide
DDEEIRTTNPIAYEWYGSVATNLERGNR

SEQ ID NO: 31164 - protein, 28 aa, Artificial Sequence
  Description of Artificial Sequence: Synthetic peptide
DEAEIMTTNPVATEQYGEVADNLQAGNR

SEQ ID NO: 31165 - protein, 28 aa, Artificial Sequence
  Description of Artificial Sequence: Synthetic peptide
DEQEIACTNPVSTEVYGSVSTNLQRGGR

SEQ ID NO: 31166 - protein, 28 aa, Artificial Sequence
  Description of Artificial Sequence: Synthetic peptide
DEQEIVTTNPVATELYGCVSTNLQRGTQ

SEQ ID NO: 31167 - protein, 30 aa, Artificial Sequence
  Description of Artificial Sequence: Synthetic polypeptide
DEQEIRTTNPVATEQYGSVSTELQEREGEM

SEQ ID NO: 31168 - protein, 28 aa, Artificial Sequence
  Description of Artificial Sequence: Synthetic peptide
DEEEIRTTNPVATEQYGTTSTELETGNI

SEQ ID NO: 31169 - protein, 29 aa, Artificial Sequence
  Description of Artificial Sequence: Synthetic peptide
DEQEIRCTNPVATEIYGCVATNLQRNGNR

SEQ ID NO: 31170 - protein, 32 aa, Artificial Sequence
  Description of Artificial Sequence: Synthetic polypeptide
DEEEIRTTNPVATEQYGSWVSTFNGLQDNGNV

SEQ ID NO: 31171 - protein, 30 aa, Artificial Sequence
  Description of Artificial Sequence: Synthetic polypeptide
DENEIRTTNPVATECYGSVSTDLQDTEGNR

SEQ ID NO: 31172 - protein, 28 aa, Artificial Sequence
  Description of Artificial Sequence: Synthetic peptide
DEEEIRATNPVATEQYGDYSENLQQGDR

SEQ ID NO: 31173 - protein, 28 aa, Artificial Sequence
  Description of Artificial Sequence: Synthetic peptide
DEEEVATTNIDACEQYGSVSTNLQRGNT

SEQ ID NO: 31174 - protein, 28 aa, Artificial Sequence
  Description of Artificial Sequence: Synthetic peptide
SEDEIVTTNPVATQQYGSVSTNLQNGPR

SEQ ID NO: 31175 - protein, 30 aa, Artificial Sequence
  Description of Artificial Sequence: Synthetic polypeptide
DEQEIRCTNPVATEQYGSVSENDQNRGNDR

SEQ ID NO: 31176 - protein, 28 aa, Artificial Sequence
  Description of Artificial Sequence: Synthetic peptide
KEEEIRATNPVATECYGSVSTELQRGEH

SEQ ID NO: 31177 - protein, 28 aa, Artificial Sequence
  Description of Artificial Sequence: Synthetic peptide
GEEEITTTNPVATEQYGSVSTELQDGEP

SEQ ID NO: 31178 - protein, 31 aa, Artificial Sequence
  Description of Artificial Sequence: Synthetic polypeptide
DEEEIRTCNPVATEQYGSVSTIVLQERGDNS

SEQ ID NO: 31179 - protein, 28 aa, Artificial Sequence
  Description of Artificial Sequence: Synthetic peptide
DEEEIRTTNPVSTEWYGSVSDNEMQGNR

SEQ ID NO: 31180 - protein, 28 aa, Artificial Sequence
  Description of Artificial Sequence: Synthetic peptide
KEEEIATTNPVATECYGDVSTDEQRGNR

SEQ ID NO: 31181 - protein, 28 aa, Artificial Sequence
  Description of Artificial Sequence: Synthetic peptide
DEEEIRTTNPVATEQYWSWEHPDQRGNR

SEQ ID NO: 31182 - protein, 28 aa, Artificial Sequence
  Description of Artificial Sequence: Synthetic peptide
KEEEIATTNPVATECYGVVSEDLQRGNR

SEQ ID NO: 31183 - protein, 31 aa, Artificial Sequence
  Description of Artificial Sequence: Synthetic polypeptide
DEEEIRTTNPVATEQYGVVSTENLQRGDEDH

SEQ ID NO: 31184 - protein, 28 aa, Artificial Sequence
  Description of Artificial Sequence: Synthetic peptide
DEEEIATTNPVATEVYGDVSTNLMHMNR

SEQ ID NO: 31185 - protein, 28 aa, Artificial Sequence
  Description of Artificial Sequence: Synthetic peptide
DEQEIRTTNPVATEQYGSVSENLMRMQQ

SEQ ID NO: 31186 - protein, 28 aa, Artificial Sequence
  Description of Artificial Sequence: Synthetic peptide
DEEEIRTTNPVATEVYGSVSENIMAGVR

SEQ ID NO: 31187 - protein, 28 aa, Artificial Sequence
  Description of Artificial Sequence: Synthetic peptide
NEEELRTTNPVAYELYGAVATNLQRGNR

SEQ ID NO: 31188 - protein, 28 aa, Artificial Sequence
  Description of Artificial Sequence: Synthetic peptide
QEEEIRQTNPVATEQYGEVSEVLQHGNR

SEQ ID NO: 31189 - protein, 28 aa, Artificial Sequence
  Description of Artificial Sequence: Synthetic peptide
DEGVIRTTNPVATETYGNVSTNLQLLNR

SEQ ID NO: 31190 - protein, 32 aa, Artificial Sequence
  Description of Artificial Sequence: Synthetic polypeptide
DEEEIRTTNPVATEQYGVVSTTNGLELRGNDR

SEQ ID NO: 31191 - protein, 30 aa, Artificial Sequence
  Description of Artificial Sequence: Synthetic polypeptide
DENEIRTVNPVATECYGSVSTNLQYEGNDR

SEQ ID NO: 31192 - protein, 30 aa, Artificial Sequence
  Description of Artificial Sequence: Synthetic polypeptide
DENEIATTNPVATECYGSVSTDLQIREGNR

SEQ ID NO: 31193 - protein, 28 aa, Artificial Sequence
  Description of Artificial Sequence: Synthetic peptide
QEQEIRTTNPVATEQYGVVSTELQPGNL

SEQ ID NO: 31194 - protein, 30 aa, Artificial Sequence
  Description of Artificial Sequence: Synthetic polypeptide
DEQEIRTTNPEATEQYGSVSTELQHGENDR

SEQ ID NO: 31195 - protein, 29 aa, Artificial Sequence
  Description of Artificial Sequence: Synthetic peptide
DEEEIRTTNPVATEQYGFVGDNEQRALNR

SEQ ID NO: 31196 - protein, 31 aa, Artificial Sequence
  Description of Artificial Sequence: Synthetic polypeptide
DEEEIRTTNPVATEQYGSVDSTIDLQQKGNQ

SEQ ID NO: 31197 - protein, 29 aa, Artificial Sequence
  Description of Artificial Sequence: Synthetic peptide
DEDEIRTTNPVATEQYGIVSDNLQRAGMM

SEQ ID NO: 31198 - protein, 28 aa, Artificial Sequence
  Description of Artificial Sequence: Synthetic peptide
SEEEIATTNPVATECYGVVSTNLQRGTF

SEQ ID NO: 31199 - protein, 31 aa, Artificial Sequence
  Description of Artificial Sequence: Synthetic polypeptide
DEEEIRTTNPVATECYGSVSETENLQDPGER

SEQ ID NO: 31200 - protein, 29 aa, Artificial Sequence
  Description of Artificial Sequence: Synthetic peptide
DEEEIAATNPVAHFQYGSVSTNLQRLENR

SEQ ID NO: 31201 - protein, 28 aa, Artificial Sequence
  Description of Artificial Sequence: Synthetic peptide
AEEEIRGTNPVATETYGSVSCNLQRGGI

SEQ ID NO: 31202 - protein, 28 aa, Artificial Sequence
  Description of Artificial Sequence: Synthetic peptide
DDEEIRATNPVAYEIYGSVAMNLQRGNR

SEQ ID NO: 31203 - protein, 29 aa, Artificial Sequence
  Description of Artificial Sequence: Synthetic peptide
DEEEIRTTNPVATEQWGSVSENEMMRGNA

SEQ ID NO: 31204 - protein, 28 aa, Artificial Sequence
  Description of Artificial Sequence: Synthetic peptide
SEEEIRTTNPTATEQYGSVSTNEQNGTL

SEQ ID NO: 31205 - protein, 28 aa, Artificial Sequence
  Description of Artificial Sequence: Synthetic peptide
DEEEIRTTNPVGCEQYGSVSTELQQGEM

SEQ ID NO: 31206 - protein, 28 aa, Artificial Sequence
  Description of Artificial Sequence: Synthetic peptide
NEEEIRCTNPVGTEQYGDVSTNVQRGNA

SEQ ID NO: 31207 - protein, 28 aa, Artificial Sequence
  Description of Artificial Sequence: Synthetic peptide
DEEEIRTTNPVATEQYGEVSEVCQHENR

SEQ ID NO: 31208 - protein, 32 aa, Artificial Sequence
  Description of Artificial Sequence: Synthetic polypeptide
DEEEIRTTNPVATEQYGSVSTTTNLELINGNR

SEQ ID NO: 31209 - protein, 29 aa, Artificial Sequence
  Description of Artificial Sequence: Synthetic peptide
DENEIATTNPVATECYGSVSTNLQRGEDE

SEQ ID NO: 31210 - protein, 28 aa, Artificial Sequence
  Description of Artificial Sequence: Synthetic peptide
MEEEIACTNPVATEQYGSVSNVLQRGGR

SEQ ID NO: 31211 - protein, 29 aa, Artificial Sequence
  Description of Artificial Sequence: Synthetic peptide
DEEEIRTTNPVSTEPYGSVSTDLQDVGNG

SEQ ID NO: 31212 - protein, 28 aa, Artificial Sequence
  Description of Artificial Sequence: Synthetic peptide
DEHEIRTTNPVATEIYGSVSTDDLRGNQ

SEQ ID NO: 31213 - protein, 31 aa, Artificial Sequence
  Description of Artificial Sequence: Synthetic polypeptide
DEEEIRTTNPVATEQYGSVSTNLESNGENDV

SEQ ID NO: 31214 - protein, 30 aa, Artificial Sequence
  Description of Artificial Sequence: Synthetic polypeptide
DEQEIRTTNPVASEIYGAVSATNLQREGNR

SEQ ID NO: 31215 - protein, 28 aa, Artificial Sequence
  Description of Artificial Sequence: Synthetic peptide
SEEEIRATNPVATEQFGSVSENEQRGNF

SEQ ID NO: 31216 - protein, 28 aa, Artificial Sequence
  Description of Artificial Sequence: Synthetic peptide
DEDEIRTVNPVATETYGSVSTNGQLGNS

SEQ ID NO: 31217 - protein, 28 aa, Artificial Sequence
  Description of Artificial Sequence: Synthetic peptide
DEEEIRTTNPDATEQYGSVSTCEQEGED

SEQ ID NO: 31218 - protein, 30 aa, Artificial Sequence
  Description of Artificial Sequence: Synthetic polypeptide
DEEEIRTTNPVATETYGLVSTNLQISGNDV

SEQ ID NO: 31219 - protein, 28 aa, Artificial Sequence
  Description of Artificial Sequence: Synthetic peptide
SEEEIRHTNPVATEQYGSVSENVQEYNR

SEQ ID NO: 31220 - protein, 28 aa, Artificial Sequence
  Description of Artificial Sequence: Synthetic peptide
SEEEIRTTNPVATEMYGSVSENLQQGTF

SEQ ID NO: 31221 - protein, 28 aa, Artificial Sequence
  Description of Artificial Sequence: Synthetic peptide
GEEEIATTNPVATENYGSVSTCLTRGND

SEQ ID NO: 31222 - protein, 28 aa, Artificial Sequence
  Description of Artificial Sequence: Synthetic peptide
HEEEIVTTNPVATEHYGSVSENLQNGNY

SEQ ID NO: 31223 - protein, 28 aa, Artificial Sequence
  Description of Artificial Sequence: Synthetic peptide
DEQEIRTTNPCATEQYGCVATNLQRPND

SEQ ID NO: 31224 - protein, 28 aa, Artificial Sequence
  Description of Artificial Sequence: Synthetic peptide
DEEEISATNPVATEQYGSVDTELQRGEF

SEQ ID NO: 31225 - protein, 31 aa, Artificial Sequence
  Description of Artificial Sequence: Synthetic polypeptide
DEEEIRTTNPVATECYGSVSATNLQRNGEDL

SEQ ID NO: 31226 - protein, 28 aa, Artificial Sequence
  Description of Artificial Sequence: Synthetic peptide
DEEEISTTNPVCTEPYGWVSDNLQSGNR

SEQ ID NO: 31227 - protein, 30 aa, Artificial Sequence
  Description of Artificial Sequence: Synthetic polypeptide
DEEEIVTTNPVATEQYGWVSTEIQQQRGNR

SEQ ID NO: 31228 - protein, 29 aa, Artificial Sequence
  Description of Artificial Sequence: Synthetic peptide
DDEEIKPTNPVATEQWGSVSDTNLQRGTR

SEQ ID NO: 31229 - protein, 28 aa, Artificial Sequence
  Description of Artificial Sequence: Synthetic peptide
DEEEIRTTNPYATEQYGSVHTGEIRGNP

SEQ ID NO: 31230 - protein, 28 aa, Artificial Sequence
  Description of Artificial Sequence: Synthetic peptide
DEGEIRTTNPTATEQYGCVSTNLQSGTN

SEQ ID NO: 31231 - protein, 28 aa, Artificial Sequence
  Description of Artificial Sequence: Synthetic peptide
NEHEISTTNPVATEQYGVVSENLQRGNN

SEQ ID NO: 31232 - protein, 30 aa, Artificial Sequence
  Description of Artificial Sequence: Synthetic polypeptide
DEEEIRCTNPVATEQFGSVSANLQEVGINR

SEQ ID NO: 31233 - protein, 28 aa, Artificial Sequence
  Description of Artificial Sequence: Synthetic peptide
MENEIRTTNPVATEQYGSVSTDLQGGEL

SEQ ID NO: 31234 - protein, 28 aa, Artificial Sequence
  Description of Artificial Sequence: Synthetic peptide
DEQEINTTNIVATEQYGSVSTNLQISTR

SEQ ID NO: 31235 - protein, 28 aa, Artificial Sequence
  Description of Artificial Sequence: Synthetic peptide
DEEEIRGTNPVATEQYGDVSTLLSHGND

SEQ ID NO: 31236 - protein, 28 aa, Artificial Sequence
  Description of Artificial Sequence: Synthetic peptide
MEEEIATTNPVATEQYGDVSTELQRENN

SEQ ID NO: 31237 - protein, 28 aa, Artificial Sequence
  Description of Artificial Sequence: Synthetic peptide
DEEEIATVNPVSTECYGTVGTNLQRGNR

SEQ ID NO: 31238 - protein, 29 aa, Artificial Sequence
  Description of Artificial Sequence: Synthetic peptide
GEEEIRATNPVATEMYGSVSTNLQFEGER

SEQ ID NO: 31239 - protein, 30 aa, Artificial Sequence
  Description of Artificial Sequence: Synthetic polypeptide
DEEEIRATNPVATEQYGSVSTGNSKQRGQN

SEQ ID NO: 31240 - protein, 31 aa, Artificial Sequence
  Description of Artificial Sequence: Synthetic polypeptide
DEQEIRTTNPVATEQYGSVSCEMNLQQGNDR

SEQ ID NO: 31241 - protein, 31 aa, Artificial Sequence
  Description of Artificial Sequence: Synthetic polypeptide
DEEEIATTNPVATEQYGSVSTNLQEVKGEDR

SEQ ID NO: 31242 - protein, 28 aa, Artificial Sequence
  Description of Artificial Sequence: Synthetic peptide
KEEEIRTVNPVATEQYGVVSTDLQIGDR

SEQ ID NO: 31243 - protein, 30 aa, Artificial Sequence
  Description of Artificial Sequence: Synthetic polypeptide
DEEEIRTTNPVATEQYGSVWTNDQCHGNHQ

SEQ ID NO: 31244 - protein, 28 aa, Artificial Sequence
  Description of Artificial Sequence: Synthetic peptide
DEEEIRCTNPVSTEWYGSVSTNLEQGDR

SEQ ID NO: 31245 - protein, 28 aa, Artificial Sequence
  Description of Artificial Sequence: Synthetic peptide
KENEIATTNPVATECYGSVSTELQRGNY

SEQ ID NO: 31246 - protein, 28 aa, Artificial Sequence
  Description of Artificial Sequence: Synthetic peptide
DEEEIRCTNPVATEQFGSVSENWQQENR

SEQ ID NO: 31247 - protein, 29 aa, Artificial Sequence
  Description of Artificial Sequence: Synthetic peptide
DENEIATTNPVATEQYGSVSENLQRAFQR

SEQ ID NO: 31248 - protein, 32 aa, Artificial Sequence
  Description of Artificial Sequence: Synthetic polypeptide
DEEEIRTTNPVATEQYGSVSTLNPDQDRGEDR

SEQ ID NO: 31249 - protein, 28 aa, Artificial Sequence
  Description of Artificial Sequence: Synthetic peptide
DEEEIATTNCVATEQYGTCSTNLQGGGR

SEQ ID NO: 31250 - protein, 28 aa, Artificial Sequence
  Description of Artificial Sequence: Synthetic peptide
DEGEIYPTNPVATEQYGAVSTNQQRGND

SEQ ID NO: 31251 - protein, 28 aa, Artificial Sequence
  Description of Artificial Sequence: Synthetic peptide
SEEEIRTTNPVATEQYGDCPENLQRGER

SEQ ID NO: 31252 - protein, 28 aa, Artificial Sequence
  Description of Artificial Sequence: Synthetic peptide
DEEEIRTTNPVATEQYGSVETPDQMGEV

SEQ ID NO: 31253 - protein, 28 aa, Artificial Sequence
  Description of Artificial Sequence: Synthetic peptide
QEEEIRTTNIVATEQYGSVSENLQFGES

SEQ ID NO: 31254 - protein, 28 aa, Artificial Sequence
  Description of Artificial Sequence: Synthetic peptide
DEEEIRPTNPDSTEQYGSVATNLQRGDY

SEQ ID NO: 31255 - protein, 32 aa, Artificial Sequence
  Description of Artificial Sequence: Synthetic polypeptide
DEEEIRTTNPVATEQYGSVETNPLPQRGDEPR

SEQ ID NO: 31256 - protein, 28 aa, Artificial Sequence
  Description of Artificial Sequence: Synthetic peptide
DEEEIRTTNPVAYQIYGSVSHNLDPGNR

SEQ ID NO: 31257 - protein, 28 aa, Artificial Sequence
  Description of Artificial Sequence: Synthetic peptide
DEEEIRTTNPDATEQYGSVSTDLDDGDW

SEQ ID NO: 31258 - protein, 28 aa, Artificial Sequence
  Description of Artificial Sequence: Synthetic peptide
DEEEIRATNPVCTEQFGSVATNLQRGPQ

SEQ ID NO: 31259 - protein, 28 aa, Artificial Sequence
  Description of Artificial Sequence: Synthetic peptide
DEEEIRCTNPVATECYGSVSDNDQHGNY

SEQ ID NO: 31260 - protein, 29 aa, Artificial Sequence
  Description of Artificial Sequence: Synthetic peptide
DEVEIATTNPVATEQYGTVSTGLVQTGNR

SEQ ID NO: 31261 - protein, 28 aa, Artificial Sequence
  Description of Artificial Sequence: Synthetic peptide
QEQEIRTTNPVATEIYGSVSTLLQRGGL

SEQ ID NO: 31262 - protein, 28 aa, Artificial Sequence
  Description of Artificial Sequence: Synthetic peptide
DTEEIRTTNPVANEKYGSVHTNLQEGTR

SEQ ID NO: 31263 - protein, 30 aa, Artificial Sequence
  Description of Artificial Sequence: Synthetic polypeptide
DEEEIRTTNPVATEQYGSVDTNEQLVGNDA

SEQ ID NO: 31264 - protein, 28 aa, Artificial Sequence
  Description of Artificial Sequence: Synthetic peptide
NEIEIVTTNPVATEIYGEVSTNLQRGDR

SEQ ID NO: 31265 - protein, 28 aa, Artificial Sequence
  Description of Artificial Sequence: Synthetic peptide
DEEEIRTTNPVATEQYGSVSDDPQGDNP

SEQ ID NO: 31266 - protein, 28 aa, Artificial Sequence
  Description of Artificial Sequence: Synthetic peptide
SEVEIATTNPVATELYGSVSENEQRGNR

SEQ ID NO: 31267 - protein, 28 aa, Artificial Sequence
  Description of Artificial Sequence: Synthetic peptide
DEEEICTTNPVATNQYGSVSWNLNVGNA

SEQ ID NO: 31268 - protein, 28 aa, Artificial Sequence
  Description of Artificial Sequence: Synthetic peptide
DEEEIRTTNIVATEQWGHISTNLQRGHT

SEQ ID NO: 31269 - protein, 28 aa, Artificial Sequence
  Description of Artificial Sequence: Synthetic peptide
HEEEIRTTNPVATEIYGSVATNIQRPLR

SEQ ID NO: 31270 - protein, 28 aa, Artificial Sequence
  Description of Artificial Sequence: Synthetic peptide
DEQEIRTTNPVATEQYGSVETPLEHGNQ

SEQ ID NO: 31271 - protein, 28 aa, Artificial Sequence
  Description of Artificial Sequence: Synthetic peptide
REEEIATTNPVATEPYGDVSENLQTGNR

SEQ ID NO: 31272 - protein, 32 aa, Artificial Sequence
  Description of Artificial Sequence: Synthetic polypeptide
SEEEIRTTNPVATEQYGSVSTMNLQERGDNDV

SEQ ID NO: 31273 - protein, 28 aa, Artificial Sequence
  Description of Artificial Sequence: Synthetic peptide
DEEEIRTTNPIAYEAYGSVCTNLQVGTR

SEQ ID NO: 31274 - protein, 28 aa, Artificial Sequence
  Description of Artificial Sequence: Synthetic peptide
SEGEIAATNPVATEQFGSVSTNLQVGNR

SEQ ID NO: 31275 - protein, 28 aa, Artificial Sequence
  Description of Artificial Sequence: Synthetic peptide
DEEEIVTTNPVATEQYGVVSTCSQRFNL

SEQ ID NO: 31276 - protein, 32 aa, Artificial Sequence
  Description of Artificial Sequence: Synthetic polypeptide
DEEEIRTTNPVATEQYGSVSCTMNLCDRGNDA

SEQ ID NO: 31277 - protein, 29 aa, Artificial Sequence
  Description of Artificial Sequence: Synthetic peptide
DEQEIRTTNPVATECYGSVSTNLEVKGNI

SEQ ID NO: 31278 - protein, 28 aa, Artificial Sequence
  Description of Artificial Sequence: Synthetic peptide
DEEEIRATNPEATELYGSVSTNLQSGDV

SEQ ID NO: 31279 - protein, 29 aa, Artificial Sequence
  Description of Artificial Sequence: Synthetic peptide
DEEEIRTTNPVATEQYGCVGMNLQRLTER

SEQ ID NO: 31280 - protein, 28 aa, Artificial Sequence
  Description of Artificial Sequence: Synthetic peptide
SEEEIRTVNPVATEVYGCVSNNLERGNR

SEQ ID NO: 31281 - protein, 28 aa, Artificial Sequence
  Description of Artificial Sequence: Synthetic peptide
DEGEIVTTNPVATEPYGSCSTNVQRGMR

SEQ ID NO: 31282 - protein, 30 aa, Artificial Sequence
  Description of Artificial Sequence: Synthetic polypeptide
DENEIRTTNPVATEQYGSASENLQRGFEDR

SEQ ID NO: 31283 - protein, 29 aa, Artificial Sequence
  Description of Artificial Sequence: Synthetic peptide
GEEEIRTVNPVATEQYGSVSTELQNEGNL

SEQ ID NO: 31284 - protein, 31 aa, Artificial Sequence
  Description of Artificial Sequence: Synthetic polypeptide
DEEEIRTTNPVATEQYGSVSTNLQEIEGEDN

SEQ ID NO: 31285 - protein, 28 aa, Artificial Sequence
  Description of Artificial Sequence: Synthetic peptide
DEGEIRSVNPVATEQYGSVSTNWQTGNF

SEQ ID NO: 31286 - protein, 28 aa, Artificial Sequence
  Description of Artificial Sequence: Synthetic peptide
DENEIRATNPVASENYGEVSTNLQHGNR

SEQ ID NO: 31287 - protein, 31 aa, Artificial Sequence
  Description of Artificial Sequence: Synthetic polypeptide
DEEEIRTTNPVATELYGSVSTNWQEREGPNH

SEQ ID NO: 31288 - protein, 31 aa, Artificial Sequence
  Description of Artificial Sequence: Synthetic polypeptide
DEEEIRTTNPVATEQYGSVSTDLQDIKGEDR

SEQ ID NO: 31289 - protein, 28 aa, Artificial Sequence
  Description of Artificial Sequence: Synthetic peptide
DEEEIRTTNPNATEEYGSVATNHGRGNA

SEQ ID NO: 31290 - protein, 28 aa, Artificial Sequence
  Description of Artificial Sequence: Synthetic peptide
QEEEIACTNPVATETYGSVSENLQTGNR

SEQ ID NO: 31291 - protein, 28 aa, Artificial Sequence
  Description of Artificial Sequence: Synthetic peptide
DEEEIRTTNIVATEQYGSVDTDLQIGEL

SEQ ID NO: 31292 - protein, 28 aa, Artificial Sequence
  Description of Artificial Sequence: Synthetic peptide
DEEEIRTTNPVSTEHFGSVSDNGQRGNV

SEQ ID NO: 31293 - protein, 31 aa, Artificial Sequence
  Description of Artificial Sequence: Synthetic polypeptide
DEEEIATTNPTATEQYGSVSTMNEQLRGNDR

SEQ ID NO: 31294 - protein, 28 aa, Artificial Sequence
  Description of Artificial Sequence: Synthetic peptide
DENEIRCTNPVATEQYGGVSDVLQRGGR

SEQ ID NO: 31295 - protein, 28 aa, Artificial Sequence
  Description of Artificial Sequence: Synthetic peptide
DEQEIATVNPVATECYGSVSENLQHGNR

SEQ ID NO: 31296 - protein, 28 aa, Artificial Sequence
  Description of Artificial Sequence: Synthetic peptide
DEEEIRCTNPIATEQYGNVSENLQYGGR

SEQ ID NO: 31297 - protein, 28 aa, Artificial Sequence
  Description of Artificial Sequence: Synthetic peptide
DEEEIRCTNPVSTEWYGSVSTNLMTGNF

SEQ ID NO: 31298 - protein, 29 aa, Artificial Sequence
  Description of Artificial Sequence: Synthetic peptide
DDEEIRTTNPVATEMYGVVSTDLQREGNI

SEQ ID NO: 31299 - protein, 28 aa, Artificial Sequence
  Description of Artificial Sequence: Synthetic peptide
DEEEIRTTNPVATEQYGSVEDNDERGEG

SEQ ID NO: 31300 - protein, 32 aa, Artificial Sequence
  Description of Artificial Sequence: Synthetic polypeptide
DEEEIRTTNPVATEQYGSVDSETNLEDDGENR

SEQ ID NO: 31301 - protein, 29 aa, Artificial Sequence
  Description of Artificial Sequence: Synthetic peptide
DEAEIRTTNPVATEMYGSVSTANLESGNF

SEQ ID NO: 31302 - protein, 28 aa, Artificial Sequence
  Description of Artificial Sequence: Synthetic peptide
DEMEITSTNPVATENYGSVSTNLQSGMR

SEQ ID NO: 31303 - protein, 28 aa, Artificial Sequence
  Description of Artificial Sequence: Synthetic peptide
NEEEIRTTNPVATEQYGCVAELLQRGNM

SEQ ID NO: 31304 - protein, 28 aa, Artificial Sequence
  Description of Artificial Sequence: Synthetic peptide
QEEEIRTTNPIATECYGSVSTAEQRGNQ

SEQ ID NO: 31305 - protein, 30 aa, Artificial Sequence
  Description of Artificial Sequence: Synthetic polypeptide
SEEEIRTTNPVATEQYGCVSTNGLQQGNTL

SEQ ID NO: 31306 - protein, 30 aa, Artificial Sequence
  Description of Artificial Sequence: Synthetic polypeptide
DEEEIRTTNPVATEQYGSVSDNLPQVGPTI

SEQ ID NO: 31307 - protein, 28 aa, Artificial Sequence
  Description of Artificial Sequence: Synthetic peptide
DEVEIATTNPTATEMFGSVSENLQRGNR

SEQ ID NO: 31308 - protein, 28 aa, Artificial Sequence
  Description of Artificial Sequence: Synthetic peptide
DEQEIRTTNPVATEQYGSWSTADERGER

SEQ ID NO: 31309 - protein, 28 aa, Artificial Sequence
  Description of Artificial Sequence: Synthetic peptide
DEEEIRCTNPVATEQYGLVAANLQRGPT

SEQ ID NO: 31310 - protein, 28 aa, Artificial Sequence
  Description of Artificial Sequence: Synthetic peptide
DEDEIRTTNPVSCEAYGSVATNLQRGNW

SEQ ID NO: 31311 - protein, 28 aa, Artificial Sequence
  Description of Artificial Sequence: Synthetic peptide
MEEEIRTTNPVATEHYGWVSENLQAGNN

SEQ ID NO: 31312 - protein, 28 aa, Artificial Sequence
  Description of Artificial Sequence: Synthetic peptide
DEQEIATTNIVSTEQYGSVSEVLQRGNR

SEQ ID NO: 31313 - protein, 28 aa, Artificial Sequence
  Description of Artificial Sequence: Synthetic peptide
DEEEIRAVNPVATEMYGVVSTNLQYGDR

SEQ ID NO: 31314 - protein, 28 aa, Artificial Sequence
  Description of Artificial Sequence: Synthetic peptide
DEEEIRCTNPVASEIYGCVSMNLERGNR

SEQ ID NO: 31315 - protein, 29 aa, Artificial Sequence
  Description of Artificial Sequence: Synthetic peptide
QEEEIRTTNPVATEVYGEASTNLQRAGGR

SEQ ID NO: 31316 - protein, 28 aa, Artificial Sequence
  Description of Artificial Sequence: Synthetic peptide
AEEEITTTNPVATEQYGEVSTELQAGNY

SEQ ID NO: 31317 - protein, 29 aa, Artificial Sequence
  Description of Artificial Sequence: Synthetic peptide
DEEEIRTTNPVATEQYGDAGATNLQHGNI

SEQ ID NO: 31318 - protein, 28 aa, Artificial Sequence
  Description of Artificial Sequence: Synthetic peptide
GEEEIRTTNPVATETYGIVSNNLQRGTQ

SEQ ID NO: 31319 - protein, 28 aa, Artificial Sequence
  Description of Artificial Sequence: Synthetic peptide
DENEIATTNPVATEQYGDVPTNLQHGER

SEQ ID NO: 31320 - protein, 28 aa, Artificial Sequence
  Description of Artificial Sequence: Synthetic peptide
DENEIRTTNPVATECYGVVSTNLEDGNM

SEQ ID NO: 31321 - protein, 29 aa, Artificial Sequence
  Description of Artificial Sequence: Synthetic peptide
DEEEIRTTNPVATELWGSVSTNEMNRGNL

SEQ ID NO: 31322 - protein, 28 aa, Artificial Sequence
  Description of Artificial Sequence: Synthetic peptide
DESEIRTTNPVATECYGTVATDLQRGDR

SEQ ID NO: 31323 - protein, 28 aa, Artificial Sequence
  Description of Artificial Sequence: Synthetic peptide
DDEEISSTNPVATEQYGEVSTNLQSGDR

SEQ ID NO: 31324 - protein, 28 aa, Artificial Sequence
  Description of Artificial Sequence: Synthetic peptide
DEEEICCTNIVATEDYGSVSTNLQRNIR

SEQ ID NO: 31325 - protein, 28 aa, Artificial Sequence
  Description of Artificial Sequence: Synthetic peptide
DESEIRATNPVATEQFGVVSNNLQHGNR

SEQ ID NO: 31326 - protein, 28 aa, Artificial Sequence
  Description of Artificial Sequence: Synthetic peptide
DEQEIRTTNPVATELWGSVSTNLMTGNF

SEQ ID NO: 31327 - protein, 30 aa, Artificial Sequence
  Description of Artificial Sequence: Synthetic polypeptide
DEEEIRTTNPFATEQYGCSVDTGNLQRGDG

SEQ ID NO: 31328 - protein, 31 aa, Artificial Sequence
  Description of Artificial Sequence: Synthetic polypeptide
DHEEIRTTNPVAYEQYGSMVTSDHNLQRGNR

SEQ ID NO: 31329 - protein, 28 aa, Artificial Sequence
  Description of Artificial Sequence: Synthetic peptide
DEEEIRTTNITASEQYGTTVTNLQRGNR

SEQ ID NO: 31330 - protein, 31 aa, Artificial Sequence
  Description of Artificial Sequence: Synthetic polypeptide
DENEIVTTNPVATEQYGSVSATNLQVEGDNR

SEQ ID NO: 31331 - protein, 31 aa, Artificial Sequence
  Description of Artificial Sequence: Synthetic polypeptide
DEEEIRTTNPVATEQYGECVSTCNLQMGDNW

SEQ ID NO: 31332 - protein, 28 aa, Artificial Sequence
  Description of Artificial Sequence: Synthetic peptide
AEQEIATTNPTATEQYGSVSMNLQRGNI

SEQ ID NO: 31333 - protein, 30 aa, Artificial Sequence
  Description of Artificial Sequence: Synthetic polypeptide
DEEEIRTTNPEATEQYGDVSTNPLQRDGEL

SEQ ID NO: 31334 - protein, 28 aa, Artificial Sequence
  Description of Artificial Sequence: Synthetic peptide
DENEIATTNPVATECYGSVSTELQRGEA

SEQ ID NO: 31335 - protein, 31 aa, Artificial Sequence
  Description of Artificial Sequence: Synthetic polypeptide
DEEEIRTTNPIATEQYGSVSTGGLQNVKGNR

SEQ ID NO: 31336 - protein, 29 aa, Artificial Sequence
  Description of Artificial Sequence: Synthetic peptide
DESEIYTTNPVATEQYGGVSCNLQRAGNV

SEQ ID NO: 31337 - protein, 28 aa, Artificial Sequence
  Description of Artificial Sequence: Synthetic peptide
SEGEIRTTNPVATEMYGWVSENLQRGNT

SEQ ID NO: 31338 - protein, 28 aa, Artificial Sequence
  Description of Artificial Sequence: Synthetic peptide
QEEETNTTNPVATEHYGSVSDNLQAGNR

SEQ ID NO: 31339 - protein, 28 aa, Artificial Sequence
  Description of Artificial Sequence: Synthetic peptide
AEAEIGTTNPVATEQYGVVSTVLQRGGR

SEQ ID NO: 31340 - protein, 28 aa, Artificial Sequence
  Description of Artificial Sequence: Synthetic peptide
DEVEIATTNPVATEMYGSVSENEQRGTR

SEQ ID NO: 31341 - protein, 28 aa, Artificial Sequence
  Description of Artificial Sequence: Synthetic peptide
MEEEISTTNPVSTEIYGTVSTNLQRGGR

SEQ ID NO: 31342 - protein, 28 aa, Artificial Sequence
  Description of Artificial Sequence: Synthetic peptide
NEEEIRTTNPGATQHYGSVSTELQAGNR

SEQ ID NO: 31343 - protein, 28 aa, Artificial Sequence
  Description of Artificial Sequence: Synthetic peptide
SESEIRCTNPVATEQYGSMSTNLERGNL

SEQ ID NO: 31344 - protein, 29 aa, Artificial Sequence
  Description of Artificial Sequence: Synthetic peptide
DEEEIRTTNPVSTEQYGIVSENDQNIGNR

SEQ ID NO: 31345 - protein, 31 aa, Artificial Sequence
  Description of Artificial Sequence: Synthetic polypeptide
DEEEIRTTNPTATEQYGSVSTNEQIEGDNTR

SEQ ID NO: 31346 - protein, 28 aa, Artificial Sequence
  Description of Artificial Sequence: Synthetic peptide
DEGEITTTNPVATEQYGEVSDELQRGQR

SEQ ID NO: 31347 - protein, 28 aa, Artificial Sequence
  Description of Artificial Sequence: Synthetic peptide
SEEEIRTTNPTATEQFGSVSTNWQFGNI

SEQ ID NO: 31348 - protein, 30 aa, Artificial Sequence
  Description of Artificial Sequence: Synthetic polypeptide
DEEEIRTVNPVATEQYGSVSCTMNLQMLNA

SEQ ID NO: 31349 - protein, 29 aa, Artificial Sequence
  Description of Artificial Sequence: Synthetic peptide
DENEIRSTNPVATEQYGSVSTDLQIEGNQ

SEQ ID NO: 31350 - protein, 28 aa, Artificial Sequence
  Description of Artificial Sequence: Synthetic peptide
DESEIATVNPVATEIYGAVSMNLQRGNR

SEQ ID NO: 31351 - protein, 28 aa, Artificial Sequence
  Description of Artificial Sequence: Synthetic peptide
DEQEIRCTNPVATEIYGSVANNLERGNR

SEQ ID NO: 31352 - protein, 28 aa, Artificial Sequence
  Description of Artificial Sequence: Synthetic peptide
NDAEIRATNPVATEQYGSVSNNLQRGTR

SEQ ID NO: 31353 - protein, 28 aa, Artificial Sequence
  Description of Artificial Sequence: Synthetic peptide
DEQEIATTNPVATECYGSVSENLQIGNY

SEQ ID NO: 31354 - protein, 28 aa, Artificial Sequence
  Description of Artificial Sequence: Synthetic peptide
DEEEITTTNIVAAEYYGSVSTNDQRGNC

SEQ ID NO: 31355 - protein, 31 aa, Artificial Sequence
  Description of Artificial Sequence: Synthetic polypeptide
DEEEIRQTNPVATEQYGVVSTNGLQYKGENR

SEQ ID NO: 31356 - protein, 28 aa, Artificial Sequence
  Description of Artificial Sequence: Synthetic peptide
DENEIRTTNPVSTEMYGEVSTNLQHGGR

SEQ ID NO: 31357 - protein, 28 aa, Artificial Sequence
  Description of Artificial Sequence: Synthetic peptide
DEVEIATTNPVCTEGYGSASTNLQRGNL

SEQ ID NO: 31358 - protein, 31 aa, Artificial Sequence
  Description of Artificial Sequence: Synthetic polypeptide
DEEEIRTTNPVATEQYGSVSTNLQENEGEDM

SEQ ID NO: 31359 - protein, 28 aa, Artificial Sequence
  Description of Artificial Sequence: Synthetic peptide
QEEEIRQTNPVATEGYGSVPTVLQRENR

SEQ ID NO: 31360 - protein, 33 aa, Artificial Sequence
  Description of Artificial Sequence: Synthetic polypeptide
DEEEIRTTNPVATEQYGSVSTTDNLVEREGDNR

SEQ ID NO: 31361 - protein, 28 aa, Artificial Sequence
  Description of Artificial Sequence: Synthetic peptide
DEEEICTTNPTATECYGSVSENLQLGNN

SEQ ID NO: 31362 - protein, 28 aa, Artificial Sequence
  Description of Artificial Sequence: Synthetic peptide
DEEEIRTTNIVATEQFGEVSENIQRGNF

SEQ ID NO: 31363 - protein, 30 aa, Artificial Sequence
  Description of Artificial Sequence: Synthetic polypeptide
DEEEIRTTNPVATEQYGSVATELCVDGENR

SEQ ID NO: 31364 - protein, 28 aa, Artificial Sequence
  Description of Artificial Sequence: Synthetic peptide
DENEIRTTNPVSTEQYGTVFTNLQPGDR

SEQ ID NO: 31365 - protein, 32 aa, Artificial Sequence
  Description of Artificial Sequence: Synthetic polypeptide
DEEEIRTTNPVATEQYGSVCSDTNLQDQGDER

SEQ ID NO: 31366 - protein, 28 aa, Artificial Sequence
  Description of Artificial Sequence: Synthetic peptide
DEQEIRTTNPVSTEQYGSVSEVLQHGGR

SEQ ID NO: 31367 - protein, 29 aa, Artificial Sequence
  Description of Artificial Sequence: Synthetic peptide
DEEEIRTVNPVATEIYGSVSATVIQHGNR

SEQ ID NO: 31368 - protein, 28 aa, Artificial Sequence
  Description of Artificial Sequence: Synthetic peptide
SEEEIRTTNPVATETYGSVSTNEQQGTQ

SEQ ID NO: 31369 - protein, 30 aa, Artificial Sequence
  Description of Artificial Sequence: Synthetic polypeptide
DEEEIRATNPVATEQYGNVSANLQDRGINQ

SEQ ID NO: 31370 - protein, 28 aa, Artificial Sequence
  Description of Artificial Sequence: Synthetic peptide
DEEEIRTTNPVATECYGSVSTELENGES

SEQ ID NO: 31371 - protein, 28 aa, Artificial Sequence
  Description of Artificial Sequence: Synthetic peptide
DENEIRTTNPVSTEQWGSVSENEQRGNM

SEQ ID NO: 31372 - protein, 28 aa, Artificial Sequence
  Description of Artificial Sequence: Synthetic peptide
DEEEICTTNPVATEQYGSAPTVLQGGTR

SEQ ID NO: 31373 - protein, 33 aa, Artificial Sequence
  Description of Artificial Sequence: Synthetic polypeptide
DEEEIRTTNPVATEQYGSVSITTNLEEREGDNR

SEQ ID NO: 31374 - protein, 28 aa, Artificial Sequence
  Description of Artificial Sequence: Synthetic peptide
QESEIRTTNPVATEIYGSVSYNLERGNM

SEQ ID NO: 31375 - protein, 29 aa, Artificial Sequence
  Description of Artificial Sequence: Synthetic peptide
QEDEICTTNPVATEQYGEVSAENLQRGNR

SEQ ID NO: 31376 - protein, 28 aa, Artificial Sequence
  Description of Artificial Sequence: Synthetic peptide
DEQEIRTTNPEATEQYGSVSTNLDHDNE

SEQ ID NO: 31377 - protein, 28 aa, Artificial Sequence
  Description of Artificial Sequence: Synthetic peptide
DENEIRTTNPVSSECYGICSTNLQRGNR

SEQ ID NO: 31378 - protein, 28 aa, Artificial Sequence
  Description of Artificial Sequence: Synthetic peptide
DEEEIKATNPVATEMYGAVSENLQRGER

SEQ ID NO: 31379 - protein, 28 aa, Artificial Sequence
  Description of Artificial Sequence: Synthetic peptide
KEEEIRTTNPVATEMYGVVSTELQNGNA

SEQ ID NO: 31380 - protein, 28 aa, Artificial Sequence
  Description of Artificial Sequence: Synthetic peptide
DEEEIRTTNPVATEQYWSWSTGQNRGND

SEQ ID NO: 31381 - protein, 30 aa, Artificial Sequence
  Description of Artificial Sequence: Synthetic polypeptide
DEEEIRTTNPVATEQYGSVTETPNLLRGEP

SEQ ID NO: 31382 - protein, 28 aa, Artificial Sequence
  Description of Artificial Sequence: Synthetic peptide
DENEIRQTNPVATEQYGVVSTDDQRGNL

SEQ ID NO: 31383 - protein, 29 aa, Artificial Sequence
  Description of Artificial Sequence: Synthetic peptide
SEEEIRTTNPVSTEQWGDVSTNLQWRGDR

SEQ ID NO: 31384 - protein, 28 aa, Artificial Sequence
  Description of Artificial Sequence: Synthetic peptide
DEQEIATTNPVCTEQYGEVSENLQRGNT

SEQ ID NO: 31385 - protein, 28 aa, Artificial Sequence
  Description of Artificial Sequence: Synthetic peptide
GEEEISTVNPVATEMYGSVSENLQRGNK

SEQ ID NO: 31386 - protein, 28 aa, Artificial Sequence
  Description of Artificial Sequence: Synthetic peptide
DEEELRTTNPVATEMYGSVRTNLGIGND

SEQ ID NO: 31387 - protein, 28 aa, Artificial Sequence
  Description of Artificial Sequence: Synthetic peptide
FEDEIATTNPVATECYGFVSDNLQRGNR

SEQ ID NO: 31388 - protein, 30 aa, Artificial Sequence
  Description of Artificial Sequence: Synthetic polypeptide
DEEEIRTTNPVATEQYGSVSTIELQEKGEY

SEQ ID NO: 31389 - protein, 29 aa, Artificial Sequence
  Description of Artificial Sequence: Synthetic peptide
DEEEIRTTNPTATEQYGSTSAELLQRGER

SEQ ID NO: 31390 - protein, 32 aa, Artificial Sequence
  Description of Artificial Sequence: Synthetic polypeptide
DENEIRTTNPVATEQYGSVDSATNGLVQRGER

SEQ ID NO: 31391 - protein, 28 aa, Artificial Sequence
  Description of Artificial Sequence: Synthetic peptide
AEEEIRTVNPVSTEQYGGVAMNLQRGNR

SEQ ID NO: 31392 - protein, 30 aa, Artificial Sequence
  Description of Artificial Sequence: Synthetic polypeptide
DEEEITTTNPVATEQYGWVPSELNLQRGNE

SEQ ID NO: 31393 - protein, 33 aa, Artificial Sequence
  Description of Artificial Sequence: Synthetic polypeptide
DEEEIRTTNPVATEQYGSVESITYNGLQRKGNY

SEQ ID NO: 31394 - protein, 31 aa, Artificial Sequence
  Description of Artificial Sequence: Synthetic polypeptide
DEEEIRTTNPTATEQYGSVSTNLQDLEGNTN

SEQ ID NO: 31395 - protein, 32 aa, Artificial Sequence
  Description of Artificial Sequence: Synthetic polypeptide
DEEEIRTTNPVATEQYGSVSTCNLQQHGINDM

SEQ ID NO: 31396 - protein, 29 aa, Artificial Sequence
  Description of Artificial Sequence: Synthetic peptide
DESEVRTTNPVATEQYGSVANNWQRGNDR

SEQ ID NO: 31397 - protein, 30 aa, Artificial Sequence
  Description of Artificial Sequence: Synthetic polypeptide
DEEEIATTNPVATEQYGSVSTNEQDNGDNL

SEQ ID NO: 31398 - protein, 28 aa, Artificial Sequence
  Description of Artificial Sequence: Synthetic peptide
SEEEIRTTNPTATEQYGSVSTNPQVGTQ

SEQ ID NO: 31399 - protein, 28 aa, Artificial Sequence
  Description of Artificial Sequence: Synthetic peptide
DEEEIATTNPVATEQYGGVSTNLEIGDQ

SEQ ID NO: 31400 - protein, 28 aa, Artificial Sequence
  Description of Artificial Sequence: Synthetic peptide
NEEEIRTTNIVATEQYGSVSANIEFGNR

SEQ ID NO: 31401 - protein, 28 aa, Artificial Sequence
  Description of Artificial Sequence: Synthetic peptide
DEEEIRTTNPVATEVYGSMSTDLDMGNN

SEQ ID NO: 31402 - protein, 30 aa, Artificial Sequence
  Description of Artificial Sequence: Synthetic polypeptide
NEEEIRTTNPVATEIYGAVSMMNLQREGNR

SEQ ID NO: 31403 - protein, 29 aa, Artificial Sequence
  Description of Artificial Sequence: Synthetic peptide
SEEEIRTTNPVATEQWGSYSENLQRGLDR

SEQ ID NO: 31404 - protein, 32 aa, Artificial Sequence
  Description of Artificial Sequence: Synthetic polypeptide
DEEEIRTTNPVATEQYGSVESTELQDADGDNR

SEQ ID NO: 31405 - protein, 28 aa, Artificial Sequence
  Description of Artificial Sequence: Synthetic peptide
SEEEIRTTNPAATEMFGSVSTNLQNGTR

SEQ ID NO: 31406 - protein, 29 aa, Artificial Sequence
  Description of Artificial Sequence: Synthetic peptide
DEEEIRTTNPVATEQWGDYSTNEQRAGNA

SEQ ID NO: 31407 - protein, 28 aa, Artificial Sequence
  Description of Artificial Sequence: Synthetic peptide
DEEEIRTVNPVATETYGVVSTNLQNGTN

SEQ ID NO: 31408 - protein, 29 aa, Artificial Sequence
  Description of Artificial Sequence: Synthetic peptide
AEQEIVTTNPVATECYGSVSATNEQRGNR

SEQ ID NO: 31409 - protein, 29 aa, Artificial Sequence
  Description of Artificial Sequence: Synthetic peptide
YEEEIRTTNPVATEVYGAVSTNDQTRGNM

SEQ ID NO: 31410 - protein, 28 aa, Artificial Sequence
  Description of Artificial Sequence: Synthetic peptide
QEEEITATNPVATEQYGSVSTDLQSGND

SEQ ID NO: 31411 - protein, 28 aa, Artificial Sequence
  Description of Artificial Sequence: Synthetic peptide
GENEIRTTNPVATECYGSVSTELQQGNE

SEQ ID NO: 31412 - protein, 28 aa, Artificial Sequence
  Description of Artificial Sequence: Synthetic peptide
KENEIATTNPVATEQYGSASENLQRGNM

SEQ ID NO: 31413 - protein, 31 aa, Artificial Sequence
  Description of Artificial Sequence: Synthetic polypeptide
GEEEIRTTNPVASEQYGWVSTNLQDREGNDR

SEQ ID NO: 31414 - protein, 31 aa, Artificial Sequence
  Description of Artificial Sequence: Synthetic polypeptide
DEEEITTTNPVATEQYGSVNSTINLDRGNDN

SEQ ID NO: 31415 - protein, 28 aa, Artificial Sequence
  Description of Artificial Sequence: Synthetic peptide
DEDEIRCTNPIATEIYGSVGMNLQRGNR

SEQ ID NO: 31416 - protein, 28 aa, Artificial Sequence
  Description of Artificial Sequence: Synthetic peptide
DESEIRTTNPCATETYGDVSDNLQRLNR

SEQ ID NO: 31417 - protein, 31 aa, Artificial Sequence
  Description of Artificial Sequence: Synthetic polypeptide
AEEEIRTTNPVATEQYGVVSTTNLQLRGEER

SEQ ID NO: 31418 - protein, 30 aa, Artificial Sequence
  Description of Artificial Sequence: Synthetic polypeptide
DEEEIRTTNPVATECYGSVSTNLQQNGEDL

SEQ ID NO: 31419 - protein, 28 aa, Artificial Sequence
  Description of Artificial Sequence: Synthetic peptide
DENEIRTTNPVATECYGSMSDNLQHGDR

SEQ ID NO: 31420 - protein, 28 aa, Artificial Sequence
  Description of Artificial Sequence: Synthetic peptide
GEEEIRTTNPVATEQYGVVGTDIQWGNR

SEQ ID NO: 31421 - protein, 28 aa, Artificial Sequence
  Description of Artificial Sequence: Synthetic peptide
QEQEIATVNPVSTEQYGSVSTNLQHGNR

SEQ ID NO: 31422 - protein, 28 aa, Artificial Sequence
  Description of Artificial Sequence: Synthetic peptide
AENEIRTTNPVATEQYGSVSTNLMRMQQ

SEQ ID NO: 31423 - protein, 28 aa, Artificial Sequence
  Description of Artificial Sequence: Synthetic peptide
DEEEIRTTNPVATEQYGSVSTDPDNGEM

SEQ ID NO: 31424 - protein, 28 aa, Artificial Sequence
  Description of Artificial Sequence: Synthetic peptide
KEEEIRATNPVATEQYGSMATNLQQGNM

SEQ ID NO: 31425 - protein, 28 aa, Artificial Sequence
  Description of Artificial Sequence: Synthetic peptide
DEEEIRTTNPVATECYGEVATNLQRTEW

SEQ ID NO: 31426 - protein, 28 aa, Artificial Sequence
  Description of Artificial Sequence: Synthetic peptide
DENEIRTTNPVATEQYGVVSEDQQRGER

SEQ ID NO: 31427 - protein, 29 aa, Artificial Sequence
  Description of Artificial Sequence: Synthetic peptide
DEEEIRTTNPVATEQYGGVADELQYAGNR

SEQ ID NO: 31428 - protein, 29 aa, Artificial Sequence
  Description of Artificial Sequence: Synthetic peptide
AEEEISQTNPVATEQYGTVSATNLQRGGR

SEQ ID NO: 31429 - protein, 31 aa, Artificial Sequence
  Description of Artificial Sequence: Synthetic polypeptide
DEEEIRTTNPVATEQYGSVSTANEQEHGNTI

SEQ ID NO: 31430 - protein, 32 aa, Artificial Sequence
  Description of Artificial Sequence: Synthetic polypeptide
DEEEIRTTNPVATEQYGSVSTNEQLVEGDNTR

SEQ ID NO: 31431 - protein, 29 aa, Artificial Sequence
  Description of Artificial Sequence: Synthetic peptide
DEHEIRTTNPCCTEQYGDVSCENLQRGNR

SEQ ID NO: 31432 - protein, 28 aa, Artificial Sequence
  Description of Artificial Sequence: Synthetic peptide
DEDEVRTTNPVATEQYGQVSTDLQAGND

SEQ ID NO: 31433 - protein, 28 aa, Artificial Sequence
  Description of Artificial Sequence: Synthetic peptide
DEEEIRTTNPVGTECYGLVSENLQRFNT

SEQ ID NO: 31434 - protein, 30 aa, Artificial Sequence
  Description of Artificial Sequence: Synthetic polypeptide
QEEEIRTTNPVATENYGCVSTCNLLREGNR

SEQ ID NO: 31435 - protein, 28 aa, Artificial Sequence
  Description of Artificial Sequence: Synthetic peptide
DEEEIACTNPVSTEQYGEVATNLQHGNR

SEQ ID NO: 31436 - protein, 28 aa, Artificial Sequence
  Description of Artificial Sequence: Synthetic peptide
DENEIVCTNPVATEQYGWTGTNLQRGNR

SEQ ID NO: 31437 - protein, 32 aa, Artificial Sequence
  Description of Artificial Sequence: Synthetic polypeptide
DEEEIRTTNPVATEQYGSVSTNLELREGENDT

SEQ ID NO: 31438 - protein, 28 aa, Artificial Sequence
  Description of Artificial Sequence: Synthetic peptide
DENEIATTNPVSTEQYGSCSTNLEHGNR

SEQ ID NO: 31439 - protein, 28 aa, Artificial Sequence
  Description of Artificial Sequence: Synthetic peptide
DEEEIRTTNPVATEQYGSVSEGECQGNA

SEQ ID NO: 31440 - protein, 29 aa, Artificial Sequence
  Description of Artificial Sequence: Synthetic peptide
DECEIRTTNPVATEPYGCVDTNLQDKGNR

SEQ ID NO: 31441 - protein, 30 aa, Artificial Sequence
  Description of Artificial Sequence: Synthetic polypeptide
DEEEIRTTNPEATEQYGDVSTNLEERGNDN

SEQ ID NO: 31442 - protein, 28 aa, Artificial Sequence
  Description of Artificial Sequence: Synthetic peptide
YEQELRTTNPVATEQYGGVCTELQRGNR

SEQ ID NO: 31443 - protein, 31 aa, Artificial Sequence
  Description of Artificial Sequence: Synthetic polypeptide
DEEEIRTTNPVATEQYGSVSTNPQDRGDTTG

SEQ ID NO: 31444 - protein, 28 aa, Artificial Sequence
  Description of Artificial Sequence: Synthetic peptide
DENEIRTTNPVATEIYGVVSTNLQYGEN

SEQ ID NO: 31445 - protein, 28 aa, Artificial Sequence
  Description of Artificial Sequence: Synthetic peptide
DEEYIRTTNPVAYQCYGSVSTNLDPGNR

SEQ ID NO: 31446 - protein, 30 aa, Artificial Sequence
  Description of Artificial Sequence: Synthetic polypeptide
DENEIRTTNPVATECYGSVSATDLQEHGNR

SEQ ID NO: 31447 - protein, 28 aa, Artificial Sequence
  Description of Artificial Sequence: Synthetic peptide
DEEEIRTTNPVATEIYGCVSTNWQVGDA

SEQ ID NO: 31448 - protein, 28 aa, Artificial Sequence
  Description of Artificial Sequence: Synthetic peptide
DEEEIRTTNPVATEQYGSVETDDDIGNQ

SEQ ID NO: 31449 - protein, 29 aa, Artificial Sequence
  Description of Artificial Sequence: Synthetic peptide
KENEIRTTNPVATEQYGSVSTELQDVGNH

SEQ ID NO: 31450 - protein, 31 aa, Artificial Sequence
  Description of Artificial Sequence: Synthetic polypeptide
KEEEIATTNPVATEQYGSVSTNLQQHFGNDR

SEQ ID NO: 31451 - protein, 29 aa, Artificial Sequence
  Description of Artificial Sequence: Synthetic peptide
DEREIVTTNPVATEQYGSVSDGNLQVGNF

SEQ ID NO: 31452 - protein, 28 aa, Artificial Sequence
  Description of Artificial Sequence: Synthetic peptide
DEEEIRTTNPTATEQFGSVSTNPQSGTN

SEQ ID NO: 31453 - protein, 31 aa, Artificial Sequence
  Description of Artificial Sequence: Synthetic polypeptide
DEEEIRTTNPVATEQYGSVSITAPVQIGVNR

SEQ ID NO: 31454 - protein, 28 aa, Artificial Sequence
  Description of Artificial Sequence: Synthetic peptide
DDEEIRTTNPVATETYGVVGNNLERGNR

SEQ ID NO: 31455 - protein, 28 aa, Artificial Sequence
  Description of Artificial Sequence: Synthetic peptide
QEGEIRATNPVATEQYGDVSANDQRGNR

SEQ ID NO: 31456 - protein, 29 aa, Artificial Sequence
  Description of Artificial Sequence: Synthetic peptide
DEEEIATTNPVATECYGDVSENLQERGNM

SEQ ID NO: 31457 - protein, 29 aa, Artificial Sequence
  Description of Artificial Sequence: Synthetic peptide
DEQEIRTTNPVATEQYGSVSEDLQTGNDM

SEQ ID NO: 31458 - protein, 29 aa, Artificial Sequence
  Description of Artificial Sequence: Synthetic peptide
DEEEIYTTNPVCTEQYGSVSNGLQRGINT

SEQ ID NO: 31459 - protein, 29 aa, Artificial Sequence
  Description of Artificial Sequence: Synthetic peptide
DEEEIRTTNPVATEQWGSVSENEMMRGNF

SEQ ID NO: 31460 - protein, 29 aa, Artificial Sequence
  Description of Artificial Sequence: Synthetic peptide
DEEEIRTTNPVATEQYGDVSENLQCHGEQ

SEQ ID NO: 31461 - protein, 30 aa, Artificial Sequence
  Description of Artificial Sequence: Synthetic polypeptide
DEEEIRTTNPVATEQYGSVDSETNLEAGEL

SEQ ID NO: 31462 - protein, 28 aa, Artificial Sequence
  Description of Artificial Sequence: Synthetic peptide
DEVEIRTTNPVSTECYGSVSTNEQRGTF

SEQ ID NO: 31463 - protein, 28 aa, Artificial Sequence
  Description of Artificial Sequence: Synthetic peptide
DENEIRTTNPVATEQWGSVDTNLMLGNM

SEQ ID NO: 31464 - protein, 29 aa, Artificial Sequence
  Description of Artificial Sequence: Synthetic peptide
DEYEIRSTNPVATEQFGSVSTNLQRAGMM

SEQ ID NO: 31465 - protein, 29 aa, Artificial Sequence
  Description of Artificial Sequence: Synthetic peptide
DENEIRQTNPVSTEQYGEVSAENLQRGNR

SEQ ID NO: 31466 - protein, 28 aa, Artificial Sequence
  Description of Artificial Sequence: Synthetic peptide
DEEEIRTTNPVATEQYGIVSECEQRGLG

SEQ ID NO: 31467 - protein, 30 aa, Artificial Sequence
  Description of Artificial Sequence: Synthetic polypeptide
DEEEIRTTNPVATELYGSVSENMTQRFLNR

SEQ ID NO: 31468 - protein, 31 aa, Artificial Sequence
  Description of Artificial Sequence: Synthetic polypeptide
DEEEIRTTNPVATEQYGSVSITEDQRKGNDS

SEQ ID NO: 31469 - protein, 28 aa, Artificial Sequence
  Description of Artificial Sequence: Synthetic peptide
DEQEIRTTNPVATEIYGSVSEVLQHGMR

SEQ ID NO: 31470 - protein, 28 aa, Artificial Sequence
  Description of Artificial Sequence: Synthetic peptide
DPEEIRTTNPVATQQYGSVSTNDDPGER

SEQ ID NO: 31471 - protein, 28 aa, Artificial Sequence
  Description of Artificial Sequence: Synthetic peptide
DEEEIVTTNPVATEQYGSVSTGGNMGNS

SEQ ID NO: 31472 - protein, 28 aa, Artificial Sequence
  Description of Artificial Sequence: Synthetic peptide
HEQEIVTTNPVATEQFGSVSMNLQHGNR

SEQ ID NO: 31473 - protein, 30 aa, Artificial Sequence
  Description of Artificial Sequence: Synthetic polypeptide
NEEEIRTTNPVATEQYGSVSVTAIQAAGNR

SEQ ID NO: 31474 - protein, 29 aa, Artificial Sequence
  Description of Artificial Sequence: Synthetic peptide
DEEEIRTTNPCATEQYGDVSMNWQRGNDI

SEQ ID NO: 31475 - protein, 30 aa, Artificial Sequence
  Description of Artificial Sequence: Synthetic polypeptide
DEEEIRTTNPVATECWGDHVSTQLQRGNDR

SEQ ID NO: 31476 - protein, 28 aa, Artificial Sequence
  Description of Artificial Sequence: Synthetic peptide
DENEIRTTNPVATEQYGSVDTELCNGNT

SEQ ID NO: 31477 - protein, 28 aa, Artificial Sequence
  Description of Artificial Sequence: Synthetic peptide
DEEEIRCTNPVSTEQYGCVSMNLQRGET

SEQ ID NO: 31478 - protein, 28 aa, Artificial Sequence
  Description of Artificial Sequence: Synthetic peptide
DEEEIRTTNPVASEIYGCVAMNLERGNR

SEQ ID NO: 31479 - protein, 28 aa, Artificial Sequence
  Description of Artificial Sequence: Synthetic peptide
MENEIRATNPVATEQYGWVSDNLQRGER

SEQ ID NO: 31480 - protein, 28 aa, Artificial Sequence
  Description of Artificial Sequence: Synthetic peptide
GESEIRTVNPVATEQYGSVSTELEHGNR

SEQ ID NO: 31481 - protein, 30 aa, Artificial Sequence
  Description of Artificial Sequence: Synthetic polypeptide
DEGEIRTTNPVATEQYGSVSTNEPASRGNF

SEQ ID NO: 31482 - protein, 28 aa, Artificial Sequence
  Description of Artificial Sequence: Synthetic peptide
DCEEIRATNPVATMQYGSVSTNLSYGNF

SEQ ID NO: 31483 - protein, 30 aa, Artificial Sequence
  Description of Artificial Sequence: Synthetic polypeptide
DEEEISTTNPVATEQYGSHYSTILQNRENR

SEQ ID NO: 31484 - protein, 29 aa, Artificial Sequence
  Description of Artificial Sequence: Synthetic peptide
DEEEIRTTNPVATEQYGSVSENLQHQEEN

SEQ ID NO: 31485 - protein, 28 aa, Artificial Sequence
  Description of Artificial Sequence: Synthetic peptide
DESEIVTTNPVADEQWGSVSTNLQRGEN

SEQ ID NO: 31486 - protein, 28 aa, Artificial Sequence
  Description of Artificial Sequence: Synthetic peptide
DEQEIRTTNPVATELWGSVSTNEMRGNP

SEQ ID NO: 31487 - protein, 28 aa, Artificial Sequence
  Description of Artificial Sequence: Synthetic peptide
MEEEIDTTNPVATECYGAVSTNLQHGNE

SEQ ID NO: 31488 - protein, 31 aa, Artificial Sequence
  Description of Artificial Sequence: Synthetic polypeptide
DEEEIRPTNPVATEQYGSYVEDTNGQRGENR

SEQ ID NO: 31489 - protein, 28 aa, Artificial Sequence
  Description of Artificial Sequence: Synthetic peptide
KEEEIRTTNPVATEQYGEVSTNLQQPMM

SEQ ID NO: 31490 - protein, 28 aa, Artificial Sequence
  Description of Artificial Sequence: Synthetic peptide
SEEEIRTTNPVATEQYGSVSNGLERGDW

SEQ ID NO: 31491 - protein, 28 aa, Artificial Sequence
  Description of Artificial Sequence: Synthetic peptide
VEDEIRTTNPVATEQYGSVSDDLERGER

SEQ ID NO: 31492 - protein, 28 aa, Artificial Sequence
  Description of Artificial Sequence: Synthetic peptide
DEVEIATTNPVATEQYGSCGTNLQTGNF

SEQ ID NO: 31493 - protein, 28 aa, Artificial Sequence
  Description of Artificial Sequence: Synthetic peptide
DEQELRATNPVATEIYGSVAMNLQRGNR

SEQ ID NO: 31494 - protein, 28 aa, Artificial Sequence
  Description of Artificial Sequence: Synthetic peptide
DHEEIRTTNPVATEQYGSVWHNDDPGNR

SEQ ID NO: 31495 - protein, 31 aa, Artificial Sequence
  Description of Artificial Sequence: Synthetic polypeptide
DEECIRTTNPVATEQYWGSVSDTPLQERGER

SEQ ID NO: 31496 - protein, 28 aa, Artificial Sequence
  Description of Artificial Sequence: Synthetic peptide
DQEEIRTTNPVATESYGSVSASLGWGNR

SEQ ID NO: 31497 - protein, 29 aa, Artificial Sequence
  Description of Artificial Sequence: Synthetic peptide
DENEIRTTNPVATEQWGSVSENEQMRGNA

SEQ ID NO: 31498 - protein, 28 aa, Artificial Sequence
  Description of Artificial Sequence: Synthetic peptide
DEEEIRTTNPVATEQYGSVDTDLQMEEW

SEQ ID NO: 31499 - protein, 28 aa, Artificial Sequence
  Description of Artificial Sequence: Synthetic peptide
DEQEIRTTNPVATEQWGIVSENEQRGNS

SEQ ID NO: 31500 - protein, 28 aa, Artificial Sequence
  Description of Artificial Sequence: Synthetic peptide
DEEELATTNPVATECYGSTSTNLQHGER

SEQ ID NO: 31501 - protein, 31 aa, Artificial Sequence
  Description of Artificial Sequence: Synthetic polypeptide
DCEEIRTTNPVATEQYGSVWSTNLCNEGDNR

SEQ ID NO: 31502 - protein, 28 aa, Artificial Sequence
  Description of Artificial Sequence: Synthetic peptide
DEVEIRTTNPEATEQYGHVSTGLQVGNE

SEQ ID NO: 31503 - protein, 28 aa, Artificial Sequence
  Description of Artificial Sequence: Synthetic peptide
DEQEIRTTNPVATEQYGSVSTELETGEL

SEQ ID NO: 31504 - protein, 28 aa, Artificial Sequence
  Description of Artificial Sequence: Synthetic peptide
DENEIATTNPVATEVYGSASENLMRGNR

SEQ ID NO: 31505 - protein, 29 aa, Artificial Sequence
  Description of Artificial Sequence: Synthetic peptide
DEVEIRTTNPVATEQYGSVNTMNEQQGDR

SEQ ID NO: 31506 - protein, 29 aa, Artificial Sequence
  Description of Artificial Sequence: Synthetic peptide
QENEIATTNPVATEQYGEVSADNLQRGNR

SEQ ID NO: 31507 - protein, 29 aa, Artificial Sequence
  Description of Artificial Sequence: Synthetic peptide
QEQEIVTTNPVATEQYGEVSADNLQRGNR

SEQ ID NO: 31508 - protein, 28 aa, Artificial Sequence
  Description of Artificial Sequence: Synthetic peptide
AEHEIRTTNPVATEQYGSASTVLQHGGR

SEQ ID NO: 31509 - protein, 28 aa, Artificial Sequence
  Description of Artificial Sequence: Synthetic peptide
DDQEIRTTNPVATEQYGSVSTLLQFPNA

SEQ ID NO: 31510 - protein, 29 aa, Artificial Sequence
  Description of Artificial Sequence: Synthetic peptide
QEEEIATTNPVSTEQYGSASTNLQRAGGR

SEQ ID NO: 31511 - protein, 28 aa, Artificial Sequence
  Description of Artificial Sequence: Synthetic peptide
DEQEIATTNPVCTEQYGSVSTDLQHGNA

SEQ ID NO: 31512 - protein, 31 aa, Artificial Sequence
  Description of Artificial Sequence: Synthetic polypeptide
DEEEIRTTNPVATEQYGVVCSTALIQRGVNE

SEQ ID NO: 31513 - protein, 28 aa, Artificial Sequence
  Description of Artificial Sequence: Synthetic peptide
KENEIRTVNPVATEMYGVVSTNLQFGNR

SEQ ID NO: 31514 - protein, 28 aa, Artificial Sequence
  Description of Artificial Sequence: Synthetic peptide
DEQEIRTTNPVATEQYGSVSTADQMGGE

SEQ ID NO: 31515 - protein, 31 aa, Artificial Sequence
  Description of Artificial Sequence: Synthetic polypeptide
DEEMIRTTNPVATEQYGSVTSTCNLQAGNAG

SEQ ID NO: 31516 - protein, 29 aa, Artificial Sequence
  Description of Artificial Sequence: Synthetic peptide
DEQEIRTVNPVATEQYGAVSTNWQRNGTR

SEQ ID NO: 31517 - protein, 28 aa, Artificial Sequence
  Description of Artificial Sequence: Synthetic peptide
DESEIRTTNPTATELYGSVSEDLQRGND

SEQ ID NO: 31518 - protein, 30 aa, Artificial Sequence
  Description of Artificial Sequence: Synthetic polypeptide
DEQEIRCTNPVATEIYGCVSATNLQREGNR

SEQ ID NO: 31519 - protein, 32 aa, Artificial Sequence
  Description of Artificial Sequence: Synthetic polypeptide
DEEEIRTTNPVATEQYGSVDSETDLQNGDNDR

SEQ ID NO: 31520 - protein, 28 aa, Artificial Sequence
  Description of Artificial Sequence: Synthetic peptide
DEEEIATTNPVATECYGSVSTDLEMGER

SEQ ID NO: 31521 - protein, 28 aa, Artificial Sequence
  Description of Artificial Sequence: Synthetic peptide
DEENIRTTNPVATEQYGSVEYDLDGGNR

SEQ ID NO: 31522 - protein, 28 aa, Artificial Sequence
  Description of Artificial Sequence: Synthetic peptide
DENEIRSTNPVASEQYGVVSTDLQQGNR

SEQ ID NO: 31523 - protein, 28 aa, Artificial Sequence
  Description of Artificial Sequence: Synthetic peptide
DEEEIYTTNPVSTEQYGSVSTEPQLGNA

SEQ ID NO: 31524 - protein, 28 aa, Artificial Sequence
  Description of Artificial Sequence: Synthetic peptide
SEEELSTTNPTATETYGSVSTNLQRGNL

SEQ ID NO: 31525 - protein, 28 aa, Artificial Sequence
  Description of Artificial Sequence: Synthetic peptide
DEEGIRTTNPVSTEQYGSVVTNLIRENP

SEQ ID NO: 31526 - protein, 28 aa, Artificial Sequence
  Description of Artificial Sequence: Synthetic peptide
KEEEIRTTNPVATEQYGEVSENEQHGNN

SEQ ID NO: 31527 - protein, 28 aa, Artificial Sequence
  Description of Artificial Sequence: Synthetic peptide
DESEIRATNPVASEVYGSVGMNLQRGNR

SEQ ID NO: 31528 - protein, 32 aa, Artificial Sequence
  Description of Artificial Sequence: Synthetic polypeptide
DEEEIRTTNPVATEQYGSVSTIEPLQVRKGNV

SEQ ID NO: 31529 - protein, 28 aa, Artificial Sequence
  Description of Artificial Sequence: Synthetic peptide
DEQEICCTNPVATEVYGSVSTNLQVGNS

SEQ ID NO: 31530 - protein, 29 aa, Artificial Sequence
  Description of Artificial Sequence: Synthetic peptide
DEHEIRTTNPVATECYGSVSTNLESGNDL

SEQ ID NO: 31531 - protein, 30 aa, Artificial Sequence
  Description of Artificial Sequence: Synthetic polypeptide
DEEEIRCTNPSATEQYGSVSDMLQVRQGNR

SEQ ID NO: 31532 - protein, 31 aa, Artificial Sequence
  Description of Artificial Sequence: Synthetic polypeptide
DEEEIRTTNPVATEQYGSVETLNGDPQAGNR

SEQ ID NO: 31533 - protein, 28 aa, Artificial Sequence
  Description of Artificial Sequence: Synthetic peptide
SEEEIRTTNPTATEQFGSVSTNLQQGTE

SEQ ID NO: 31534 - protein, 28 aa, Artificial Sequence
  Description of Artificial Sequence: Synthetic peptide
GEEEIRTTNPCSTEIYGSVATNWQRGNR

SEQ ID NO: 31535 - protein, 29 aa, Artificial Sequence
  Description of Artificial Sequence: Synthetic peptide
DEQEIRCTNPVASEVYGAVSATNLQRGNR

SEQ ID NO: 31536 - protein, 31 aa, Artificial Sequence
  Description of Artificial Sequence: Synthetic polypeptide
DEEEIAQTNPVATEQYGVVSTNGLVQLRGNR

SEQ ID NO: 31537 - protein, 29 aa, Artificial Sequence
  Description of Artificial Sequence: Synthetic peptide
DEEEIRTTNPVATEQYGDVSENLCCHGNQ

SEQ ID NO: 31538 - protein, 28 aa, Artificial Sequence
  Description of Artificial Sequence: Synthetic peptide
DEEEIRTTNPVATEQYWSVETNLDDGEP

SEQ ID NO: 31539 - protein, 28 aa, Artificial Sequence
  Description of Artificial Sequence: Synthetic peptide
DEEEIRTTNPVATEQYGSVETDDELGNQ

SEQ ID NO: 31540 - protein, 32 aa, Artificial Sequence
  Description of Artificial Sequence: Synthetic polypeptide
DEEEIRTTNPVATEQYGSVSTANLPCRGDNCF

SEQ ID NO: 31541 - protein, 28 aa, Artificial Sequence
  Description of Artificial Sequence: Synthetic peptide
DEEEIRTTNPVATEQYGSVSTCQEMGDW

SEQ ID NO: 31542 - protein, 29 aa, Artificial Sequence
  Description of Artificial Sequence: Synthetic peptide
DENEIRTTNPVATEQYGGVSDENLQQLNR

SEQ ID NO: 31543 - protein, 28 aa, Artificial Sequence
  Description of Artificial Sequence: Synthetic peptide
DEQEIRTTNPVATEQYGSVSTEDERENI

SEQ ID NO: 31544 - protein, 31 aa, Artificial Sequence
  Description of Artificial Sequence: Synthetic polypeptide
DEEEIRTTNPFATEQYGSVNSCTNLNRENER

SEQ ID NO: 31545 - protein, 30 aa, Artificial Sequence
  Description of Artificial Sequence: Synthetic polypeptide
DEEEITTTNPVATEQYGSVSTELEPKGNAR

SEQ ID NO: 31546 - protein, 28 aa, Artificial Sequence
  Description of Artificial Sequence: Synthetic peptide
DEQEIATTNPVATEQYGSVSTELERGEL

SEQ ID NO: 31547 - protein, 31 aa, Artificial Sequence
  Description of Artificial Sequence: Synthetic polypeptide
DEEEIRTTNPVATEQYGSVDCTMNLCCRGND

SEQ ID NO: 31548 - protein, 28 aa, Artificial Sequence
  Description of Artificial Sequence: Synthetic peptide
EEMEITTTNPVATEQYGEVSSNLQRGPR

SEQ ID NO: 31549 - protein, 28 aa, Artificial Sequence
  Description of Artificial Sequence: Synthetic peptide
DEYEIRTTNPVACEQYGETSDNLQRGQR

SEQ ID NO: 31550 - protein, 29 aa, Artificial Sequence
  Description of Artificial Sequence: Synthetic peptide
MEEETRTVNPVATEQYGSVSTDLQIGNDR

SEQ ID NO: 31551 - protein, 29 aa, Artificial Sequence
  Description of Artificial Sequence: Synthetic peptide
DEEEIRSTNPVATEQYGTVSENVQRPGNL

SEQ ID NO: 31552 - protein, 30 aa, Artificial Sequence
  Description of Artificial Sequence: Synthetic polypeptide
SEEEIATTNPVATAQYGSSVETNGLQRGNR

SEQ ID NO: 31553 - protein, 28 aa, Artificial Sequence
  Description of Artificial Sequence: Synthetic peptide
DEEEIRATNPVATEQYGVVSTALETGNT

SEQ ID NO: 31554 - protein, 28 aa, Artificial Sequence
  Description of Artificial Sequence: Synthetic peptide
DEEEIRTTNPVAVEQYGDVSTGLNFGNE

SEQ ID NO: 31555 - protein, 31 aa, Artificial Sequence
  Description of Artificial Sequence: Synthetic polypeptide
DEVEIRTTNPVATEQYGSVCDTTNLQGNGNR

SEQ ID NO: 31556 - protein, 28 aa, Artificial Sequence
  Description of Artificial Sequence: Synthetic peptide
DEEEIMTTNPEATEQYGSVSTNVQRELH

SEQ ID NO: 31557 - protein, 32 aa, Artificial Sequence
  Description of Artificial Sequence: Synthetic polypeptide
DEEEIRTTNPVATEQYGSVSCEMDLQCRGNDR

SEQ ID NO: 31558 - protein, 28 aa, Artificial Sequence
  Description of Artificial Sequence: Synthetic peptide
DEEEIRCTNPVSTEQFGVVSANLQRGPR

SEQ ID NO: 31559 - protein, 28 aa, Artificial Sequence
  Description of Artificial Sequence: Synthetic peptide
DEEEVATTNPIAYEMYGSVSTNLQRGPR

SEQ ID NO: 31560 - protein, 28 aa, Artificial Sequence
  Description of Artificial Sequence: Synthetic peptide
YEEEITTTNPVATEQYGEVPTVLQRGNH

SEQ ID NO: 31561 - protein, 28 aa, Artificial Sequence
  Description of Artificial Sequence: Synthetic peptide
SEGEIATTNPVATEQFGSVSTNLQQGDR

SEQ ID NO: 31562 - protein, 28 aa, Artificial Sequence
  Description of Artificial Sequence: Synthetic peptide
DEEEIRTTNPVATEMFGEVSTDLQRGPI

SEQ ID NO: 31563 - protein, 28 aa, Artificial Sequence
  Description of Artificial Sequence: Synthetic peptide
DEEEIRTTNPVATELYGIVSTNEQQGTY

SEQ ID NO: 31564 - protein, 31 aa, Artificial Sequence
  Description of Artificial Sequence: Synthetic polypeptide
DEEEIRTTNPVATEQYGSVETNLVQVRGEDC

SEQ ID NO: 31565 - protein, 28 aa, Artificial Sequence
  Description of Artificial Sequence: Synthetic peptide
DEGEIRTTNPVATEQYGQVSTNWENGNH

SEQ ID NO: 31566 - protein, 28 aa, Artificial Sequence
  Description of Artificial Sequence: Synthetic peptide
DEQEVCTTNPVCTEQYGSVSTNLQNGNS

SEQ ID NO: 31567 - protein, 29 aa, Artificial Sequence
  Description of Artificial Sequence: Synthetic peptide
DEQEIRTTNPVATEIYGVVGTNLQRNGND

SEQ ID NO: 31568 - protein, 28 aa, Artificial Sequence
  Description of Artificial Sequence: Synthetic peptide
DENEIRTTNPVATEQWGSVSENEQQGNW

SEQ ID NO: 31569 - protein, 32 aa, Artificial Sequence
  Description of Artificial Sequence: Synthetic polypeptide
DEEEIRTTNPVATEQYGSVSCTMNLQCNGNDI

SEQ ID NO: 31570 - protein, 28 aa, Artificial Sequence
  Description of Artificial Sequence: Synthetic peptide
DENEIRTTNPVATEQWGSVSENEMRGNA

SEQ ID NO: 31571 - protein, 28 aa, Artificial Sequence
  Description of Artificial Sequence: Synthetic peptide
DEQEIRTTNPTATYQYGEVSTNLQQGDR

SEQ ID NO: 31572 - protein, 30 aa, Artificial Sequence
  Description of Artificial Sequence: Synthetic polypeptide
DEEEIRTTNPVATEQYGSVSVMNIQQRGDN

SEQ ID NO: 31573 - protein, 28 aa, Artificial Sequence
  Description of Artificial Sequence: Synthetic peptide
DEEEVRTTNPVATELYGSVSENDQQGND

SEQ ID NO: 31574 - protein, 28 aa, Artificial Sequence
  Description of Artificial Sequence: Synthetic peptide
DEEEIRCTNPVATEQYGEVSENLQVENS

SEQ ID NO: 31575 - protein, 28 aa, Artificial Sequence
  Description of Artificial Sequence: Synthetic peptide
NEEEVRSTNPVCSEQYGSVSMNLQRGNR

SEQ ID NO: 31576 - protein, 32 aa, Artificial Sequence
  Description of Artificial Sequence: Synthetic polypeptide
DEEEIRTTNPVATEQYGSVSTGLQLRNGENDC

SEQ ID NO: 31577 - protein, 28 aa, Artificial Sequence
  Description of Artificial Sequence: Synthetic peptide
DEEEIRTTNPCATEQYGSVSSEDCRGNH

SEQ ID NO: 31578 - protein, 28 aa, Artificial Sequence
  Description of Artificial Sequence: Synthetic peptide
DENEIRTTNPVATEQWGSVSENEQQGNA

SEQ ID NO: 31579 - protein, 28 aa, Artificial Sequence
  Description of Artificial Sequence: Synthetic peptide
DEEEIRTTNPVATEQWGSVSDNDMQGNS

SEQ ID NO: 31580 - protein, 30 aa, Artificial Sequence
  Description of Artificial Sequence: Synthetic polypeptide
SEVEIRTTNPVATEQYGSVSTNEQREGDNF

SEQ ID NO: 31581 - protein, 28 aa, Artificial Sequence
  Description of Artificial Sequence: Synthetic peptide
DENELWTTNPVATEQYGAASTNLQHGNR

SEQ ID NO: 31582 - protein, 28 aa, Artificial Sequence
  Description of Artificial Sequence: Synthetic peptide
TEEYIRTTNPVATEQYGSVSGNLQPDQR

SEQ ID NO: 31583 - protein, 28 aa, Artificial Sequence
  Description of Artificial Sequence: Synthetic peptide
DENEIRTTNPVATEQWGIVSENLMRGNA

SEQ ID NO: 31584 - protein, 28 aa, Artificial Sequence
  Description of Artificial Sequence: Synthetic peptide
DEEEIAATNPVSTEQYGGVSTNEQGGNR

SEQ ID NO: 31585 - protein, 28 aa, Artificial Sequence
  Description of Artificial Sequence: Synthetic peptide
DEEEIRTVNPCATENYGSVANNLLRGNR

SEQ ID NO: 31586 - protein, 32 aa, Artificial Sequence
  Description of Artificial Sequence: Synthetic polypeptide
DEEEIRTTNPVATEQYGESVDSTNPLQRGVDN

SEQ ID NO: 31587 - protein, 32 aa, Artificial Sequence
  Description of Artificial Sequence: Synthetic polypeptide
DEEEIRTTNPVATEQYGSVSTTELQIRKGENI

SEQ ID NO: 31588 - protein, 28 aa, Artificial Sequence
  Description of Artificial Sequence: Synthetic peptide
DEQEIRTTNPVATEQYGIVSMCLQRGEY

SEQ ID NO: 31589 - protein, 28 aa, Artificial Sequence
  Description of Artificial Sequence: Synthetic peptide
DEQEIAAVNPVATEVYGSVSTNLQHGNR

SEQ ID NO: 31590 - protein, 28 aa, Artificial Sequence
  Description of Artificial Sequence: Synthetic peptide
QEEEIRCTNPIATECFGSVSTNLQRGNF

SEQ ID NO: 31591 - protein, 28 aa, Artificial Sequence
  Description of Artificial Sequence: Synthetic peptide
DEEEITTTNPVATELYGTASTNLQTGNQ

SEQ ID NO: 31592 - protein, 28 aa, Artificial Sequence
  Description of Artificial Sequence: Synthetic peptide
DEQEIRTTNPVATEQYGSVETPLEREER

SEQ ID NO: 31593 - protein, 28 aa, Artificial Sequence
  Description of Artificial Sequence: Synthetic peptide
MEEEIRTTNPVATENYGDISTNLQGENR

SEQ ID NO: 31594 - protein, 31 aa, Artificial Sequence
  Description of Artificial Sequence: Synthetic polypeptide
DEEEIRTTNPVATEQYGSVDATNNLVQMGER

SEQ ID NO: 31595 - protein, 28 aa, Artificial Sequence
  Description of Artificial Sequence: Synthetic peptide
GDCEITTTNPIATEQWGSVSTNLQRGNR

SEQ ID NO: 31596 - protein, 31 aa, Artificial Sequence
  Description of Artificial Sequence: Synthetic polypeptide
HEEEIRTTNCVATEQWGSVSQTNLQRLGSNR

SEQ ID NO: 31597 - protein, 28 aa, Artificial Sequence
  Description of Artificial Sequence: Synthetic peptide
KENEIWTTNPVATEQYGSVSDNLQRENK

SEQ ID NO: 31598 - protein, 28 aa, Artificial Sequence
  Description of Artificial Sequence: Synthetic peptide
YESEIRTTNPVSTEQYGDVSTALQNGNR

SEQ ID NO: 31599 - protein, 31 aa, Artificial Sequence
  Description of Artificial Sequence: Synthetic polypeptide
DEEEIRTTNPVSTEQYGSVAESNLQRNGENR

SEQ ID NO: 31600 - protein, 32 aa, Artificial Sequence
  Description of Artificial Sequence: Synthetic polypeptide
DEEEIRTTNPVATEQYGSVSETNPLVQNGDDR

SEQ ID NO: 31601 - protein, 28 aa, Artificial Sequence
  Description of Artificial Sequence: Synthetic peptide
VEEEIHPTNPVATEQWGSVSTPLQRGNP

SEQ ID NO: 31602 - protein, 29 aa, Artificial Sequence
  Description of Artificial Sequence: Synthetic peptide
DEQEITTTNPCATEQYGSVSCTNLCQGNR

SEQ ID NO: 31603 - protein, 28 aa, Artificial Sequence
  Description of Artificial Sequence: Synthetic peptide
DDEEVRTTNPVATEQYGSVATDVQRGAR

SEQ ID NO: 31604 - protein, 28 aa, Artificial Sequence
  Description of Artificial Sequence: Synthetic peptide
DEEEISTTNPVATEQYGSVSTNCPRDEK

SEQ ID NO: 31605 - protein, 28 aa, Artificial Sequence
  Description of Artificial Sequence: Synthetic peptide
NEEEITTVNPVATEMYGTVSTNLQRGNQ

SEQ ID NO: 31606 - protein, 28 aa, Artificial Sequence
  Description of Artificial Sequence: Synthetic peptide
QEEEIATTNPCATEQYGIVSTNLQSGTR

SEQ ID NO: 31607 - protein, 28 aa, Artificial Sequence
  Description of Artificial Sequence: Synthetic peptide
DEEEIRTTNPVSTEWWGSVSTNLMRGTM

SEQ ID NO: 31608 - protein, 30 aa, Artificial Sequence
  Description of Artificial Sequence: Synthetic polypeptide
DENEIRTTNPVATEQYGSVSATDLQHGEDR

SEQ ID NO: 31609 - protein, 29 aa, Artificial Sequence
  Description of Artificial Sequence: Synthetic peptide
MEEEIMTTNPVATEQYGNVSVTMLQGGNR

SEQ ID NO: 31610 - protein, 28 aa, Artificial Sequence
  Description of Artificial Sequence: Synthetic peptide
DEEEIRTTNPVATEQWGSVSTNEMIGDQ

SEQ ID NO: 31611 - protein, 28 aa, Artificial Sequence
  Description of Artificial Sequence: Synthetic peptide
DEEEIRTTNPVATEQYGSVDENDQQGEM

SEQ ID NO: 31612 - protein, 30 aa, Artificial Sequence
  Description of Artificial Sequence: Synthetic polypeptide
DEEEIRTTNPVATECYGSYSTNEQNRAGNA

SEQ ID NO: 31613 - protein, 28 aa, Artificial Sequence
  Description of Artificial Sequence: Synthetic peptide
REEEIYTVNPVATEQYGTVSTNVQHGNR

SEQ ID NO: 31614 - protein, 28 aa, Artificial Sequence
  Description of Artificial Sequence: Synthetic peptide
VEEEIETTNPVATEQWGFVCTNLQRGPR

SEQ ID NO: 31615 - protein, 28 aa, Artificial Sequence
  Description of Artificial Sequence: Synthetic peptide
RESEIRTTNPVATEQYGSVSTNIQYGGQ

SEQ ID NO: 31616 - protein, 30 aa, Artificial Sequence
  Description of Artificial Sequence: Synthetic polypeptide
DEEEIRTTNPVATEQYGAVATPLQVRGIDR

SEQ ID NO: 31617 - protein, 28 aa, Artificial Sequence
  Description of Artificial Sequence: Synthetic peptide
QEEEIRATNPVSTEQYGDVSTLTQRGNR

SEQ ID NO: 31618 - protein, 28 aa, Artificial Sequence
  Description of Artificial Sequence: Synthetic peptide
NEMEIRTTNPVATEQYGSVSTALEYGNM

SEQ ID NO: 31619 - protein, 28 aa, Artificial Sequence
  Description of Artificial Sequence: Synthetic peptide
DEEEIRATNPVSTEQFGSVSANLQGGTR

SEQ ID NO: 31620 - protein, 29 aa, Artificial Sequence
  Description of Artificial Sequence: Synthetic peptide
QEEEVRTTNPVATEQYGSVSDNGPQTGNR

SEQ ID NO: 31621 - protein, 28 aa, Artificial Sequence
  Description of Artificial Sequence: Synthetic peptide
DEGEIRTTNPVATESYGSISTNPQGGNQ

SEQ ID NO: 31622 - protein, 28 aa, Artificial Sequence
  Description of Artificial Sequence: Synthetic peptide
DEGEIRCTNPVATEIYGSVSVNLQFGPR

SEQ ID NO: 31623 - protein, 28 aa, Artificial Sequence
  Description of Artificial Sequence: Synthetic peptide
DEEEVACTNPFATEQYGSVSTNLQRGGI

SEQ ID NO: 31624 - protein, 30 aa, Artificial Sequence
  Description of Artificial Sequence: Synthetic polypeptide
SDEEIRTTNPVATECYGIVSTTNLQRNGNR

SEQ ID NO: 31625 - protein, 32 aa, Artificial Sequence
  Description of Artificial Sequence: Synthetic polypeptide
DEEEIRTTNPVATEQYGSVSCEMNLQCRGNDS

SEQ ID NO: 31626 - protein, 32 aa, Artificial Sequence
  Description of Artificial Sequence: Synthetic polypeptide
DEEEIRTTNPVATEQYGSVDSETNLQDDGENS

SEQ ID NO: 31627 - protein, 28 aa, Artificial Sequence
  Description of Artificial Sequence: Synthetic peptide
DEEEIRTTNPVATEQYGSVETEDDPGND

SEQ ID NO: 31628 - protein, 31 aa, Artificial Sequence
  Description of Artificial Sequence: Synthetic polypeptide
DEEEIRTTNPVATEQYGSVSTNPEQRKGEDA

SEQ ID NO: 31629 - protein, 28 aa, Artificial Sequence
  Description of Artificial Sequence: Synthetic peptide
GESEIRSTNPVATEQYGSVSMNDQQGNR

SEQ ID NO: 31630 - protein, 28 aa, Artificial Sequence
  Description of Artificial Sequence: Synthetic peptide
DEECIRTTNPVATEQYGDVDENLERGNN

SEQ ID NO: 31631 - protein, 28 aa, Artificial Sequence
  Description of Artificial Sequence: Synthetic peptide
DESEVTTTNPVATEQYGSVSMNLQSGNS

SEQ ID NO: 31632 - protein, 28 aa, Artificial Sequence
  Description of Artificial Sequence: Synthetic peptide
DEIEIGTTNPVATEQYGQVSTELQYGNH

SEQ ID NO: 31633 - protein, 29 aa, Artificial Sequence
  Description of Artificial Sequence: Synthetic peptide
DEVEIRQTNPVSTEQYGSVSTQLQRAGNM

SEQ ID NO: 31634 - protein, 31 aa, Artificial Sequence
  Description of Artificial Sequence: Synthetic polypeptide
DEEEIRTTNPVATEQYGDVSCEMNLQRGNDH

SEQ ID NO: 31635 - protein, 28 aa, Artificial Sequence
  Description of Artificial Sequence: Synthetic peptide
DEQEIATTNPVATEQYGTVSENLQNGNM

SEQ ID NO: 31636 - protein, 28 aa, Artificial Sequence
  Description of Artificial Sequence: Synthetic peptide
DEEEIRSVNPVATEIYGVVATNLQRGNY

SEQ ID NO: 31637 - protein, 28 aa, Artificial Sequence
  Description of Artificial Sequence: Synthetic peptide
DEEEIRTTNPEATEQYGSVSTEDDEGNF

SEQ ID NO: 31638 - protein, 29 aa, Artificial Sequence
  Description of Artificial Sequence: Synthetic peptide
AEEEIRTTNPVATELYGSVSENGLIRGND

SEQ ID NO: 31639 - protein, 31 aa, Artificial Sequence
  Description of Artificial Sequence: Synthetic polypeptide
DEEEINTTNPYATEQYGSVSITNPLTQRGNI

SEQ ID NO: 31640 - protein, 31 aa, Artificial Sequence
  Description of Artificial Sequence: Synthetic polypeptide
DEEEIRTTNPVATEQYGSVSCTMELQCLGNC

SEQ ID NO: 31641 - protein, 28 aa, Artificial Sequence
  Description of Artificial Sequence: Synthetic peptide
DEEEIRTTNPACTEQFGTVSTNPQLGNR

SEQ ID NO: 31642 - protein, 28 aa, Artificial Sequence
  Description of Artificial Sequence: Synthetic peptide
DEEEIRTTNPEATDQYGSVSTNLQLEFL

SEQ ID NO: 31643 - protein, 28 aa, Artificial Sequence
  Description of Artificial Sequence: Synthetic peptide
DDSEIVTTNPVATEWYGSVGTNLQRGNI

SEQ ID NO: 31644 - protein, 28 aa, Artificial Sequence
  Description of Artificial Sequence: Synthetic peptide
DEQEISTTNPVATECWGSVSTNLMRGNA

SEQ ID NO: 31645 - protein, 28 aa, Artificial Sequence
  Description of Artificial Sequence: Synthetic peptide
DEEEIATTNPVATECYGVVSENLQTGER

SEQ ID NO: 31646 - protein, 28 aa, Artificial Sequence
  Description of Artificial Sequence: Synthetic peptide
DESEIRSTNPVATECYGSVSADLQRGNY

SEQ ID NO: 31647 - protein, 31 aa, Artificial Sequence
  Description of Artificial Sequence: Synthetic polypeptide
DEEEIRTTNPVATEQYGSVSTGNGPQVGENL

SEQ ID NO: 31648 - protein, 28 aa, Artificial Sequence
  Description of Artificial Sequence: Synthetic peptide
DEQEIRTTNPIATEIFGCVSNNLQRGNR

SEQ ID NO: 31649 - protein, 29 aa, Artificial Sequence
  Description of Artificial Sequence: Synthetic peptide
GEEEIRTTNPVSTETYGSVSVTDLQRGNL

SEQ ID NO: 31650 - protein, 28 aa, Artificial Sequence
  Description of Artificial Sequence: Synthetic peptide
DEEEIRTVNPVASEHYGGVSNNLQRGNQ

SEQ ID NO: 31651 - protein, 28 aa, Artificial Sequence
  Description of Artificial Sequence: Synthetic peptide
DEVEIATTNPTATEQYGSVSTNEQVGNG

SEQ ID NO: 31652 - protein, 28 aa, Artificial Sequence
  Description of Artificial Sequence: Synthetic peptide
DEQEIRTTNPVATEQWGSVSDNEMRGNA

SEQ ID NO: 31653 - protein, 29 aa, Artificial Sequence
  Description of Artificial Sequence: Synthetic peptide
DEIEIATTNPVATEMYGSVSDVNLQHGNR

SEQ ID NO: 31654 - protein, 28 aa, Artificial Sequence
  Description of Artificial Sequence: Synthetic peptide
GEEEIRTTNPVATEMYGVVSTDLQIGNT

SEQ ID NO: 31655 - protein, 29 aa, Artificial Sequence
  Description of Artificial Sequence: Synthetic peptide
DEEEIRSTNPTATEHYGSVSTNLQHKGNF

SEQ ID NO: 31656 - protein, 28 aa, Artificial Sequence
  Description of Artificial Sequence: Synthetic peptide
DEEEIRTTNPFATEQYGSVSTCGLGGNS

SEQ ID NO: 31657 - protein, 29 aa, Artificial Sequence
  Description of Artificial Sequence: Synthetic peptide
MEEEIATVNPVATEQYGSVSTNLQREGDC

SEQ ID NO: 31658 - protein, 28 aa, Artificial Sequence
  Description of Artificial Sequence: Synthetic peptide
DEVEIRATNPVATECFGSVSTNLQRGDF

SEQ ID NO: 31659 - protein, 29 aa, Artificial Sequence
  Description of Artificial Sequence: Synthetic peptide
DENEIRTTNPVATEQYGSAPENLQHAGNR

SEQ ID NO: 31660 - protein, 28 aa, Artificial Sequence
  Description of Artificial Sequence: Synthetic peptide
DEEEIRQTNPVATEGYGEVSTNLMHGNK

SEQ ID NO: 31661 - protein, 28 aa, Artificial Sequence
  Description of Artificial Sequence: Synthetic peptide
DEEEIRTTNPAATECFGSVSTNWQRGTA

SEQ ID NO: 31662 - protein, 30 aa, Artificial Sequence
  Description of Artificial Sequence: Synthetic polypeptide
SEGEIRTTNPTATEMYGSVISTNLQDRGNR

SEQ ID NO: 31663 - protein, 28 aa, Artificial Sequence
  Description of Artificial Sequence: Synthetic peptide
DEEEIAATNPTATEQYGGVSTNLQQGTR

SEQ ID NO: 31664 - protein, 28 aa, Artificial Sequence
  Description of Artificial Sequence: Synthetic peptide
DEQEIRTTNPDATEQYGSVSTPDQREER

SEQ ID NO: 31665 - protein, 28 aa, Artificial Sequence
  Description of Artificial Sequence: Synthetic peptide
DENEIATTNPVASEQYGSMATNLDRGNR

SEQ ID NO: 31666 - protein, 28 aa, Artificial Sequence
  Description of Artificial Sequence: Synthetic peptide
DEEEIRTTNPCATEQYGSVDTNEEAGNF

SEQ ID NO: 31667 - protein, 28 aa, Artificial Sequence
  Description of Artificial Sequence: Synthetic peptide
DEEEICTTNPVCTEIYGSVSVALQTGNR

SEQ ID NO: 31668 - protein, 28 aa, Artificial Sequence
  Description of Artificial Sequence: Synthetic peptide
DEEEIRTTNPVATECWGSVSTNEMIGNL

SEQ ID NO: 31669 - protein, 28 aa, Artificial Sequence
  Description of Artificial Sequence: Synthetic peptide
SEEEIRPTNPCATEQYGVVDTNLQRGNA

SEQ ID NO: 31670 - protein, 28 aa, Artificial Sequence
  Description of Artificial Sequence: Synthetic peptide
AEEEIKSTNPTATEQYGSVSTNEQRGNF

SEQ ID NO: 31671 - protein, 28 aa, Artificial Sequence
  Description of Artificial Sequence: Synthetic peptide
DENEIRTTNPVATEQYGTMSTDLQLGNL

SEQ ID NO: 31672 - protein, 28 aa, Artificial Sequence
  Description of Artificial Sequence: Synthetic peptide
DEEEIRTTNPEATEQYGSVETPLQVGED

SEQ ID NO: 31673 - protein, 28 aa, Artificial Sequence
  Description of Artificial Sequence: Synthetic peptide
DEQEIRTTNPVATEQYGQVSTNGNMGNS

SEQ ID NO: 31674 - protein, 30 aa, Artificial Sequence
  Description of Artificial Sequence: Synthetic polypeptide
DEEEIRCTNPVATEIYGVVSEMNLQRNGNR

SEQ ID NO: 31675 - protein, 31 aa, Artificial Sequence
  Description of Artificial Sequence: Synthetic polypeptide
DEEEIRTTNPVATEQYGSVSCTMDLQAGNDI

SEQ ID NO: 31676 - protein, 31 aa, Artificial Sequence
  Description of Artificial Sequence: Synthetic polypeptide
DENEIRTTNPVATECYGSVSATNLQDREGNL

SEQ ID NO: 31677 - protein, 30 aa, Artificial Sequence
  Description of Artificial Sequence: Synthetic polypeptide
DEEEIRTTNPVATEQYGTWSTINPLQRENN

SEQ ID NO: 31678 - protein, 29 aa, Artificial Sequence
  Description of Artificial Sequence: Synthetic peptide
QEEEIRCTNPVCTEQYGSVSTNLQEGDNT

SEQ ID NO: 31679 - protein, 28 aa, Artificial Sequence
  Description of Artificial Sequence: Synthetic peptide
QEDEIRTTNPVATEGYGSVSENCQRGER

SEQ ID NO: 31680 - protein, 28 aa, Artificial Sequence
  Description of Artificial Sequence: Synthetic peptide
DEQEIAATNPVSTEVYGTVSTNLQRGNR

SEQ ID NO: 31681 - protein, 31 aa, Artificial Sequence
  Description of Artificial Sequence: Synthetic polypeptide
DEEEIRTTNPVATECYGVVSDTENLQRGDNL

SEQ ID NO: 31682 - protein, 30 aa, Artificial Sequence
  Description of Artificial Sequence: Synthetic polypeptide
DEEEIVTTNPVATEQYGSVSTGDQIRGDNY

SEQ ID NO: 31683 - protein, 29 aa, Artificial Sequence
  Description of Artificial Sequence: Synthetic peptide
SEEEIRTTNPVSTEIYGSVDTNLQGGNDR

SEQ ID NO: 31684 - protein, 28 aa, Artificial Sequence
  Description of Artificial Sequence: Synthetic peptide
DEAEIRATNPVATEGYGEVCMNLQRGNR

SEQ ID NO: 31685 - protein, 28 aa, Artificial Sequence
  Description of Artificial Sequence: Synthetic peptide
DENEIRTTNPVATECYGSVSENGQREER

SEQ ID NO: 31686 - protein, 28 aa, Artificial Sequence
  Description of Artificial Sequence: Synthetic peptide
DEQEIATTNPVATECYGSTSTNLQHGND

SEQ ID NO: 31687 - protein, 28 aa, Artificial Sequence
  Description of Artificial Sequence: Synthetic peptide
KEEEIRTVNPVATECYGSVSDDLQRGNM

SEQ ID NO: 31688 - protein, 30 aa, Artificial Sequence
  Description of Artificial Sequence: Synthetic polypeptide
DENEIRTTNPVATEQFGSVSTNGEQRGTDR

SEQ ID NO: 31689 - protein, 30 aa, Artificial Sequence
  Description of Artificial Sequence: Synthetic polypeptide
DEEEIRTTNPVATEQYGVVSTPLVYDRGNM

SEQ ID NO: 31690 - protein, 28 aa, Artificial Sequence
  Description of Artificial Sequence: Synthetic peptide
MEQEIRTTNPVATEQYGSVATDLQVGNM

SEQ ID NO: 31691 - protein, 28 aa, Artificial Sequence
  Description of Artificial Sequence: Synthetic peptide
DENEIVQTNPVASEHYGSVSTNLQRGNQ

SEQ ID NO: 31692 - protein, 28 aa, Artificial Sequence
  Description of Artificial Sequence: Synthetic peptide
DEQEIATTNPVATECYGSVATNLQSGNQ

SEQ ID NO: 31693 - protein, 28 aa, Artificial Sequence
  Description of Artificial Sequence: Synthetic peptide
DEEEIRCTNPVATEQYGDVSTDPQPGNY

SEQ ID NO: 31694 - protein, 33 aa, Artificial Sequence
  Description of Artificial Sequence: Synthetic polypeptide
DEEEIRTTNPVATEQYGSYVESTNDVQPRGTNR

SEQ ID NO: 31695 - protein, 28 aa, Artificial Sequence
  Description of Artificial Sequence: Synthetic peptide
DECEIMTTNPVSTEQYGSVSDQLQGGNR

SEQ ID NO: 31696 - protein, 28 aa, Artificial Sequence
  Description of Artificial Sequence: Synthetic peptide
SEEEIRTTNPVSTEQYGVVSVDDQRGNR

SEQ ID NO: 31697 - protein, 28 aa, Artificial Sequence
  Description of Artificial Sequence: Synthetic peptide
CENEIRTTNPVATECYGDVSTNLQHGNF

SEQ ID NO: 31698 - protein, 28 aa, Artificial Sequence
  Description of Artificial Sequence: Synthetic peptide
KEREISCTNPVATEQYGSCSENLQRGNR

SEQ ID NO: 31699 - protein, 28 aa, Artificial Sequence
  Description of Artificial Sequence: Synthetic peptide
DEEEVRTTNPVATEIYGSVSNNLEPPNR

SEQ ID NO: 31700 - protein, 30 aa, Artificial Sequence
  Description of Artificial Sequence: Synthetic polypeptide
DEEEIRTTNPVSTEQYGSVFTGNLQQGGNG

SEQ ID NO: 31701 - protein, 28 aa, Artificial Sequence
  Description of Artificial Sequence: Synthetic peptide
DEEEIRSVNPVATEQYGACATNLQRGNF

SEQ ID NO: 31702 - protein, 29 aa, Artificial Sequence
  Description of Artificial Sequence: Synthetic peptide
DEDEIATTNPVASEQYGTVSTALQRGENR

SEQ ID NO: 31703 - protein, 28 aa, Artificial Sequence
  Description of Artificial Sequence: Synthetic peptide
SEEEIRATNPTATEQFGSVSTNLQHGNT

SEQ ID NO: 31704 - protein, 33 aa, Artificial Sequence
  Description of Artificial Sequence: Synthetic polypeptide
DEEEIRTTNPVATEQYGESVDETNPLQRKGNPR

SEQ ID NO: 31705 - protein, 28 aa, Artificial Sequence
  Description of Artificial Sequence: Synthetic peptide
MEEEIRTTNPVATECYGSVSENLQYGDY

SEQ ID NO: 31706 - protein, 29 aa, Artificial Sequence
  Description of Artificial Sequence: Synthetic peptide
DEQEIWTTNPVATEQYGVASENLQRIGNR

SEQ ID NO: 31707 - protein, 28 aa, Artificial Sequence
  Description of Artificial Sequence: Synthetic peptide
TEEEIGTTNPVATEQYGEYTTNLQRGDR

SEQ ID NO: 31708 - protein, 28 aa, Artificial Sequence
  Description of Artificial Sequence: Synthetic peptide
DEEEVRTTNPCATEIYGVVAMNLQRGNR

SEQ ID NO: 31709 - protein, 28 aa, Artificial Sequence
  Description of Artificial Sequence: Synthetic peptide
SEEEIRCTNPTATEQYGSVSTDLQQGNH

SEQ ID NO: 31710 - protein, 28 aa, Artificial Sequence
  Description of Artificial Sequence: Synthetic peptide
SDEEIRSTNPVATEWYGSVSTNLEQGNR

SEQ ID NO: 31711 - protein, 28 aa, Artificial Sequence
  Description of Artificial Sequence: Synthetic peptide
SEDEIATTNPVATECFGSVSTNWQRGNR

SEQ ID NO: 31712 - protein, 28 aa, Artificial Sequence
  Description of Artificial Sequence: Synthetic peptide
KENEIRTTNPVATEQYGSVSYDLQSGNM

SEQ ID NO: 31713 - protein, 31 aa, Artificial Sequence
  Description of Artificial Sequence: Synthetic polypeptide
DEQEIRTTNPVATEQYGSVSDTNLERDGDNP

SEQ ID NO: 31714 - protein, 28 aa, Artificial Sequence
  Description of Artificial Sequence: Synthetic peptide
AEQEIRTTNPVATEQYGVVSTNQQFGNW

SEQ ID NO: 31715 - protein, 28 aa, Artificial Sequence
  Description of Artificial Sequence: Synthetic peptide
DEEEIRTTNPVAHEQYGEVSENDQHGNQ

SEQ ID NO: 31716 - protein, 31 aa, Artificial Sequence
  Description of Artificial Sequence: Synthetic polypeptide
DEQEIRTTNPVATESYGSVSDENLQRNGNER

SEQ ID NO: 31717 - protein, 28 aa, Artificial Sequence
  Description of Artificial Sequence: Synthetic peptide
DEEEIRTTNPFATEQYGSVSTGPYQGNF

SEQ ID NO: 31718 - protein, 28 aa, Artificial Sequence
  Description of Artificial Sequence: Synthetic peptide
DEEEIATVNPVATESYGTVSTNLQNGNA

SEQ ID NO: 31719 - protein, 29 aa, Artificial Sequence
  Description of Artificial Sequence: Synthetic peptide
DEEEIATTNPVATEQYGEVSTVCQQRGER

SEQ ID NO: 31720 - protein, 28 aa, Artificial Sequence
  Description of Artificial Sequence: Synthetic peptide
DEVEIATTNPTATEQYGSVSTNPQHGNF

SEQ ID NO: 31721 - protein, 28 aa, Artificial Sequence
  Description of Artificial Sequence: Synthetic peptide
SEEEIRTTNPVATECFGSVSTNEQFGNS

SEQ ID NO: 31722 - protein, 31 aa, Artificial Sequence
  Description of Artificial Sequence: Synthetic polypeptide
SEEEIRTTNPVATEQYGSVSTAGLQASGNDR

SEQ ID NO: 31723 - protein, 31 aa, Artificial Sequence
  Description of Artificial Sequence: Synthetic polypeptide
DEEEIRQTNPVATEQYGSVSTCNDVQIGNDR

SEQ ID NO: 31724 - protein, 31 aa, Artificial Sequence
  Description of Artificial Sequence: Synthetic polypeptide
DEEEIRTTNPVATEQYGSYVSTPNDVEPGNR

SEQ ID NO: 31725 - protein, 28 aa, Artificial Sequence
  Description of Artificial Sequence: Synthetic peptide
DEQEISQTNPVATEQYGAVATNLQRGDR

SEQ ID NO: 31726 - protein, 29 aa, Artificial Sequence
  Description of Artificial Sequence: Synthetic peptide
DENEIRTTNPVATEQYGSMSTDLQDLGNF

SEQ ID NO: 31727 - protein, 33 aa, Artificial Sequence
  Description of Artificial Sequence: Synthetic polypeptide
DEEEIRTTNPVATEQYWGCSVESTNDQERGNPR

SEQ ID NO: 31728 - protein, 28 aa, Artificial Sequence
  Description of Artificial Sequence: Synthetic peptide
AEQEITCTNPVATEVYGVVSTNLQRGNR

SEQ ID NO: 31729 - protein, 29 aa, Artificial Sequence
  Description of Artificial Sequence: Synthetic peptide
DEQEIRTTNPVATEQYGSVSMNLQTHGDL

SEQ ID NO: 31730 - protein, 30 aa, Artificial Sequence
  Description of Artificial Sequence: Synthetic polypeptide
DEVEIRATNPVATETYGSVISTNLQDRGNF

SEQ ID NO: 31731 - protein, 29 aa, Artificial Sequence
  Description of Artificial Sequence: Synthetic peptide
DEEEIRTTNPVATEQWGSVSENEQMQGNA

SEQ ID NO: 31732 - protein, 29 aa, Artificial Sequence
  Description of Artificial Sequence: Synthetic peptide
SEEEIAATNPVATEMYGSVSTMNEQRGNR

SEQ ID NO: 31733 - protein, 28 aa, Artificial Sequence
  Description of Artificial Sequence: Synthetic peptide
DEEEIRQTNPVATEQYGSVSTEDQAGET

SEQ ID NO: 31734 - protein, 30 aa, Artificial Sequence
  Description of Artificial Sequence: Synthetic polypeptide
DEEEIRTTNPVATEMYGSISTNLDRKGHNE

SEQ ID NO: 31735 - protein, 34 aa, Artificial Sequence
  Description of Artificial Sequence: Synthetic polypeptide
DEEEIRTTNPVATEAQYGMSVSQTNLQRKGLNTR

SEQ ID NO: 31736 - protein, 28 aa, Artificial Sequence
  Description of Artificial Sequence: Synthetic peptide
SEVEIATTNPVATEQYGSVSENLQNGNA

SEQ ID NO: 31737 - protein, 28 aa, Artificial Sequence
  Description of Artificial Sequence: Synthetic peptide
NEEEIRTTNPCCTEQYGTASTNLQRGNI

SEQ ID NO: 31738 - protein, 28 aa, Artificial Sequence
  Description of Artificial Sequence: Synthetic peptide
KENEIRTTNPVATEQYGSVSDDLQNGNM

SEQ ID NO: 31739 - protein, 28 aa, Artificial Sequence
  Description of Artificial Sequence: Synthetic peptide
KEAEIRCTNPVATEQYGSASDNWQRGNR

SEQ ID NO: 31740 - protein, 28 aa, Artificial Sequence
  Description of Artificial Sequence: Synthetic peptide
GEEEIRTTNPVATEQYGTVSMALQTGDR

SEQ ID NO: 31741 - protein, 28 aa, Artificial Sequence
  Description of Artificial Sequence: Synthetic peptide
DEAEITTTNPVATEQYGTVSTDLQRENL

SEQ ID NO: 31742 - protein, 28 aa, Artificial Sequence
  Description of Artificial Sequence: Synthetic peptide
DEEEIATTNPVATEQYGSASEDEQRGNM

SEQ ID NO: 31743 - protein, 28 aa, Artificial Sequence
  Description of Artificial Sequence: Synthetic peptide
DEMEIRTTNPVATEQYGDTSENLQMGTR

SEQ ID NO: 31744 - protein, 28 aa, Artificial Sequence
  Description of Artificial Sequence: Synthetic peptide
SEEEIRTTNPTATEQFGSVSTNEQIGTR

SEQ ID NO: 31745 - protein, 29 aa, Artificial Sequence
  Description of Artificial Sequence: Synthetic peptide
DEDEIATTNPVCTEQYGSVSEMNLQQGNR

SEQ ID NO: 31746 - protein, 28 aa, Artificial Sequence
  Description of Artificial Sequence: Synthetic peptide
DEEEIRTTNPEATEQYGSVSDNEEHGND

SEQ ID NO: 31747 - protein, 28 aa, Artificial Sequence
  Description of Artificial Sequence: Synthetic peptide
DEEEIRTTNPVCTEQYGAVSMDLQNGNL

SEQ ID NO: 31748 - protein, 28 aa, Artificial Sequence
  Description of Artificial Sequence: Synthetic peptide
DEEEIRTTNPVATEQYGSVETEDEIGNW

SEQ ID NO: 31749 - protein, 28 aa, Artificial Sequence
  Description of Artificial Sequence: Synthetic peptide
DEEEIRTTNPVATECWGSVSENLMTGNF

SEQ ID NO: 31750 - protein, 28 aa, Artificial Sequence
  Description of Artificial Sequence: Synthetic peptide
AEAEIRATNPVCTEMYGSVSTNLQRGPR

SEQ ID NO: 31751 - protein, 29 aa, Artificial Sequence
  Description of Artificial Sequence: Synthetic peptide
DENEIRTTNPVATEQWGSVSTNLMMQGNA

SEQ ID NO: 31752 - protein, 28 aa, Artificial Sequence
  Description of Artificial Sequence: Synthetic peptide
DEEEIRTTNPVASELYGCVAMNLERGNR

SEQ ID NO: 31753 - protein, 28 aa, Artificial Sequence
  Description of Artificial Sequence: Synthetic peptide
QEEEIRTTNPVATYQYGSVSEVLQGGNN

SEQ ID NO: 31754 - protein, 28 aa, Artificial Sequence
  Description of Artificial Sequence: Synthetic peptide
DEECIRTTNPVATECYWSWSHNLQDGNR

SEQ ID NO: 31755 - protein, 28 aa, Artificial Sequence
  Description of Artificial Sequence: Synthetic peptide
DEEEIRTTNPVATQHYGFVSYNLQEFNR

SEQ ID NO: 31756 - protein, 28 aa, Artificial Sequence
  Description of Artificial Sequence: Synthetic peptide
DESEIRATNPVATENFGVVSNNLQRGNR

SEQ ID NO: 31757 - protein, 28 aa, Artificial Sequence
  Description of Artificial Sequence: Synthetic peptide
DEEEIRATNPVATECYGCVSTNLQVLNN

SEQ ID NO: 31758 - protein, 28 aa, Artificial Sequence
  Description of Artificial Sequence: Synthetic peptide
DEEEIRTCNPVATEVFGSVSVNGQRGNA

SEQ ID NO: 31759 - protein, 28 aa, Artificial Sequence
  Description of Artificial Sequence: Synthetic peptide
DEEEIATTNPTATEMYGEVSTLLQRENR

SEQ ID NO: 31760 - protein, 31 aa, Artificial Sequence
  Description of Artificial Sequence: Synthetic polypeptide
DEEEIRTTNPVATEQYGSVSTINPLDVDGNC

SEQ ID NO: 31761 - protein, 28 aa, Artificial Sequence
  Description of Artificial Sequence: Synthetic peptide
DEEEIVTVNPVATECYGSVSTELQVGNL

SEQ ID NO: 31762 - protein, 28 aa, Artificial Sequence
  Description of Artificial Sequence: Synthetic peptide
FEEEIRTVNPVATEPYGSVSENVQRGNT

SEQ ID NO: 31763 - protein, 30 aa, Artificial Sequence
  Description of Artificial Sequence: Synthetic polypeptide
SEEEIRTTNPVATEQYGSVSATNLQQYGEF

SEQ ID NO: 31764 - protein, 30 aa, Artificial Sequence
  Description of Artificial Sequence: Synthetic polypeptide
AEEEIRTTNPVATEQYGQVSTTNLERNGER

SEQ ID NO: 31765 - protein, 33 aa, Artificial Sequence
  Description of Artificial Sequence: Synthetic polypeptide
DEEEIRTTNPVATEQYGSVYSTLNLQDREGDNG

SEQ ID NO: 31766 - protein, 30 aa, Artificial Sequence
  Description of Artificial Sequence: Synthetic polypeptide
DEHEICTTNPVATECYGSVSTNLQETNGNR

SEQ ID NO: 31767 - protein, 28 aa, Artificial Sequence
  Description of Artificial Sequence: Synthetic peptide
DEQEIRTTNPVATEQYGSVSTDDEIGNF

SEQ ID NO: 31768 - protein, 28 aa, Artificial Sequence
  Description of Artificial Sequence: Synthetic peptide
DEDEICTTNPVACEVYGSVGTNLQRGNM

SEQ ID NO: 31769 - protein, 28 aa, Artificial Sequence
  Description of Artificial Sequence: Synthetic peptide
REEEISCTNPVATECYGSVSTNLQHGQR

SEQ ID NO: 31770 - protein, 31 aa, Artificial Sequence
  Description of Artificial Sequence: Synthetic polypeptide
DEVEIRTTNPVATEQYGSVVSQTCLQRGENL

SEQ ID NO: 31771 - protein, 29 aa, Artificial Sequence
  Description of Artificial Sequence: Synthetic peptide
DEEEIRTTNPTATEQFGSVSTCNEQSGTR

SEQ ID NO: 31772 - protein, 28 aa, Artificial Sequence
  Description of Artificial Sequence: Synthetic peptide
DDEEIRCTNPVATEIYGCVAMNLQRGNR

SEQ ID NO: 31773 - protein, 31 aa, Artificial Sequence
  Description of Artificial Sequence: Synthetic polypeptide
DEEEIVTTNPVATEQYGSVSTNWQQCHGNDR

SEQ ID NO: 31774 - protein, 29 aa, Artificial Sequence
  Description of Artificial Sequence: Synthetic peptide
DEEEIRTTNPVATEWWGSVDTNEQMRGNM

SEQ ID NO: 31775 - protein, 29 aa, Artificial Sequence
  Description of Artificial Sequence: Synthetic peptide
SEQEIRTTNPVATEQYGWVTAANLQRGNR

SEQ ID NO: 31776 - protein, 31 aa, Artificial Sequence
  Description of Artificial Sequence: Synthetic polypeptide
DEEEIRQTNPVATEQYGSVSTNPQRKGDNPE

SEQ ID NO: 31777 - protein, 28 aa, Artificial Sequence
  Description of Artificial Sequence: Synthetic peptide
DPECIRTTNPVAYEQYGSVSHNDQRGNP

SEQ ID NO: 31778 - protein, 28 aa, Artificial Sequence
  Description of Artificial Sequence: Synthetic peptide
DEQEIATTNPVATEQYGSVGDNLQVGNA

SEQ ID NO: 31779 - protein, 30 aa, Artificial Sequence
  Description of Artificial Sequence: Synthetic polypeptide
DEQEIRTTNPVATEQYGSVSDTELQMKGNM

SEQ ID NO: 31780 - protein, 30 aa, Artificial Sequence
  Description of Artificial Sequence: Synthetic polypeptide
DENEIRTTNPVCTEQYGSVSTEEQTRNGNR

SEQ ID NO: 31781 - protein, 28 aa, Artificial Sequence
  Description of Artificial Sequence: Synthetic peptide
DEEEIRTTNPTATEQYGSVSTGPYQGNF

SEQ ID NO: 31782 - protein, 28 aa, Artificial Sequence
  Description of Artificial Sequence: Synthetic peptide
DEEEIRTTNPVATEQYGSVSTADFLGLM

SEQ ID NO: 31783 - protein, 28 aa, Artificial Sequence
  Description of Artificial Sequence: Synthetic peptide
DEVEIATTNPVATECYGGVSTNEQRGDR

SEQ ID NO: 31784 - protein, 32 aa, Artificial Sequence
  Description of Artificial Sequence: Synthetic polypeptide
DEEEIRTTNPFATEQYGSVSTMNNLVQMFGNR

SEQ ID NO: 31785 - protein, 28 aa, Artificial Sequence
  Description of Artificial Sequence: Synthetic peptide
QEEEIRATNPVATECYGSVSTDLQSGNL

SEQ ID NO: 31786 - protein, 28 aa, Artificial Sequence
  Description of Artificial Sequence: Synthetic peptide
SEEEIRTTNPTATEQYGSVSTNPQNGTL

SEQ ID NO: 31787 - protein, 31 aa, Artificial Sequence
  Description of Artificial Sequence: Synthetic polypeptide
DEEEIRTTNPVATEQYGSVSCTMDLQCNGNI

SEQ ID NO: 31788 - protein, 28 aa, Artificial Sequence
  Description of Artificial Sequence: Synthetic peptide
DEEEIRTTNPFATEQYGSVSTGLCDGED

SEQ ID NO: 31789 - protein, 29 aa, Artificial Sequence
  Description of Artificial Sequence: Synthetic peptide
DENEIRTTNPVATEQWGSVSTNLMMTGNL

SEQ ID NO: 31790 - protein, 28 aa, Artificial Sequence
  Description of Artificial Sequence: Synthetic peptide
VEGELRTTNPVASEQFGCVSTNLQRGNR

SEQ ID NO: 31791 - protein, 31 aa, Artificial Sequence
  Description of Artificial Sequence: Synthetic polypeptide
DENEIATTNPVATEQYGSVCSTCCPLQRGNR

SEQ ID NO: 31792 - protein, 30 aa, Artificial Sequence
  Description of Artificial Sequence: Synthetic polypeptide
DENEIATTNPVATEQYGSVSATNLQHGEDR

SEQ ID NO: 31793 - protein, 32 aa, Artificial Sequence
  Description of Artificial Sequence: Synthetic polypeptide
DEEEIRTTNPVATEQYGSVDSETENGLERGND

SEQ ID NO: 31794 - protein, 30 aa, Artificial Sequence
  Description of Artificial Sequence: Synthetic polypeptide
SEEEICTTNPVATEQYGTVSTNLPQRGVNI

SEQ ID NO: 31795 - protein, 31 aa, Artificial Sequence
  Description of Artificial Sequence: Synthetic polypeptide
DEEEIRTTNPTATEQYGSVSTGNEQREGNTN

SEQ ID NO: 31796 - protein, 29 aa, Artificial Sequence
  Description of Artificial Sequence: Synthetic peptide
DENEIRTTNPVATELYGSVSENEQNRGNW

SEQ ID NO: 31797 - protein, 29 aa, Artificial Sequence
  Description of Artificial Sequence: Synthetic peptide
DEVEISTTNPVATEQYGYVSTNWQRGDNT

SEQ ID NO: 31798 - protein, 29 aa, Artificial Sequence
  Description of Artificial Sequence: Synthetic peptide
DEVEIATTNPVATEQYGSVSTADQTVGNR

SEQ ID NO: 31799 - protein, 28 aa, Artificial Sequence
  Description of Artificial Sequence: Synthetic peptide
DEEEISTTNPVSTELYGSVSTAEQRGNM

SEQ ID NO: 31800 - protein, 28 aa, Artificial Sequence
  Description of Artificial Sequence: Synthetic peptide
DENEIATTNPVATECYGSVSTELQHGER

SEQ ID NO: 31801 - protein, 28 aa, Artificial Sequence
  Description of Artificial Sequence: Synthetic peptide
CEEEIRTTNPVATEVYGEVSTNLQREQM

SEQ ID NO: 31802 - protein, 28 aa, Artificial Sequence
  Description of Artificial Sequence: Synthetic peptide
DENEIRTTNPVATEQYGSVSTDLEHGEA

SEQ ID NO: 31803 - protein, 28 aa, Artificial Sequence
  Description of Artificial Sequence: Synthetic peptide
DEVEIAATNPVATEQYGSVSENLQHGDR

SEQ ID NO: 31804 - protein, 29 aa, Artificial Sequence
  Description of Artificial Sequence: Synthetic peptide
AEEEIYTTNPVASEQYGSVSTTLQHSGNR

SEQ ID NO: 31805 - protein, 30 aa, Artificial Sequence
  Description of Artificial Sequence: Synthetic polypeptide
DEQEITTTNPVCTEQYGSVSTMDLQQRGNR

SEQ ID NO: 31806 - protein, 28 aa, Artificial Sequence
  Description of Artificial Sequence: Synthetic peptide
DEDEIRTTNPCATEVYGFVSTNLQSLNR

SEQ ID NO: 31807 - protein, 28 aa, Artificial Sequence
  Description of Artificial Sequence: Synthetic peptide
SEEEIRTTNPVATEQFGVVSVNLQHGNH

SEQ ID NO: 31808 - protein, 28 aa, Artificial Sequence
  Description of Artificial Sequence: Synthetic peptide
DEEEIRTTNPVATEQYGSWSEPQQDENR

SEQ ID NO: 31809 - protein, 31 aa, Artificial Sequence
  Description of Artificial Sequence: Synthetic polypeptide
DEEEIRTTNPVATEQYGSVKSENLFQYHGNS

SEQ ID NO: 31810 - protein, 28 aa, Artificial Sequence
  Description of Artificial Sequence: Synthetic peptide
DENEIRTTNPVATEQYGDVSTNLMHMNQ

SEQ ID NO: 31811 - protein, 30 aa, Artificial Sequence
  Description of Artificial Sequence: Synthetic polypeptide
DEEEIRTTNPTATEQYGSVSTMNEQQGDNF

SEQ ID NO: 31812 - protein, 28 aa, Artificial Sequence
  Description of Artificial Sequence: Synthetic peptide
DEEEIMTTNPFATEQYGSVSTDQQDDNR

SEQ ID NO: 31813 - protein, 28 aa, Artificial Sequence
  Description of Artificial Sequence: Synthetic peptide
DEEEIVTTNPVATENYGIVSMNIQQGNR

SEQ ID NO: 31814 - protein, 28 aa, Artificial Sequence
  Description of Artificial Sequence: Synthetic peptide
DEEEIRCTNPVATEQFGCVSTDLQIGTR

SEQ ID NO: 31815 - protein, 30 aa, Artificial Sequence
  Description of Artificial Sequence: Synthetic polypeptide
DEEEIRSTNPVATEQYGDVSEDNLTYRGNR

SEQ ID NO: 31816 - protein, 28 aa, Artificial Sequence
  Description of Artificial Sequence: Synthetic peptide
DEQEIRTVNPVATEQYGSAAEVLQRGNR

SEQ ID NO: 31817 - protein, 28 aa, Artificial Sequence
  Description of Artificial Sequence: Synthetic peptide
SEVEIRTTNPTATEQYGSVSTNLQQGDF

SEQ ID NO: 31818 - protein, 30 aa, Artificial Sequence
  Description of Artificial Sequence: Synthetic polypeptide
DEGEIATTNPVATEVYGSVSTLNLQDIGNR

SEQ ID NO: 31819 - protein, 28 aa, Artificial Sequence
  Description of Artificial Sequence: Synthetic peptide
DEEEIRTTNPTATEIYGYVATNWQQGNR

SEQ ID NO: 31820 - protein, 28 aa, Artificial Sequence
  Description of Artificial Sequence: Synthetic peptide
DEEEITATNPVATEQFGSVSTNLQQGTS

SEQ ID NO: 31821 - protein, 29 aa, Artificial Sequence
  Description of Artificial Sequence: Synthetic peptide
DDEEIRTTNPVSTEQYGNASVTNLQRGDR

SEQ ID NO: 31822 - protein, 28 aa, Artificial Sequence
  Description of Artificial Sequence: Synthetic peptide
DEEEIRTTNPVSTENYGTVSTDDQRGNI

SEQ ID NO: 31823 - protein, 28 aa, Artificial Sequence
  Description of Artificial Sequence: Synthetic peptide
DEEEIRTTNPVATEQYGDVSTQEQLNNE

SEQ ID NO: 31824 - protein, 28 aa, Artificial Sequence
  Description of Artificial Sequence: Synthetic peptide
DEPEIRSTNPVSTEQYGDVSCNLQRGDR

SEQ ID NO: 31825 - protein, 29 aa, Artificial Sequence
  Description of Artificial Sequence: Synthetic peptide
DEEEIRGTNPVSTEQYGSVGTNLMTGNDR

SEQ ID NO: 31826 - protein, 28 aa, Artificial Sequence
  Description of Artificial Sequence: Synthetic peptide
DDDEISTTNPVSTEQYGSVCTNLQRGNA

SEQ ID NO: 31827 - protein, 28 aa, Artificial Sequence
  Description of Artificial Sequence: Synthetic peptide
DENEIRTTNPVATEQYGNVSENLMRGDA

SEQ ID NO: 31828 - protein, 28 aa, Artificial Sequence
  Description of Artificial Sequence: Synthetic peptide
DDEEIRCTNPVASEQYGCVSMNLERGNR

SEQ ID NO: 31829 - protein, 28 aa, Artificial Sequence
  Description of Artificial Sequence: Synthetic peptide
EEQSIRTTNPVATEQYGSVSDNLQPGNA

SEQ ID NO: 31830 - protein, 28 aa, Artificial Sequence
  Description of Artificial Sequence: Synthetic peptide
DEEEIRATNPVATEQYGVVSNNLTHGNA

SEQ ID NO: 31831 - protein, 30 aa, Artificial Sequence
  Description of Artificial Sequence: Synthetic polypeptide
DEQEIRTTNPVATEQYGDVSTNLQCHGNDA

SEQ ID NO: 31832 - protein, 28 aa, Artificial Sequence
  Description of Artificial Sequence: Synthetic peptide
DEQEIRATNPVATEIFGSVAMNLQRGNR

SEQ ID NO: 31833 - protein, 30 aa, Artificial Sequence
  Description of Artificial Sequence: Synthetic polypeptide
DEEEIRTTNPVATEQYGSVSTMDLCAGNDS

SEQ ID NO: 31834 - protein, 28 aa, Artificial Sequence
  Description of Artificial Sequence: Synthetic peptide
AEEEIRTTNPVATEQWGVVSTNLPIGNF

SEQ ID NO: 31835 - protein, 28 aa, Artificial Sequence
  Description of Artificial Sequence: Synthetic peptide
HETELRTTNPVATEHYGSVGTNLQRGER

SEQ ID NO: 31836 - protein, 28 aa, Artificial Sequence
  Description of Artificial Sequence: Synthetic peptide
DESEIRTTNPVCSEMYGSVSTNDQRENR

SEQ ID NO: 31837 - protein, 28 aa, Artificial Sequence
  Description of Artificial Sequence: Synthetic peptide
DEEEIRTTNPDATEQYGSVETPEDRGNY

SEQ ID NO: 31838 - protein, 31 aa, Artificial Sequence
  Description of Artificial Sequence: Synthetic polypeptide
DEEEIRTTNPVATEQYGSVDCTNLQCQGNDN

SEQ ID NO: 31839 - protein, 28 aa, Artificial Sequence
  Description of Artificial Sequence: Synthetic peptide
DEGEIRTTNPVATECYGSVSTDLERGEN

SEQ ID NO: 31840 - protein, 28 aa, Artificial Sequence
  Description of Artificial Sequence: Synthetic peptide
DEEEIAQTNPVATEQYGSASENLQRENK

SEQ ID NO: 31841 - protein, 29 aa, Artificial Sequence
  Description of Artificial Sequence: Synthetic peptide
DENEIRTTNPVATEQWGSVSENEMMRGNR

SEQ ID NO: 31842 - protein, 29 aa, Artificial Sequence
  Description of Artificial Sequence: Synthetic peptide
DEEEIRTTNPVATEQYGCWVSDTEQRGNL

SEQ ID NO: 31843 - protein, 28 aa, Artificial Sequence
  Description of Artificial Sequence: Synthetic peptide
DEEEIRTTNPVATEQYWSVSTDQARGEY

SEQ ID NO: 31844 - protein, 29 aa, Artificial Sequence
  Description of Artificial Sequence: Synthetic peptide
DEEEIRTTNPVATEQYGSVSTNEPVEEDR

SEQ ID NO: 31845 - protein, 29 aa, Artificial Sequence
  Description of Artificial Sequence: Synthetic peptide
DDEEIRTTNPVATEGYGSVSTLNQQPGNN

SEQ ID NO: 31846 - protein, 32 aa, Artificial Sequence
  Description of Artificial Sequence: Synthetic polypeptide
DEQEIRTTNPVATEQYGESVDITNNLQRGTNR

SEQ ID NO: 31847 - protein, 28 aa, Artificial Sequence
  Description of Artificial Sequence: Synthetic peptide
HETEIVTTNPVATEQYGAVSTTLQRGNA

SEQ ID NO: 31848 - protein, 30 aa, Artificial Sequence
  Description of Artificial Sequence: Synthetic polypeptide
DEEEIYTTNPVATECYGSVSTNGQRRGEPR

SEQ ID NO: 31849 - protein, 28 aa, Artificial Sequence
  Description of Artificial Sequence: Synthetic peptide
AEEEIAQTNPVATEQYGSVSTGDERGNR

SEQ ID NO: 31850 - protein, 28 aa, Artificial Sequence
  Description of Artificial Sequence: Synthetic peptide
DEEEIRTTNPDATEQYGVVSTCPIRGNS

SEQ ID NO: 31851 - protein, 28 aa, Artificial Sequence
  Description of Artificial Sequence: Synthetic peptide
DEEEVRTTNPIATECYGAVAMNLQRGNR

SEQ ID NO: 31852 - protein, 28 aa, Artificial Sequence
  Description of Artificial Sequence: Synthetic peptide
DENEIRTTNPVATEQYGGVSENIIEGNR

SEQ ID NO: 31853 - protein, 28 aa, Artificial Sequence
  Description of Artificial Sequence: Synthetic peptide
SEEEIRTTNPVATELYGSVSTAEQTGPR

SEQ ID NO: 31854 - protein, 28 aa, Artificial Sequence
  Description of Artificial Sequence: Synthetic peptide
DENEIRTTNPVATEQYGVVSTDQERGER

SEQ ID NO: 31855 - protein, 28 aa, Artificial Sequence
  Description of Artificial Sequence: Synthetic peptide
DEQEIRTTNPVATEQYGSVSTDDEQGER

SEQ ID NO: 31856 - protein, 28 aa, Artificial Sequence
  Description of Artificial Sequence: Synthetic peptide
DEEEIATTNPVCTEQYGWVSDNLQNGNS

SEQ ID NO: 31857 - protein, 29 aa, Artificial Sequence
  Description of Artificial Sequence: Synthetic peptide
QEQEITTTNPVATEQYGEVSAENLQRGNR

SEQ ID NO: 31858 - protein, 28 aa, Artificial Sequence
  Description of Artificial Sequence: Synthetic peptide
SEEEIRTTNPVATECYGEVSTNWQLGNQ

SEQ ID NO: 31859 - protein, 28 aa, Artificial Sequence
  Description of Artificial Sequence: Synthetic peptide
DENEIATTNPVATEQYGSVSTGQEQGNR

SEQ ID NO: 31860 - protein, 28 aa, Artificial Sequence
  Description of Artificial Sequence: Synthetic peptide
SEEEIRCTNPVATFQWGTVATNLQRGNR

SEQ ID NO: 31861 - protein, 28 aa, Artificial Sequence
  Description of Artificial Sequence: Synthetic peptide
DECEVGTTNPVATEVYGSVSYNLQRGMR

SEQ ID NO: 31862 - protein, 28 aa, Artificial Sequence
  Description of Artificial Sequence: Synthetic peptide
VEEEIRGTNPVATSQYGSVSTNLDRGTH

SEQ ID NO: 31863 - protein, 32 aa, Artificial Sequence
  Description of Artificial Sequence: Synthetic polypeptide
DEEEIRTTNPVATEQYGSVDSETDDQRDGENR

SEQ ID NO: 31864 - protein, 32 aa, Artificial Sequence
  Description of Artificial Sequence: Synthetic polypeptide
DEEEIRCTNPVATEQYGMSVSTPPLQIRGNDR

SEQ ID NO: 31865 - protein, 29 aa, Artificial Sequence
  Description of Artificial Sequence: Synthetic peptide
DEQEIRTTNPVATEQYGSVSTELERGEDW

SEQ ID NO: 31866 - protein, 29 aa, Artificial Sequence
  Description of Artificial Sequence: Synthetic peptide
DEEEIRTTNPVATEQYGDASTNLMHAMNR

SEQ ID NO: 31867 - protein, 28 aa, Artificial Sequence
  Description of Artificial Sequence: Synthetic peptide
DENEIRTTNPVATEQWGIVSENLQGGNF

SEQ ID NO: 31868 - protein, 28 aa, Artificial Sequence
  Description of Artificial Sequence: Synthetic peptide
SEEEIRTTNPAATEQFGSVSTNWQLGNA

SEQ ID NO: 31869 - protein, 28 aa, Artificial Sequence
  Description of Artificial Sequence: Synthetic peptide
DEEEIRCTNPVASELYGSVAMNLQRGNQ

SEQ ID NO: 31870 - protein, 29 aa, Artificial Sequence
  Description of Artificial Sequence: Synthetic peptide
DENEIRTTNPVATECYGSVSENLQNQGNA

SEQ ID NO: 31871 - protein, 28 aa, Artificial Sequence
  Description of Artificial Sequence: Synthetic peptide
DEEEIRTTNPVATEQYGSVSEDLQHEEN

SEQ ID NO: 31872 - protein, 31 aa, Artificial Sequence
  Description of Artificial Sequence: Synthetic polypeptide
DSEEIRPTNPVATEQYGSMVSTCNDQCRGNR

SEQ ID NO: 31873 - protein, 28 aa, Artificial Sequence
  Description of Artificial Sequence: Synthetic peptide
FEEEIRTTNPCATEQYGSVNSELQRGNY

SEQ ID NO: 31874 - protein, 28 aa, Artificial Sequence
  Description of Artificial Sequence: Synthetic peptide
DENEIRCTNPVATENYGAVSTQLQRGNK

SEQ ID NO: 31875 - protein, 28 aa, Artificial Sequence
  Description of Artificial Sequence: Synthetic peptide
DEEEIVTTNPVATEQYGDVSTCLCREER

SEQ ID NO: 31876 - protein, 31 aa, Artificial Sequence
  Description of Artificial Sequence: Synthetic polypeptide
DEEEIRTTNPVATEQYWSYVSTGLTQRGNPS

SEQ ID NO: 31877 - protein, 30 aa, Artificial Sequence
  Description of Artificial Sequence: Synthetic polypeptide
DEEEIRTTNPVATEQYGSVSTANLIFGTWL

SEQ ID NO: 31878 - protein, 31 aa, Artificial Sequence
  Description of Artificial Sequence: Synthetic polypeptide
DECEIRTTNPVATEQYGSVDMMNLQYRDGNR

SEQ ID NO: 31879 - protein, 28 aa, Artificial Sequence
  Description of Artificial Sequence: Synthetic peptide
DEEPIRTTNPVATVQYGSVDTNLDNGNP

SEQ ID NO: 31880 - protein, 28 aa, Artificial Sequence
  Description of Artificial Sequence: Synthetic peptide
DEEEIRTTNPVATEQWGIVDENLQQGNS

SEQ ID NO: 31881 - protein, 28 aa, Artificial Sequence
  Description of Artificial Sequence: Synthetic peptide
DEEEIRTTNPVATEQYGDVSENLCHENQ

SEQ ID NO: 31882 - protein, 28 aa, Artificial Sequence
  Description of Artificial Sequence: Synthetic peptide
AEEEIAQTNPVATEVYGSVSTNLMHGNR

SEQ ID NO: 31883 - protein, 28 aa, Artificial Sequence
  Description of Artificial Sequence: Synthetic peptide
AEEEIAQTNPEATEQYGDVSTNLQRGER

SEQ ID NO: 31884 - protein, 28 aa, Artificial Sequence
  Description of Artificial Sequence: Synthetic peptide
DEEEIYCTNPVATEQYGSVSEVLQHGNT

SEQ ID NO: 31885 - protein, 30 aa, Artificial Sequence
  Description of Artificial Sequence: Synthetic polypeptide
DEEEITTTNPVATEVYGSVAATVLQRAGNR

SEQ ID NO: 31886 - protein, 32 aa, Artificial Sequence
  Description of Artificial Sequence: Synthetic polypeptide
DEEEIRTTNPVATEQYGSVDTNQVQLRNGENR

SEQ ID NO: 31887 - protein, 28 aa, Artificial Sequence
  Description of Artificial Sequence: Synthetic peptide
DESEIRCTNPVASEHYGSVSTNLERGNP

SEQ ID NO: 31888 - protein, 29 aa, Artificial Sequence
  Description of Artificial Sequence: Synthetic peptide
DEHEIVTTNPVATEQYGTVSTNLQHGNDT

SEQ ID NO: 31889 - protein, 28 aa, Artificial Sequence
  Description of Artificial Sequence: Synthetic peptide
SEEEIRTTNPTATEQFGSVSTNPQFGNL

SEQ ID NO: 31890 - protein, 28 aa, Artificial Sequence
  Description of Artificial Sequence: Synthetic peptide
DEEEIAATNPTATEQYGGVSTNLQRGTF

SEQ ID NO: 31891 - protein, 30 aa, Artificial Sequence
  Description of Artificial Sequence: Synthetic polypeptide
DEEEIRTTNPVASEQYGSVSTCLTTLGENR

SEQ ID NO: 31892 - protein, 28 aa, Artificial Sequence
  Description of Artificial Sequence: Synthetic peptide
GEEEIRATNPVATEVYGSVSENLPSGNR

SEQ ID NO: 31893 - protein, 28 aa, Artificial Sequence
  Description of Artificial Sequence: Synthetic peptide
DEEEIVQTNPVATEQYGSVSTDPQGGNL

SEQ ID NO: 31894 - protein, 30 aa, Artificial Sequence
  Description of Artificial Sequence: Synthetic polypeptide
DEEWIRTTNPVATEQWGSVATNNLQLGVNR

SEQ ID NO: 31895 - protein, 28 aa, Artificial Sequence
  Description of Artificial Sequence: Synthetic peptide
DEEEIRTTNPEATEQYGSVSTGPQHGTV

SEQ ID NO: 31896 - protein, 28 aa, Artificial Sequence
  Description of Artificial Sequence: Synthetic peptide
DENEIRTTNPVATECYGSVPENEQHGNR

SEQ ID NO: 31897 - protein, 28 aa, Artificial Sequence
  Description of Artificial Sequence: Synthetic peptide
DEEEIVTTNPVATEQYGEVSEVVQHGNR

SEQ ID NO: 31898 - protein, 28 aa, Artificial Sequence
  Description of Artificial Sequence: Synthetic peptide
DEVEIATTNPTATEQYGSVSTNPQHGNV

SEQ ID NO: 31899 - protein, 29 aa, Artificial Sequence
  Description of Artificial Sequence: Synthetic peptide
DEEEVRTVNPVSTEHYGSVSTNLERGENR

SEQ ID NO: 31900 - protein, 28 aa, Artificial Sequence
  Description of Artificial Sequence: Synthetic peptide
DEEEIRTTNPVATEQYGDVSENLQHEEL

SEQ ID NO: 31901 - protein, 28 aa, Artificial Sequence
  Description of Artificial Sequence: Synthetic peptide
DEEEVRTTNPVSTEQYGEASENLQRGNT

SEQ ID NO: 31902 - protein, 28 aa, Artificial Sequence
  Description of Artificial Sequence: Synthetic peptide
DEEEIRSTNPVATEQYGSVSDCLQGFNL

SEQ ID NO: 31903 - protein, 28 aa, Artificial Sequence
  Description of Artificial Sequence: Synthetic peptide
DEHEIATTNPVATEQYGSVSTDLEAGNV

SEQ ID NO: 31904 - protein, 30 aa, Artificial Sequence
  Description of Artificial Sequence: Synthetic polypeptide
DEEEIRTTNPTATEQYGSVSTANWQRGETA

SEQ ID NO: 31905 - protein, 30 aa, Artificial Sequence
  Description of Artificial Sequence: Synthetic polypeptide
NEEEIRTTNPCATEQYGVVSVSNLQQRGNR

SEQ ID NO: 31906 - protein, 28 aa, Artificial Sequence
  Description of Artificial Sequence: Synthetic peptide
DEQEIRTTNPVATEIYGSVSSNDQHGNC

SEQ ID NO: 31907 - protein, 29 aa, Artificial Sequence
  Description of Artificial Sequence: Synthetic peptide
DENEIRTTNPVATEQYGSVSTNEMMVGNM

SEQ ID NO: 31908 - protein, 28 aa, Artificial Sequence
  Description of Artificial Sequence: Synthetic peptide
VDEEINTTNPMATEQYGSVSTNLEAGNR

SEQ ID NO: 31909 - protein, 30 aa, Artificial Sequence
  Description of Artificial Sequence: Synthetic polypeptide
DEQEIRTVNPVATEQYGSVSTNLQDNGNDW

SEQ ID NO: 31910 - protein, 30 aa, Artificial Sequence
  Description of Artificial Sequence: Synthetic polypeptide
DEEEIRTTNPVATEQYGAVSTSNLQQHGAY

SEQ ID NO: 31911 - protein, 28 aa, Artificial Sequence
  Description of Artificial Sequence: Synthetic peptide
DEEEIRTTNPCAVEQYGEVSTNIMRTNR

SEQ ID NO: 31912 - protein, 29 aa, Artificial Sequence
  Description of Artificial Sequence: Synthetic peptide
DEEEICTTNPVCTEQYGDVSTCNVQRGNS

SEQ ID NO: 31913 - protein, 30 aa, Artificial Sequence
  Description of Artificial Sequence: Synthetic polypeptide
DENEIRTTNPVATEQYGSVYEGLQNRAGNR

SEQ ID NO: 31914 - protein, 28 aa, Artificial Sequence
  Description of Artificial Sequence: Synthetic peptide
DESEIVCTNPVSTEVYGWVSTNLQRGNR

SEQ ID NO: 31915 - protein, 28 aa, Artificial Sequence
  Description of Artificial Sequence: Synthetic peptide
DEEEIYPTNPVATEQYGSAAENIQRGNR

SEQ ID NO: 31916 - protein, 28 aa, Artificial Sequence
  Description of Artificial Sequence: Synthetic peptide
VESEVSTTNPVASEQYGAVSTNLQRGNR

SEQ ID NO: 31917 - protein, 29 aa, Artificial Sequence
  Description of Artificial Sequence: Synthetic peptide
DEEEIRTTNPIATEWYGCVSMNLQFRGND

SEQ ID NO: 31918 - protein, 28 aa, Artificial Sequence
  Description of Artificial Sequence: Synthetic peptide
DEEEIAATNPTATEMFGSVSTNEQRGNR

SEQ ID NO: 31919 - protein, 28 aa, Artificial Sequence
  Description of Artificial Sequence: Synthetic peptide
DENEIRTTNPVATECYGWVSTDLQQGNF

SEQ ID NO: 31920 - protein, 32 aa, Artificial Sequence
  Description of Artificial Sequence: Synthetic polypeptide
DEEEIRTTNPVATEQYGSIVFSTGPLFTRGNR

SEQ ID NO: 31921 - protein, 28 aa, Artificial Sequence
  Description of Artificial Sequence: Synthetic peptide
DENEIRTTNPVATECYGSVSTNLQHEEL

SEQ ID NO: 31922 - protein, 28 aa, Artificial Sequence
  Description of Artificial Sequence: Synthetic peptide
DEEEIVTTNPVATECYGSVSTELESGNA

SEQ ID NO: 31923 - protein, 28 aa, Artificial Sequence
  Description of Artificial Sequence: Synthetic peptide
DEEEVATVNPVSTEHFGSVSTNLQRGNR

SEQ ID NO: 31924 - protein, 31 aa, Artificial Sequence
  Description of Artificial Sequence: Synthetic polypeptide
QEEEIRTTNPVATEQYGSVSTCNLQERDPMR

SEQ ID NO: 31925 - protein, 28 aa, Artificial Sequence
  Description of Artificial Sequence: Synthetic peptide
DEEEIRTTNPVATEQYGSVSEDLQHEEA

SEQ ID NO: 31926 - protein, 28 aa, Artificial Sequence
  Description of Artificial Sequence: Synthetic peptide
LENEIRTTNPVATEQYGTVSENLQQGNQ

SEQ ID NO: 31927 - protein, 28 aa, Artificial Sequence
  Description of Artificial Sequence: Synthetic peptide
CEGEIRATNPVSTEQYGSVSTNLQRGEP

SEQ ID NO: 31928 - protein, 28 aa, Artificial Sequence
  Description of Artificial Sequence: Synthetic peptide
DEVEIATTNPVATEQYGGVSTNEQQGNF

SEQ ID NO: 31929 - protein, 28 aa, Artificial Sequence
  Description of Artificial Sequence: Synthetic peptide
NELEIRTTNPVATEIYGSASTNLTEGNR

SEQ ID NO: 31930 - protein, 29 aa, Artificial Sequence
  Description of Artificial Sequence: Synthetic peptide
QEQEISTTNPVATEQYGEVSAENLQRGNR

SEQ ID NO: 31931 - protein, 29 aa, Artificial Sequence
  Description of Artificial Sequence: Synthetic peptide
DEQEIMTTNPVATEMYGSVSFTNPQRGNI

SEQ ID NO: 31932 - protein, 28 aa, Artificial Sequence
  Description of Artificial Sequence: Synthetic peptide
DLEEICATNPVATEQYGSVSAGLYRGNR

SEQ ID NO: 31933 - protein, 28 aa, Artificial Sequence
  Description of Artificial Sequence: Synthetic peptide
SEEEIRTTNPTATEQYGSVSTDVQRGLQ

SEQ ID NO: 31934 - protein, 29 aa, Artificial Sequence
  Description of Artificial Sequence: Synthetic peptide
DEQEIYTTNPVATEQYGSVSDNLQSGNTY

SEQ ID NO: 31935 - protein, 29 aa, Artificial Sequence
  Description of Artificial Sequence: Synthetic peptide
QEAEIVTTNPVATELYGWVSATNLQRGNR

SEQ ID NO: 31936 - protein, 29 aa, Artificial Sequence
  Description of Artificial Sequence: Synthetic peptide
DEEECRTTNPVATEGYGVVSTDLQRDGNT

SEQ ID NO: 31937 - protein, 28 aa, Artificial Sequence
  Description of Artificial Sequence: Synthetic peptide
DEVEIATTNPVATEMYGEVSTNEQQGNR

SEQ ID NO: 31938 - protein, 28 aa, Artificial Sequence
  Description of Artificial Sequence: Synthetic peptide
DEEEIRTTNPVCTEQYGTASENLQGGNS

SEQ ID NO: 31939 - protein, 28 aa, Artificial Sequence
  Description of Artificial Sequence: Synthetic peptide
DEEEIVTTNPVATEQYGVASEVLQRGMR

SEQ ID NO: 31940 - protein, 28 aa, Artificial Sequence
  Description of Artificial Sequence: Synthetic peptide
DEEEIATTNPVATEMFGGVSTNLQQGNF

SEQ ID NO: 31941 - protein, 28 aa, Artificial Sequence
  Description of Artificial Sequence: Synthetic peptide
DENEIATTNPVATECYGSVSTDLQRGEL

SEQ ID NO: 31942 - protein, 29 aa, Artificial Sequence
  Description of Artificial Sequence: Synthetic peptide
SEEEIRTTNPVATECFGSVSTNWQREGNG

SEQ ID NO: 31943 - protein, 28 aa, Artificial Sequence
  Description of Artificial Sequence: Synthetic peptide
YEQEIRTTNPVATEQYGDVSNDLQRGNS

SEQ ID NO: 31944 - protein, 31 aa, Artificial Sequence
  Description of Artificial Sequence: Synthetic polypeptide
DEDEIRTTNPVATEQYGSVSEMNLQIRGDNQ

SEQ ID NO: 31945 - protein, 28 aa, Artificial Sequence
  Description of Artificial Sequence: Synthetic peptide
DESEIRTVNPCATEQYGSVSSNLQLLNR

SEQ ID NO: 31946 - protein, 28 aa, Artificial Sequence
  Description of Artificial Sequence: Synthetic peptide
DEEEIRTTNPVATEQYGSVETNDDPGDW

SEQ ID NO: 31947 - protein, 28 aa, Artificial Sequence
  Description of Artificial Sequence: Synthetic peptide
LEEEIATTNPVATEQYGSVDENPQRGNQ

SEQ ID NO: 31948 - protein, 31 aa, Artificial Sequence
  Description of Artificial Sequence: Synthetic polypeptide
DEEEIRTTNPVAWEDYGSVSTINLHQRLGTR

SEQ ID NO: 31949 - protein, 28 aa, Artificial Sequence
  Description of Artificial Sequence: Synthetic peptide
DEEEIVATNPVCTEQFGSISTNLQVGNR

SEQ ID NO: 31950 - protein, 28 aa, Artificial Sequence
  Description of Artificial Sequence: Synthetic peptide
DEEEIVTTNPVATEQYGSVSTNDLVGEN

SEQ ID NO: 31951 - protein, 28 aa, Artificial Sequence
  Description of Artificial Sequence: Synthetic peptide
DESEIRTTNPVSTEQYGVVSTNDQSGNI

SEQ ID NO: 31952 - protein, 28 aa, Artificial Sequence
  Description of Artificial Sequence: Synthetic peptide
DEQEIRTTNPVACEIYGAVANNLQRGNR

SEQ ID NO: 31953 - protein, 31 aa, Artificial Sequence
  Description of Artificial Sequence: Synthetic polypeptide
DEEEIATTNPVATEMYGSVSEGNLQDRGNDR

SEQ ID NO: 31954 - protein, 29 aa, Artificial Sequence
  Description of Artificial Sequence: Synthetic peptide
DEEEIRTTNPTATEQFGSVSECNLQRGDL

SEQ ID NO: 31955 - protein, 28 aa, Artificial Sequence
  Description of Artificial Sequence: Synthetic peptide
TEEEIVTTNPVATEQYGSVSETLQYGNA

SEQ ID NO: 31956 - protein, 28 aa, Artificial Sequence
  Description of Artificial Sequence: Synthetic peptide
QEHEISATNPVATEQYGSVSTALQRGDR

SEQ ID NO: 31957 - protein, 28 aa, Artificial Sequence
  Description of Artificial Sequence: Synthetic peptide
DEEEIRATNPVATEMYGTVSTNLQIGES

SEQ ID NO: 31958 - protein, 28 aa, Artificial Sequence
  Description of Artificial Sequence: Synthetic peptide
DEQEIRTTNPVATEQWGSVSENEMRGNF

SEQ ID NO: 31959 - protein, 28 aa, Artificial Sequence
  Description of Artificial Sequence: Synthetic peptide
DEQEIRATNPVATEVYGSVSTNLQHFNQ

SEQ ID NO: 31960 - protein, 32 aa, Artificial Sequence
  Description of Artificial Sequence: Synthetic polypeptide
DEQEIRTTNPVATEQYGSVEETNGLQREGENR

SEQ ID NO: 31961 - protein, 28 aa, Artificial Sequence
  Description of Artificial Sequence: Synthetic peptide
SEVEIRTTNPVATEMYGSVSENLQQGNF

SEQ ID NO: 31962 - protein, 28 aa, Artificial Sequence
  Description of Artificial Sequence: Synthetic peptide
DEEEIRCTNPFATEQYGAVSTNLLRGGA

SEQ ID NO: 31963 - protein, 28 aa, Artificial Sequence
  Description of Artificial Sequence: Synthetic peptide
DEEEIRTTNPVATECYGVVSTPLQSGEI

SEQ ID NO: 31964 - protein, 29 aa, Artificial Sequence
  Description of Artificial Sequence: Synthetic peptide
SEQEIYATNPVATEQYGSVSTNLQRGPNF

SEQ ID NO: 31965 - protein, 28 aa, Artificial Sequence
  Description of Artificial Sequence: Synthetic peptide
DEEEIATTNPVATEQFGEVSELEQRGNR

SEQ ID NO: 31966 - protein, 29 aa, Artificial Sequence
  Description of Artificial Sequence: Synthetic peptide
DEEEIRTTNPTATECFGSVSTNWQREGNN

SEQ ID NO: 31967 - protein, 30 aa, Artificial Sequence
  Description of Artificial Sequence: Synthetic polypeptide
QEEEIRTTNPVATEQYGSVPTCLQIRKGNN

SEQ ID NO: 31968 - protein, 31 aa, Artificial Sequence
  Description of Artificial Sequence: Synthetic polypeptide
DEEEIRTTNPVATEQYGSVSVENEGQRGINH

SEQ ID NO: 31969 - protein, 29 aa, Artificial Sequence
  Description of Artificial Sequence: Synthetic peptide
DEEEIRSTNPVATECYGSVSMGNLQVGNS

SEQ ID NO: 31970 - protein, 30 aa, Artificial Sequence
  Description of Artificial Sequence: Synthetic polypeptide
GEEEIRTTNPEATEQYGSVSTTNPTQRGND

SEQ ID NO: 31971 - protein, 28 aa, Artificial Sequence
  Description of Artificial Sequence: Synthetic peptide
DDEEVACTNPVATEQYGSVSMNLQRLNR

SEQ ID NO: 31972 - protein, 28 aa, Artificial Sequence
  Description of Artificial Sequence: Synthetic peptide
DENEIMCTNPEATEQYGSVSTNLQSGNF

SEQ ID NO: 31973 - protein, 31 aa, Artificial Sequence
  Description of Artificial Sequence: Synthetic polypeptide
DEEEIATTNPVATEQYGSVSATNLEDREGNL

SEQ ID NO: 31974 - protein, 28 aa, Artificial Sequence
  Description of Artificial Sequence: Synthetic peptide
NEHEIRTTNPVATEQYGSVSSNDQHGNS

SEQ ID NO: 31975 - protein, 28 aa, Artificial Sequence
  Description of Artificial Sequence: Synthetic peptide
NEEEICTTNPVATEWYGDVSTLLQRGNS

SEQ ID NO: 31976 - protein, 30 aa, Artificial Sequence
  Description of Artificial Sequence: Synthetic polypeptide
DEEEIRTTNPVATEQHGEVSTCLQLVGENR

SEQ ID NO: 31977 - protein, 31 aa, Artificial Sequence
  Description of Artificial Sequence: Synthetic polypeptide
DESEIRTTNPVATEHYGSTVSTTPNLQSGNR

SEQ ID NO: 31978 - protein, 30 aa, Artificial Sequence
  Description of Artificial Sequence: Synthetic polypeptide
DEECIRTTNPVATEAQWPWSVSDNLQRGNR

SEQ ID NO: 31979 - protein, 28 aa, Artificial Sequence
  Description of Artificial Sequence: Synthetic peptide
DNEEIRTTNPLAFSQYGSVSTLAQRGNR

SEQ ID NO: 31980 - protein, 29 aa, Artificial Sequence
  Description of Artificial Sequence: Synthetic peptide
DEEEIRPTNPVATEQYGSVSYPPLQTLNR

SEQ ID NO: 31981 - protein, 28 aa, Artificial Sequence
  Description of Artificial Sequence: Synthetic peptide
DEEEIVTTNPVATEVYGSASTNLMRFNQ

SEQ ID NO: 31982 - protein, 28 aa, Artificial Sequence
  Description of Artificial Sequence: Synthetic peptide
DEEEIRTTNPCASEQYGCVSTNLEPPNR

SEQ ID NO: 31983 - protein, 31 aa, Artificial Sequence
  Description of Artificial Sequence: Synthetic polypeptide
DEEEIRTTNPVATECYGSVSTNGLQERKGET

SEQ ID NO: 31984 - protein, 28 aa, Artificial Sequence
  Description of Artificial Sequence: Synthetic peptide
DENEISTVNPVASEQYGQVSTNLQRGPR

SEQ ID NO: 31985 - protein, 28 aa, Artificial Sequence
  Description of Artificial Sequence: Synthetic peptide
HEVEIATVNPVATEQYGSVGTNLQRGNQ

SEQ ID NO: 31986 - protein, 28 aa, Artificial Sequence
  Description of Artificial Sequence: Synthetic peptide
DENEIRTVNPVATEQYGWVSTELQNGNC

SEQ ID NO: 31987 - protein, 28 aa, Artificial Sequence
  Description of Artificial Sequence: Synthetic peptide
DEEEIRTTNPVASELYGNVSNNLQRGTQ

SEQ ID NO: 31988 - protein, 28 aa, Artificial Sequence
  Description of Artificial Sequence: Synthetic peptide
DEEEIRTTNPVATECFGSWHENLQDGNR

SEQ ID NO: 31989 - protein, 28 aa, Artificial Sequence
  Description of Artificial Sequence: Synthetic peptide
FEEEITTTNPVATEMYGEVSVNLQRGNA

SEQ ID NO: 31990 - protein, 28 aa, Artificial Sequence
  Description of Artificial Sequence: Synthetic peptide
KEEPIRTTNPVATAQYGMVSENLQNGNR

SEQ ID NO: 31991 - protein, 33 aa, Artificial Sequence
  Description of Artificial Sequence: Synthetic polypeptide
DEEEIRTTNPVATEQYGSVDSETNLQEDGENER

SEQ ID NO: 31992 - protein, 28 aa, Artificial Sequence
  Description of Artificial Sequence: Synthetic peptide
DEEEIRTTNPVASEQYGTVSTDWQSGNT

SEQ ID NO: 31993 - protein, 28 aa, Artificial Sequence
  Description of Artificial Sequence: Synthetic peptide
DEAEIATTNPVCTEQYGAVSTELQRGNQ

SEQ ID NO: 31994 - protein, 28 aa, Artificial Sequence
  Description of Artificial Sequence: Synthetic peptide
EEEEISGTNPVATEQYGSVTDNLQRGER

SEQ ID NO: 31995 - protein, 31 aa, Artificial Sequence
  Description of Artificial Sequence: Synthetic polypeptide
DEEEIRTTNPVATEQYGSVSNQNDQMMGANR

SEQ ID NO: 31996 - protein, 28 aa, Artificial Sequence
  Description of Artificial Sequence: Synthetic peptide
DEEEIRTTNPVATYVYGSVSEDLQQGYR

SEQ ID NO: 31997 - protein, 28 aa, Artificial Sequence
  Description of Artificial Sequence: Synthetic peptide
QEEEIATTNPVATECYGSVSTDLEPGNR

SEQ ID NO: 31998 - protein, 28 aa, Artificial Sequence
  Description of Artificial Sequence: Synthetic peptide
SEEEIRATNPTATEQYGSVSTNPQNGNF

SEQ ID NO: 31999 - protein, 28 aa, Artificial Sequence
  Description of Artificial Sequence: Synthetic peptide
KDNEIRTTNPVATEQYGSVSTELQYGNA

SEQ ID NO: 32000 - protein, 31 aa, Artificial Sequence
  Description of Artificial Sequence: Synthetic polypeptide
DEEEIRTTNPVATEQYGIVSTNLQNGAGTDR

SEQ ID NO: 32001 - protein, 29 aa, Artificial Sequence
  Description of Artificial Sequence: Synthetic peptide
DEEEIRTTNPVATEVYGVVSTALVFSGNR

SEQ ID NO: 32002 - protein, 29 aa, Artificial Sequence
  Description of Artificial Sequence: Synthetic peptide
DEEEIRTTNPVATEIYGSVSHGDQRGNLP

SEQ ID NO: 32003 - protein, 28 aa, Artificial Sequence
  Description of Artificial Sequence: Synthetic peptide
DEQEVRTTNPVASEIYGCVATNLQRGNR

SEQ ID NO: 32004 - protein, 28 aa, Artificial Sequence
  Description of Artificial Sequence: Synthetic peptide
DEEEIRTTNPVATEQYGSWETNEERDNN

SEQ ID NO: 32005 - protein, 31 aa, Artificial Sequence
  Description of Artificial Sequence: Synthetic polypeptide
DEEEIRTTNPVATEQYGSVCNTFNLYGRGTR

SEQ ID NO: 32006 - protein, 30 aa, Artificial Sequence
  Description of Artificial Sequence: Synthetic polypeptide
IEEEIRTTNPVATDQYGSVSNTNLQRGVWQ

SEQ ID NO: 32007 - protein, 28 aa, Artificial Sequence
  Description of Artificial Sequence: Synthetic peptide
DEEEIRTTNPVATEQYGGVAMGLDVGNR

SEQ ID NO: 32008 - protein, 29 aa, Artificial Sequence
  Description of Artificial Sequence: Synthetic peptide
DEVEIRTTNPVATEPYGSVSDCNECRGNR

SEQ ID NO: 32009 - protein, 28 aa, Artificial Sequence
  Description of Artificial Sequence: Synthetic peptide
DEIEIRTTNPVATEQYGYVITNLQQDNY

SEQ ID NO: 32010 - protein, 31 aa, Artificial Sequence
  Description of Artificial Sequence: Synthetic polypeptide
SEEEIYTTNPVATEQYGSVISTCNLQIGNDR

SEQ ID NO: 32011 - protein, 30 aa, Artificial Sequence
  Description of Artificial Sequence: Synthetic polypeptide
HDEEIRTTNPISTEQYGSVSTNLQMRGDNR

SEQ ID NO: 32012 - protein, 28 aa, Artificial Sequence
  Description of Artificial Sequence: Synthetic peptide
DEMEIVTTNPVATETYGIVSENLQIGNR

SEQ ID NO: 32013 - protein, 28 aa, Artificial Sequence
  Description of Artificial Sequence: Synthetic peptide
SEGEIRTTNPVAAECYGSVSTNEQRGNL

SEQ ID NO: 32014 - protein, 30 aa, Artificial Sequence
  Description of Artificial Sequence: Synthetic polypeptide
DEEQIRTTNPVATEQYGSLVSTNDQIRLNL

SEQ ID NO: 32015 - protein, 28 aa, Artificial Sequence
  Description of Artificial Sequence: Synthetic peptide
DEHEIRTTNPVATEQYGDVSEDLQAGNI

SEQ ID NO: 32016 - protein, 28 aa, Artificial Sequence
  Description of Artificial Sequence: Synthetic peptide
DETSIRTTNPLATEQFGSVSFNLQSGNR

SEQ ID NO: 32017 - protein, 31 aa, Artificial Sequence
  Description of Artificial Sequence: Synthetic polypeptide
DEEEIRTTNPVATEQYGSVSTTPLQVNGNDC

SEQ ID NO: 32018 - protein, 30 aa, Artificial Sequence
  Description of Artificial Sequence: Synthetic polypeptide
DECEIRTTNPVATEQYGIVSTQNGQVGNDR

SEQ ID NO: 32019 - protein, 29 aa, Artificial Sequence
  Description of Artificial Sequence: Synthetic peptide
DEEETRTTNPVSTECYGSVSTNLQPGNDD

SEQ ID NO: 32020 - protein, 28 aa, Artificial Sequence
  Description of Artificial Sequence: Synthetic peptide
DEEEIATTNPVATEQYGVVSENLQFGDH

SEQ ID NO: 32021 - protein, 28 aa, Artificial Sequence
  Description of Artificial Sequence: Synthetic peptide
DEEEIRTTNPMATEIYGAVCSNEQRGNR

SEQ ID NO: 32022 - protein, 30 aa, Artificial Sequence
  Description of Artificial Sequence: Synthetic polypeptide
DEEEIYTTNPVATEQYGSVSEDNLEQTGNL

SEQ ID NO: 32023 - protein, 28 aa, Artificial Sequence
  Description of Artificial Sequence: Synthetic peptide
DEQEIRTTNPCSTEIYGCVSMNLQRGNR

SEQ ID NO: 32024 - protein, 28 aa, Artificial Sequence
  Description of Artificial Sequence: Synthetic peptide
SEEEIRTTNPTATEQFGSVSTNPQRGTV

SEQ ID NO: 32025 - protein, 31 aa, Artificial Sequence
  Description of Artificial Sequence: Synthetic polypeptide
DEEEIRTTNPVATEQYGSWSTCLVQRDGVDR

SEQ ID NO: 32026 - protein, 28 aa, Artificial Sequence
  Description of Artificial Sequence: Synthetic peptide
CEEEIATTNPVATEQYGDVSSNLQWGNM

SEQ ID NO: 32027 - protein, 28 aa, Artificial Sequence
  Description of Artificial Sequence: Synthetic peptide
DEEEIATTNPVATEQYGSVPENCQHGER

SEQ ID NO: 32028 - protein, 29 aa, Artificial Sequence
  Description of Artificial Sequence: Synthetic peptide
DENEIRTTNPVATEQWGSVSENEQNRGNF

SEQ ID NO: 32029 - protein, 28 aa, Artificial Sequence
  Description of Artificial Sequence: Synthetic peptide
SEEEIATTNPVATEMYGSVSTNEQQGNF

SEQ ID NO: 32030 - protein, 28 aa, Artificial Sequence
  Description of Artificial Sequence: Synthetic peptide
DEQEIRTTNPVATEMYGVVSTNLQNGES

SEQ ID NO: 32031 - protein, 31 aa, Artificial Sequence
  Description of Artificial Sequence: Synthetic polypeptide
DEEEIRTTNPHATEQYGSVCSDTVNIQRGNG

SEQ ID NO: 32032 - protein, 28 aa, Artificial Sequence
  Description of Artificial Sequence: Synthetic peptide
DEEEISTTNPVSTEIYGIVSTALQRGNQ

SEQ ID NO: 32033 - protein, 28 aa, Artificial Sequence
  Description of Artificial Sequence: Synthetic peptide
DEFEIRQTNPVATEQYGDCSTNVQRGQR

SEQ ID NO: 32034 - protein, 28 aa, Artificial Sequence
  Description of Artificial Sequence: Synthetic peptide
DEEEIRTTNPVATEQYGSVETDDEREER

SEQ ID NO: 32035 - protein, 28 aa, Artificial Sequence
  Description of Artificial Sequence: Synthetic peptide
DEEEIRTTNPVATEVYGSGPTNLQIGQA

SEQ ID NO: 32036 - protein, 29 aa, Artificial Sequence
  Description of Artificial Sequence: Synthetic peptide
DEQEIRTTNPVATEQWGSVSENLQNLGNL

SEQ ID NO: 32037 - protein, 28 aa, Artificial Sequence
  Description of Artificial Sequence: Synthetic peptide
DEHEIATTNPVATEVYGTVSTDLQRGNF

SEQ ID NO: 32038 - protein, 28 aa, Artificial Sequence
  Description of Artificial Sequence: Synthetic peptide
DENEIRTTNPVATEQWGDVSENEQRENR

SEQ ID NO: 32039 - protein, 30 aa, Artificial Sequence
  Description of Artificial Sequence: Synthetic polypeptide
GEEEIRTTNPVATEIYGCISATNLQRNGNR

SEQ ID NO: 32040 - protein, 28 aa, Artificial Sequence
  Description of Artificial Sequence: Synthetic peptide
DENEIRTTNPVATECYGSVSTDLQTGDQ

SEQ ID NO: 32041 - protein, 28 aa, Artificial Sequence
  Description of Artificial Sequence: Synthetic peptide
KEEEITTTNPVCTEQYGCVSTNLQNGNL

SEQ ID NO: 32042 - protein, 28 aa, Artificial Sequence
  Description of Artificial Sequence: Synthetic peptide
DEQEIRSTNPVATEQWGSVSENLMRGNM

SEQ ID NO: 32043 - protein, 28 aa, Artificial Sequence
  Description of Artificial Sequence: Synthetic peptide
AEEEVNTTNPVATEQYGSVSMNLQRGTA

SEQ ID NO: 32044 - protein, 28 aa, Artificial Sequence
  Description of Artificial Sequence: Synthetic peptide
DEQEIKTTNPVCTEQYGSVSENLQRGII

SEQ ID NO: 32045 - protein, 29 aa, Artificial Sequence
  Description of Artificial Sequence: Synthetic peptide
DENEIRTTNPVATEQWGSVSTNEMMRGNM

SEQ ID NO: 32046 - protein, 28 aa, Artificial Sequence
  Description of Artificial Sequence: Synthetic peptide
MEEEIATTNPVATEQYGSVSTDLQIGDA

SEQ ID NO: 32047 - protein, 28 aa, Artificial Sequence
  Description of Artificial Sequence: Synthetic peptide
DEEEIRATNPVATEQYGTVSANDQHGNA

SEQ ID NO: 32048 - protein, 29 aa, Artificial Sequence
  Description of Artificial Sequence: Synthetic peptide
DEEEIRTTNPVATEQYGSVSENLMRAMQQ

SEQ ID NO: 32049 - protein, 28 aa, Artificial Sequence
  Description of Artificial Sequence: Synthetic peptide
DEQEIRTTNPVATEQYGSVSTDLEHGEF

SEQ ID NO: 32050 - protein, 29 aa, Artificial Sequence
  Description of Artificial Sequence: Synthetic peptide
NEEEIRCTNPVSTEQYGSVDTALQRNGNR

SEQ ID NO: 32051 - protein, 30 aa, Artificial Sequence
  Description of Artificial Sequence: Synthetic polypeptide
DEEEIRCTNPVASEQYGSTATNLQDRNGNR

SEQ ID NO: 32052 - protein, 28 aa, Artificial Sequence
  Description of Artificial Sequence: Synthetic peptide
DEEEIATTNPVATEQYGSASENLMHGNQ

SEQ ID NO: 32053 - protein, 28 aa, Artificial Sequence
  Description of Artificial Sequence: Synthetic peptide
DEQEIRTTNPVASEIYGCVATNLERGNR

SEQ ID NO: 32054 - protein, 29 aa, Artificial Sequence
  Description of Artificial Sequence: Synthetic peptide
GESEIRTTNPVATEQYGSVSDNLEDRGDR

SEQ ID NO: 32055 - protein, 28 aa, Artificial Sequence
  Description of Artificial Sequence: Synthetic peptide
QEEEIRQTNPVATEGYGSAPTNLQHGNR

SEQ ID NO: 32056 - protein, 30 aa, Artificial Sequence
  Description of Artificial Sequence: Synthetic polypeptide
DENEIRTTNPVCTEVYGSVSTNLQNREGTR

SEQ ID NO: 32057 - protein, 28 aa, Artificial Sequence
  Description of Artificial Sequence: Synthetic peptide
DEEEIRTTNPVATECYGVVSTELEYGNL

SEQ ID NO: 32058 - protein, 31 aa, Artificial Sequence
  Description of Artificial Sequence: Synthetic polypeptide
DEEEIRTTNPVATEQYWSMVTSHNLDRGENR

SEQ ID NO: 32059 - protein, 28 aa, Artificial Sequence
  Description of Artificial Sequence: Synthetic peptide
DEVEIATTNPVATEQYGSVTTVLQRGGA

SEQ ID NO: 32060 - protein, 28 aa, Artificial Sequence
  Description of Artificial Sequence: Synthetic peptide
DEGEIYATNPVATEAYGEVSDNLQRGNR

SEQ ID NO: 32061 - protein, 28 aa, Artificial Sequence
  Description of Artificial Sequence: Synthetic peptide
DEQEIRTTNPVATEQYGDVSENDQHGNA

SEQ ID NO: 32062 - protein, 32 aa, Artificial Sequence
  Description of Artificial Sequence: Synthetic polypeptide
DEEEIRTTNPVATEQYGSVSTLNPDQVRGNDP

SEQ ID NO: 32063 - protein, 28 aa, Artificial Sequence
  Description of Artificial Sequence: Synthetic peptide
SEEEIRTTNPTATEQYGSVSTNEQLGTN

SEQ ID NO: 32064 - protein, 28 aa, Artificial Sequence
  Description of Artificial Sequence: Synthetic peptide
DEAEITTTNPVSTEAFGTVSTNLQRGNR

SEQ ID NO: 32065 - protein, 28 aa, Artificial Sequence
  Description of Artificial Sequence: Synthetic peptide
QEEEIRTTNPVATEQYGQVSENVQRGVN

SEQ ID NO: 32066 - protein, 30 aa, Artificial Sequence
  Description of Artificial Sequence: Synthetic polypeptide
MEEEIRTTNPVATECYGSVSTDLQREGNDM

SEQ ID NO: 32067 - protein, 28 aa, Artificial Sequence
  Description of Artificial Sequence: Synthetic peptide
DLEEIRATNPFATEQYGSVSTNLYQGNF

SEQ ID NO: 32068 - protein, 30 aa, Artificial Sequence
  Description of Artificial Sequence: Synthetic polypeptide
DEEEIRATNPVATEQFGSVSTGNLQQGDDR

SEQ ID NO: 32069 - protein, 28 aa, Artificial Sequence
  Description of Artificial Sequence: Synthetic peptide
DEEEIASTNPTATEQYGSVSDNLQRGIF

SEQ ID NO: 32070 - protein, 30 aa, Artificial Sequence
  Description of Artificial Sequence: Synthetic polypeptide
DEEEIRCTNPVATEQYGSVSTNGIQRGDDG

SEQ ID NO: 32071 - protein, 31 aa, Artificial Sequence
  Description of Artificial Sequence: Synthetic polypeptide
DEEEIRTTNPVATEQYGSWTSTPNPQRGTER

SEQ ID NO: 32072 - protein, 28 aa, Artificial Sequence
  Description of Artificial Sequence: Synthetic peptide
DENEIATTNPVATEQYGSVSTDLEHGNL

SEQ ID NO: 32073 - protein, 28 aa, Artificial Sequence
  Description of Artificial Sequence: Synthetic peptide
DDEEIRCTNPIATEQYGQVSTNQQRGTR

SEQ ID NO: 32074 - protein, 29 aa, Artificial Sequence
  Description of Artificial Sequence: Synthetic peptide
DEECIRTTNPVATEQYGSVFTNDCRGEDR

SEQ ID NO: 32075 - protein, 28 aa, Artificial Sequence
  Description of Artificial Sequence: Synthetic peptide
KEDEIRTTNPVADEIYGEVSTNLQRANR

SEQ ID NO: 32076 - protein, 28 aa, Artificial Sequence
  Description of Artificial Sequence: Synthetic peptide
MENEIATTNPVATEQYGSVSTDLQHGNV

SEQ ID NO: 32077 - protein, 30 aa, Artificial Sequence
  Description of Artificial Sequence: Synthetic polypeptide
DEEEIRCTNPCATEQYGSVSSDLQQRNGNR

SEQ ID NO: 32078 - protein, 31 aa, Artificial Sequence
  Description of Artificial Sequence: Synthetic polypeptide
DEEEIRTTNPVAMEQWGSHVSQTPNLQRGNP

SEQ ID NO: 32079 - protein, 28 aa, Artificial Sequence
  Description of Artificial Sequence: Synthetic peptide
DEFEIRTTNPVATEIYGSVSENLQNLNL

SEQ ID NO: 32080 - protein, 28 aa, Artificial Sequence
  Description of Artificial Sequence: Synthetic peptide
GESEIRTTNPVSTEQYGCVGTNDQRGNR

SEQ ID NO: 32081 - protein, 28 aa, Artificial Sequence
  Description of Artificial Sequence: Synthetic peptide
QEEEIGTTNPVATEQYGWASDNLQRGGR

SEQ ID NO: 32082 - protein, 32 aa, Artificial Sequence
  Description of Artificial Sequence: Synthetic polypeptide
DEEEIRTTNPVATEQYGSVESTENLERDGNDG

SEQ ID NO: 32083 - protein, 30 aa, Artificial Sequence
  Description of Artificial Sequence: Synthetic polypeptide
DEEEIRTTNPVATEQYGDASTMDLQQRGNV

SEQ ID NO: 32084 - protein, 28 aa, Artificial Sequence
  Description of Artificial Sequence: Synthetic peptide
KEEEIATTNPVATECYGSVSTELQGGNM

SEQ ID NO: 32085 - protein, 28 aa, Artificial Sequence
  Description of Artificial Sequence: Synthetic peptide
QEQEIRTTNPVATEQYGCVSTNLQIGEN

SEQ ID NO: 32086 - protein, 29 aa, Artificial Sequence
  Description of Artificial Sequence: Synthetic peptide
HEEEIRTTNPVATETYGSVSDFILQRGQR

SEQ ID NO: 32087 - protein, 28 aa, Artificial Sequence
  Description of Artificial Sequence: Synthetic peptide
DEIEIETTNPVATEVYGAVSTNLQRGQA

SEQ ID NO: 32088 - protein, 30 aa, Artificial Sequence
  Description of Artificial Sequence: Synthetic polypeptide
NEEEIRTTNPVATEQYGSWSTNPLCRGNDC

SEQ ID NO: 32089 - protein, 28 aa, Artificial Sequence
  Description of Artificial Sequence: Synthetic peptide
DEHEIRTTNPVATEVYGSVPTVLMRGER

SEQ ID NO: 32090 - protein, 31 aa, Artificial Sequence
  Description of Artificial Sequence: Synthetic polypeptide
DEEEIMTTNPVATEQYGSVSTINLALSKGNR

SEQ ID NO: 32091 - protein, 28 aa, Artificial Sequence
  Description of Artificial Sequence: Synthetic peptide
DEEEIRTTNPVASENYGTVSMNLQRGTQ

SEQ ID NO: 32092 - protein, 28 aa, Artificial Sequence
  Description of Artificial Sequence: Synthetic peptide
DEEEIRTTNPVATEQYGSVETDEQMGET

SEQ ID NO: 32093 - protein, 31 aa, Artificial Sequence
  Description of Artificial Sequence: Synthetic polypeptide
DEEEIRTTNPVATEQYGSVNDCNLQAEGYNR

SEQ ID NO: 32094 - protein, 28 aa, Artificial Sequence
  Description of Artificial Sequence: Synthetic peptide
DETEIVTTNPVATEQYGSAGDNLQNGNR

SEQ ID NO: 32095 - protein, 29 aa, Artificial Sequence
  Description of Artificial Sequence: Synthetic peptide
DEEEIRTTNPVAHEQYGSVWTNLQVFDSR

SEQ ID NO: 32096 - protein, 28 aa, Artificial Sequence
  Description of Artificial Sequence: Synthetic peptide
DEEEIRTTNPCATEQYGDVADNLQYGND

SEQ ID NO: 32097 - protein, 28 aa, Artificial Sequence
  Description of Artificial Sequence: Synthetic peptide
DEEEIRTTNPFATEQYGSVETGLIPGNP

SEQ ID NO: 32098 - protein, 28 aa, Artificial Sequence
  Description of Artificial Sequence: Synthetic peptide
DEEEIRTTNPVATEQYGSVETPDDVGND

SEQ ID NO: 32099 - protein, 30 aa, Artificial Sequence
  Description of Artificial Sequence: Synthetic polypeptide
SEEEIRTTNPVATEMYGGVISTNLQREGNF

SEQ ID NO: 32100 - protein, 28 aa, Artificial Sequence
  Description of Artificial Sequence: Synthetic peptide
DEEEIAAVNPVSTEQYGSVSTNLQHGGR

SEQ ID NO: 32101 - protein, 32 aa, Artificial Sequence
  Description of Artificial Sequence: Synthetic polypeptide
DEEEIRTTNPVATEQFGSVISTENLPQRGNTA

SEQ ID NO: 32102 - protein, 28 aa, Artificial Sequence
  Description of Artificial Sequence: Synthetic peptide
DEEEISSTNPFATEQYGWVSTALQLGNR

SEQ ID NO: 32103 - protein, 28 aa, Artificial Sequence
  Description of Artificial Sequence: Synthetic peptide
DEIEIGTTNPVATEHYGSVSDTLQRGNQ

SEQ ID NO: 32104 - protein, 28 aa, Artificial Sequence
  Description of Artificial Sequence: Synthetic peptide
DEEEIRCTNPVATECYGIVDTNLQQGNL

SEQ ID NO: 32105 - protein, 29 aa, Artificial Sequence
  Description of Artificial Sequence: Synthetic peptide
QEDEIRQTNPVATEQYGSVSEDLQRGNDR

SEQ ID NO: 32106 - protein, 30 aa, Artificial Sequence
  Description of Artificial Sequence: Synthetic polypeptide
DEQEIRCTNPVASEQYGAVSATNLQRNGNR

SEQ ID NO: 32107 - protein, 28 aa, Artificial Sequence
  Description of Artificial Sequence: Synthetic peptide
DEEEIRTTNPVATEPYGVVSSNDERGNM

SEQ ID NO: 32108 - protein, 29 aa, Artificial Sequence
  Description of Artificial Sequence: Synthetic peptide
GEEEISSTNPVASEQYGSVSTNLQERGNW

SEQ ID NO: 32109 - protein, 28 aa, Artificial Sequence
  Description of Artificial Sequence: Synthetic peptide
DEMEIRTTNPVATEQYGQVSTPDQMGNQ

SEQ ID NO: 32110 - protein, 29 aa, Artificial Sequence
  Description of Artificial Sequence: Synthetic peptide
DEEEIRTTNPVCTEQYGSASEDLQRGNDA

SEQ ID NO: 32111 - protein, 31 aa, Artificial Sequence
  Description of Artificial Sequence: Synthetic polypeptide
DEEEIRTTNPVATEQYGSVSETEDQRGENDW

SEQ ID NO: 32112 - protein, 31 aa, Artificial Sequence
  Description of Artificial Sequence: Synthetic polypeptide
DEEEIRTTNPEATEQYGCSVSTNNEQRQNHR

SEQ ID NO: 32113 - protein, 28 aa, Artificial Sequence
  Description of Artificial Sequence: Synthetic peptide
DEQEIRTTNPVATEQYGSVGTNEQRPQF

SEQ ID NO: 32114 - protein, 28 aa, Artificial Sequence
  Description of Artificial Sequence: Synthetic peptide
MENEIRATNPVATEQYGSVSENLQYGNW

SEQ ID NO: 32115 - protein, 28 aa, Artificial Sequence
  Description of Artificial Sequence: Synthetic peptide
DEEEIMCTNPVCTEQYGSVSTDVQRGNL

SEQ ID NO: 32116 - protein, 28 aa, Artificial Sequence
  Description of Artificial Sequence: Synthetic peptide
DENEIRTTNPVATEQWGSVSENEMRGNF

SEQ ID NO: 32117 - protein, 30 aa, Artificial Sequence
  Description of Artificial Sequence: Synthetic polypeptide
DEEEIRTTNPVATEQYGSVSTCEVFIRGER

SEQ ID NO: 32118 - protein, 31 aa, Artificial Sequence
  Description of Artificial Sequence: Synthetic polypeptide
DEEEIRTTNPVATEQYGSHVTSELLQRGNGC

SEQ ID NO: 32119 - protein, 28 aa, Artificial Sequence
  Description of Artificial Sequence: Synthetic peptide
KEEEIRTTNPVATECYGSVSTELQHGDL

SEQ ID NO: 32120 - protein, 28 aa, Artificial Sequence
  Description of Artificial Sequence: Synthetic peptide
QEEEIRTVNPVSTEQYGSASENLQHGNR

SEQ ID NO: 32121 - protein, 30 aa, Artificial Sequence
  Description of Artificial Sequence: Synthetic polypeptide
DEEEITTTNPTATEQYGSVSTNLQMFGVNF

SEQ ID NO: 32122 - protein, 28 aa, Artificial Sequence
  Description of Artificial Sequence: Synthetic peptide
DEEEITATNPVATEVYGSVGTPLQYGNR

SEQ ID NO: 32123 - protein, 28 aa, Artificial Sequence
  Description of Artificial Sequence: Synthetic peptide
QEEEIRTTNPCATEVYGSVPTNLQRENL

SEQ ID NO: 32124 - protein, 30 aa, Artificial Sequence
  Description of Artificial Sequence: Synthetic polypeptide
DEEMIRTTNPVAWQQYGSVTSTNLQRGNQP

SEQ ID NO: 32125 - protein, 28 aa, Artificial Sequence
  Description of Artificial Sequence: Synthetic peptide
KEEEIRCTNPVATEQYGVVSTNLCTGNQ

SEQ ID NO: 32126 - protein, 28 aa, Artificial Sequence
  Description of Artificial Sequence: Synthetic peptide
CESEIRATNPVATEQYGEVSDILQRGNR

SEQ ID NO: 32127 - protein, 33 aa, Artificial Sequence
  Description of Artificial Sequence: Synthetic polypeptide
DEEEIRTTNPVATEQYGSVDSVTVNQQSRGINR

SEQ ID NO: 32128 - protein, 28 aa, Artificial Sequence
  Description of Artificial Sequence: Synthetic peptide
DEEEIRCTNPVATEVYGSVSMPLERGNQ

SEQ ID NO: 32129 - protein, 32 aa, Artificial Sequence
  Description of Artificial Sequence: Synthetic polypeptide
DEEEIRTTNPVATEQYGSVSTCPLVLDRGTNR

SEQ ID NO: 32130 - protein, 28 aa, Artificial Sequence
  Description of Artificial Sequence: Synthetic peptide
DEEEIRTTNPVGTEQYGSVNENEQNGNY

SEQ ID NO: 32131 - protein, 28 aa, Artificial Sequence
  Description of Artificial Sequence: Synthetic peptide
DEEEIRTTNPCATEQYGSADYNLSRGNT

SEQ ID NO: 32132 - protein, 28 aa, Artificial Sequence
  Description of Artificial Sequence: Synthetic peptide
DEEEIRCTNPVATEWYGSVDTNLQTGTW

SEQ ID NO: 32133 - protein, 29 aa, Artificial Sequence
  Description of Artificial Sequence: Synthetic peptide
AEEEIRTVNPVATEQYGDVSTNLQRAGQQ

SEQ ID NO: 32134 - protein, 28 aa, Artificial Sequence
  Description of Artificial Sequence: Synthetic peptide
DEEEIAATNPIATETYGCVSNNLQRGNR

SEQ ID NO: 32135 - protein, 31 aa, Artificial Sequence
  Description of Artificial Sequence: Synthetic polypeptide
QEEEICTTNPVATEQYGSVDSTENLQRGNDL

SEQ ID NO: 32136 - protein, 29 aa, Artificial Sequence
  Description of Artificial Sequence: Synthetic peptide
DEQEIRTTNPVATECYGSVSTNLQWQGTQ

SEQ ID NO: 32137 - protein, 30 aa, Artificial Sequence
  Description of Artificial Sequence: Synthetic polypeptide
DENEIATTNPVATEQYGSVSTMNGLQRGTG

SEQ ID NO: 32138 - protein, 28 aa, Artificial Sequence
  Description of Artificial Sequence: Synthetic peptide
DEQEIRTTNPDATEQYGSVSTELESGNF

SEQ ID NO: 32139 - protein, 31 aa, Artificial Sequence
  Description of Artificial Sequence: Synthetic polypeptide
DENEIVTTNPVATEQYGSVCSATTNLQRENR

SEQ ID NO: 32140 - protein, 33 aa, Artificial Sequence
  Description of Artificial Sequence: Synthetic polypeptide
DEEEIRTTNPVASEQYGSVTSTINLQERGINPR

SEQ ID NO: 32141 - protein, 30 aa, Artificial Sequence
  Description of Artificial Sequence: Synthetic polypeptide
QEEEIATTNPVATEQYGSVSTNLQNRAEQR

SEQ ID NO: 32142 - protein, 28 aa, Artificial Sequence
  Description of Artificial Sequence: Synthetic peptide
DEQEIRTTNPVATEQYGSVETDLDEGNM

SEQ ID NO: 32143 - protein, 28 aa, Artificial Sequence
  Description of Artificial Sequence: Synthetic peptide
DEEEIASTNPVATEQYGSVSSDLMRGNI

SEQ ID NO: 32144 - protein, 28 aa, Artificial Sequence
  Description of Artificial Sequence: Synthetic peptide
QEEEIVTVNPVATEQYGEVSTVLQRENR

SEQ ID NO: 32145 - protein, 28 aa, Artificial Sequence
  Description of Artificial Sequence: Synthetic peptide
DEEEIRTTNPDATEQYGSVDTNLDLGLA

SEQ ID NO: 32146 - protein, 28 aa, Artificial Sequence
  Description of Artificial Sequence: Synthetic peptide
DEQEIRATNPVATEIYGWVATNLQRLNR

SEQ ID NO: 32147 - protein, 28 aa, Artificial Sequence
  Description of Artificial Sequence: Synthetic peptide
DEVEIRSTNPVATEQYGSVSTNDQLENQ

SEQ ID NO: 32148 - protein, 29 aa, Artificial Sequence
  Description of Artificial Sequence: Synthetic peptide
DEEEIRATNPTATEQFGSVSENLQQEGNR

SEQ ID NO: 32149 - protein, 28 aa, Artificial Sequence
  Description of Artificial Sequence: Synthetic peptide
MEQEIATTNPVATEQYGSVSTELQTGNS

SEQ ID NO: 32150 - protein, 29 aa, Artificial Sequence
  Description of Artificial Sequence: Synthetic peptide
DEEEIATTNPCATEQYGCVSATNVQRGNF

SEQ ID NO: 32151 - protein, 29 aa, Artificial Sequence
  Description of Artificial Sequence: Synthetic peptide
EEEEIATTNPVATEQYGSVSECKLQFGNR

SEQ ID NO: 32152 - protein, 28 aa, Artificial Sequence
  Description of Artificial Sequence: Synthetic peptide
SEVEICTVNPVATEQYGSVSTNLQSGNT

SEQ ID NO: 32153 - protein, 28 aa, Artificial Sequence
  Description of Artificial Sequence: Synthetic peptide
DEEELRTVNPVCYEQYGSVSTNVQRGLR

SEQ ID NO: 32154 - protein, 28 aa, Artificial Sequence
  Description of Artificial Sequence: Synthetic peptide
AETEIRTTNPVSTEQYGSVSTNLMRGTQ

SEQ ID NO: 32155 - protein, 28 aa, Artificial Sequence
  Description of Artificial Sequence: Synthetic peptide
MENEIATTNPVATEQYGSVSENLQLGNQ

SEQ ID NO: 32156 - protein, 28 aa, Artificial Sequence
  Description of Artificial Sequence: Synthetic peptide
DENEIRTTNPVATEQYGWVSTNQERGED

SEQ ID NO: 32157 - protein, 29 aa, Artificial Sequence
  Description of Artificial Sequence: Synthetic peptide
DEEEVRTTNPVATEQWGSASATNLQQGQR

SEQ ID NO: 32158 - protein, 28 aa, Artificial Sequence
  Description of Artificial Sequence: Synthetic peptide
DEEEINTTNPVATELYGGVSENIQQGNR

SEQ ID NO: 32159 - protein, 31 aa, Artificial Sequence
  Description of Artificial Sequence: Synthetic polypeptide
DEEEIRTTNPCATEQYGSVSTMNEQTQNGNR

SEQ ID NO: 32160 - protein, 28 aa, Artificial Sequence
  Description of Artificial Sequence: Synthetic peptide
DEEEIRATNPVCTEQFGSVSENLQVGDR

SEQ ID NO: 32161 - protein, 28 aa, Artificial Sequence
  Description of Artificial Sequence: Synthetic peptide
RESEIRSTNPVATEQYGTASTNDQRGNR

SEQ ID NO: 32162 - protein, 29 aa, Artificial Sequence
  Description of Artificial Sequence: Synthetic peptide
HEEEIRTTNPVATEIYGTVAATNLQRGNL

SEQ ID NO: 32163 - protein, 32 aa, Artificial Sequence
  Description of Artificial Sequence: Synthetic polypeptide
DEEEIRTTNPVATEQYGESVSETACLQDRGNE

SEQ ID NO: 32164 - protein, 28 aa, Artificial Sequence
  Description of Artificial Sequence: Synthetic peptide
VDEEIATTNPVCTEIYGAVSTNLQRGNR

SEQ ID NO: 32165 - protein, 28 aa, Artificial Sequence
  Description of Artificial Sequence: Synthetic peptide
DEEEIRTTNPCATEQYGVVSSAEQRGNV

SEQ ID NO: 32166 - protein, 31 aa, Artificial Sequence
  Description of Artificial Sequence: Synthetic polypeptide
DEEEIRTTNPAATEQYGSVSATNGQNHGNWR

SEQ ID NO: 32167 - protein, 29 aa, Artificial Sequence
  Description of Artificial Sequence: Synthetic peptide
DEEEIRTTNPVATEPYGCVSMMNLQNGNI

SEQ ID NO: 32168 - protein, 28 aa, Artificial Sequence
  Description of Artificial Sequence: Synthetic peptide
DEEEVRAVNPVAYEPYGSVGTNLQRGNR

SEQ ID NO: 32169 - protein, 30 aa, Artificial Sequence
  Description of Artificial Sequence: Synthetic polypeptide
QEEEIRTTNPVATEQYGVVSTALQDREGNN

SEQ ID NO: 32170 - protein, 32 aa, Artificial Sequence
  Description of Artificial Sequence: Synthetic polypeptide
DEEEIRTTNPVATEQYGSWVSTMNLHWRGESR

SEQ ID NO: 32171 - protein, 28 aa, Artificial Sequence
  Description of Artificial Sequence: Synthetic peptide
QEDEITTTNPVATEQYGTVSTGLQRGNF

SEQ ID NO: 32172 - protein, 28 aa, Artificial Sequence
  Description of Artificial Sequence: Synthetic peptide
DENEIRTTNPVATECYGVVSTDLQSGNS

SEQ ID NO: 32173 - protein, 28 aa, Artificial Sequence
  Description of Artificial Sequence: Synthetic peptide
DEEEIRTTNPVATEWWGIVDTNLMRGTR

SEQ ID NO: 32174 - protein, 28 aa, Artificial Sequence
  Description of Artificial Sequence: Synthetic peptide
DEEEIASVNPVATENYGSCSTLLQRGNR

SEQ ID NO: 32175 - protein, 28 aa, Artificial Sequence
  Description of Artificial Sequence: Synthetic peptide
VEEEIRTTNPCCTEMYGNVSTNLQRGNQ

SEQ ID NO: 32176 - protein, 28 aa, Artificial Sequence
  Description of Artificial Sequence: Synthetic peptide
DESEIRATNPVATEQYGIVSTNLEAGNT

SEQ ID NO: 32177 - protein, 28 aa, Artificial Sequence
  Description of Artificial Sequence: Synthetic peptide
DECEIRTTNPVSTEQYGQVETPLQRPNR

SEQ ID NO: 32178 - protein, 28 aa, Artificial Sequence
  Description of Artificial Sequence: Synthetic peptide
DENEIATTNPVATECYGSAPTNEQRGNR

SEQ ID NO: 32179 - protein, 28 aa, Artificial Sequence
  Description of Artificial Sequence: Synthetic peptide
DEEEIRTTNPVATEAYGSWSTNDEDGNQ

SEQ ID NO: 32180 - protein, 30 aa, Artificial Sequence
  Description of Artificial Sequence: Synthetic polypeptide
DEEEIRTVNPVATEQYGEVSAENLQHAGNR

SEQ ID NO: 32181 - protein, 28 aa, Artificial Sequence
  Description of Artificial Sequence: Synthetic peptide
DEEEIRTTNPFATEQYWSVSPNLEREND

SEQ ID NO: 32182 - protein, 31 aa, Artificial Sequence
  Description of Artificial Sequence: Synthetic polypeptide
DEEEIYTTNPVATEQYGSVSETENPNRGDNR

SEQ ID NO: 32183 - protein, 32 aa, Artificial Sequence
  Description of Artificial Sequence: Synthetic polypeptide
DEEEIRTTNPVATEQYGSVSETGNLVQPGNDA

SEQ ID NO: 32184 - protein, 28 aa, Artificial Sequence
  Description of Artificial Sequence: Synthetic peptide
DDEEIRATNPCATEQYGSVGSNLQRGNS

SEQ ID NO: 32185 - protein, 31 aa, Artificial Sequence
  Description of Artificial Sequence: Synthetic polypeptide
SEEEIRTTNPVATEQYGSVDSTCLPQMGINR

SEQ ID NO: 32186 - protein, 28 aa, Artificial Sequence
  Description of Artificial Sequence: Synthetic peptide
DEEEIRCTNPVATEVFGSVSTNDQGGNT

SEQ ID NO: 32187 - protein, 28 aa, Artificial Sequence
  Description of Artificial Sequence: Synthetic peptide
DDQEIRTTNPVATEQWGSVSTNEMRGNM

SEQ ID NO: 32188 - protein, 31 aa, Artificial Sequence
  Description of Artificial Sequence: Synthetic polypeptide
DEEEIRTTNPVATEQYGSVSETDLERKGENI

SEQ ID NO: 32189 - protein, 28 aa, Artificial Sequence
  Description of Artificial Sequence: Synthetic peptide
DEEEIRTTNPIAYETYGCVATNLERGNR

SEQ ID NO: 32190 - protein, 31 aa, Artificial Sequence
  Description of Artificial Sequence: Synthetic polypeptide
DEEELRTTNPVATEQYGSRVSTELGQMRGQR

SEQ ID NO: 32191 - protein, 28 aa, Artificial Sequence
  Description of Artificial Sequence: Synthetic peptide
GESEIRTTNPVSTEQYGSVGTNDQFGNR

SEQ ID NO: 32192 - protein, 28 aa, Artificial Sequence
  Description of Artificial Sequence: Synthetic peptide
DEQEIATTNPVATECYGSVSTDLQRGEA

SEQ ID NO: 32193 - protein, 28 aa, Artificial Sequence
  Description of Artificial Sequence: Synthetic peptide
DEEEIRTTNPVATEQYGSVSTADLTGEA

SEQ ID NO: 32194 - protein, 28 aa, Artificial Sequence
  Description of Artificial Sequence: Synthetic peptide
DEEEVRTTNPVATFTYGSVANNLQDGNR

SEQ ID NO: 32195 - protein, 30 aa, Artificial Sequence
  Description of Artificial Sequence: Synthetic polypeptide
DEEEVRTTNPEATEQWGSVPSNNLQRAGNR

SEQ ID NO: 32196 - protein, 28 aa, Artificial Sequence
  Description of Artificial Sequence: Synthetic peptide
NDEEIRATNPVATEIYGVVSTNLQRLNR

SEQ ID NO: 32197 - protein, 28 aa, Artificial Sequence
  Description of Artificial Sequence: Synthetic peptide
DEDEIRTCNPVATEQFGSVSTNVQVGNF

SEQ ID NO: 32198 - protein, 28 aa, Artificial Sequence
  Description of Artificial Sequence: Synthetic peptide
DEEEIRTTNPVATEQYGSVETDDDIGNM

SEQ ID NO: 32199 - protein, 28 aa, Artificial Sequence
  Description of Artificial Sequence: Synthetic peptide
DEEEIMTTNPVCTEGYGSVSDNLQDGNC

SEQ ID NO: 32200 - protein, 29 aa, Artificial Sequence
  Description of Artificial Sequence: Synthetic peptide
DECEIRTTNPVATEQYGSTATEELQRGNN

SEQ ID NO: 32201 - protein, 30 aa, Artificial Sequence
  Description of Artificial Sequence: Synthetic polypeptide
DEEEIRTTNPVATEQYGSVISENEQRGDTF

SEQ ID NO: 32202 - protein, 28 aa, Artificial Sequence
  Description of Artificial Sequence: Synthetic peptide
NEEEIRTTNPVATEQYGWVSTCDQMLNR

SEQ ID NO: 32203 - protein, 30 aa, Artificial Sequence
  Description of Artificial Sequence: Synthetic polypeptide
DENEIRTTNPVATECYGSVSTELQERGNDH

SEQ ID NO: 32204 - protein, 28 aa, Artificial Sequence
  Description of Artificial Sequence: Synthetic peptide
DENEIRTTNPVATEIFGSVSTNLERGTD

SEQ ID NO: 32205 - protein, 28 aa, Artificial Sequence
  Description of Artificial Sequence: Synthetic peptide
DENEIRTTNPVATEIWGSVSENLQVGNF

SEQ ID NO: 32206 - protein, 28 aa, Artificial Sequence
  Description of Artificial Sequence: Synthetic peptide
SEEEIRTTNPVASEQYGSVADDLQMGNR

SEQ ID NO: 32207 - protein, 29 aa, Artificial Sequence
  Description of Artificial Sequence: Synthetic peptide
QEQEITTTNPVATEQYGEVSADNLQRGNR

SEQ ID NO: 32208 - protein, 28 aa, Artificial Sequence
  Description of Artificial Sequence: Synthetic peptide
DEEEISTTNPVATEVYGSVATNVQQENR

SEQ ID NO: 32209 - protein, 32 aa, Artificial Sequence
  Description of Artificial Sequence: Synthetic polypeptide
DEEEIRTTNPVAYEQYGQSVSTNDLLQRGIRR

SEQ ID NO: 32210 - protein, 28 aa, Artificial Sequence
  Description of Artificial Sequence: Synthetic peptide
DEQEIRTTNPVATEQWGSVSENEMRGNM

SEQ ID NO: 32211 - protein, 28 aa, Artificial Sequence
  Description of Artificial Sequence: Synthetic peptide
DENEIRTTNPCATEQYGSVSTGLQRPTD

SEQ ID NO: 32212 - protein, 28 aa, Artificial Sequence
  Description of Artificial Sequence: Synthetic peptide
DEEEIRTTNPVATEQYGSVSTDDDDGEC

SEQ ID NO: 32213 - protein, 29 aa, Artificial Sequence
  Description of Artificial Sequence: Synthetic peptide
GDEEIRTTNPVATEIYGSVSDNLQTGNDR

SEQ ID NO: 32214 - protein, 28 aa, Artificial Sequence
  Description of Artificial Sequence: Synthetic peptide
SEEEIRTTNPVATEQFGGVSTNLQQGDF

SEQ ID NO: 32215 - protein, 28 aa, Artificial Sequence
  Description of Artificial Sequence: Synthetic peptide
DEEEIRSTNPVATEVYGGVSTELNVGNR

SEQ ID NO: 32216 - protein, 28 aa, Artificial Sequence
  Description of Artificial Sequence: Synthetic peptide
DEEEIRTTNPCATEVYGSVSMNDQFGNT

SEQ ID NO: 32217 - protein, 30 aa, Artificial Sequence
  Description of Artificial Sequence: Synthetic polypeptide
DEEEIRTTNPASTEQYGSVSTLNLQRGTQA

SEQ ID NO: 32218 - protein, 28 aa, Artificial Sequence
  Description of Artificial Sequence: Synthetic peptide
DEEEIRTTNPVATEQYGSWETNEEREDR

SEQ ID NO: 32219 - protein, 28 aa, Artificial Sequence
  Description of Artificial Sequence: Synthetic peptide
EENEIVTTNPVATEQYGSVSENLQRGML

SEQ ID NO: 32220 - protein, 28 aa, Artificial Sequence
  Description of Artificial Sequence: Synthetic peptide
DDSEIRCTNPVATEQYGSVSTNVFRGLR

SEQ ID NO: 32221 - protein, 28 aa, Artificial Sequence
  Description of Artificial Sequence: Synthetic peptide
EENEIRTTNPVATEQYGDVSTNLQSFLR

SEQ ID NO: 32222 - protein, 28 aa, Artificial Sequence
  Description of Artificial Sequence: Synthetic peptide
DEQEIATTNPVATECYGSVSTDLQVGER

SEQ ID NO: 32223 - protein, 29 aa, Artificial Sequence
  Description of Artificial Sequence: Synthetic peptide
MENEIRTTNPVATECYGSVSTNLQAHGNQ

SEQ ID NO: 32224 - protein, 29 aa, Artificial Sequence
  Description of Artificial Sequence: Synthetic peptide
NEHEIRCTNPVATEQYGSVSATNWQRGNV

SEQ ID NO: 32225 - protein, 28 aa, Artificial Sequence
  Description of Artificial Sequence: Synthetic peptide
DEEEVRAVNPVATEHYGCVSTNLQRGTR

SEQ ID NO: 32226 - protein, 28 aa, Artificial Sequence
  Description of Artificial Sequence: Synthetic peptide
DEEEIRTTNPVSTEQYGIVSTNEQIGTQ

SEQ ID NO: 32227 - protein, 28 aa, Artificial Sequence
  Description of Artificial Sequence: Synthetic peptide
DEEEIRTTNPVATEQYGSVETDLEIENM

SEQ ID NO: 32228 - protein, 29 aa, Artificial Sequence
  Description of Artificial Sequence: Synthetic peptide
DENEIRTTNPVATEQWGSVSENLQMRGTA

SEQ ID NO: 32229 - protein, 28 aa, Artificial Sequence
  Description of Artificial Sequence: Synthetic peptide
DEQEIRTTNPVATECYGSVSTDLEHGER

SEQ ID NO: 32230 - protein, 31 aa, Artificial Sequence
  Description of Artificial Sequence: Synthetic polypeptide
DEEEIRTTNPVATEQYGSVESDTNLDPGENP

SEQ ID NO: 32231 - protein, 28 aa, Artificial Sequence
  Description of Artificial Sequence: Synthetic peptide
AEEEITQTNPVATEQYGSVSENLQQGNV

SEQ ID NO: 32232 - protein, 30 aa, Artificial Sequence
  Description of Artificial Sequence: Synthetic polypeptide
DENEIRTTNPVATECYGSVSECLQRAGNDR

SEQ ID NO: 32233 - protein, 28 aa, Artificial Sequence
  Description of Artificial Sequence: Synthetic peptide
DEQEVRCTNPVASEQYGCVSTNLERGNR

SEQ ID NO: 32234 - protein, 28 aa, Artificial Sequence
  Description of Artificial Sequence: Synthetic peptide
DEEEVRTTNPVASEIYGVVATNLERGNR

SEQ ID NO: 32235 - protein, 31 aa, Artificial Sequence
  Description of Artificial Sequence: Synthetic polypeptide
AEQEIRTTNPVATEQYGSVSTGNLERNGVNR

SEQ ID NO: 32236 - protein, 31 aa, Artificial Sequence
  Description of Artificial Sequence: Synthetic polypeptide
DEEEIRTTNPCATEQYGSVSCTNDQRNGNDS

SEQ ID NO: 32237 - protein, 28 aa, Artificial Sequence
  Description of Artificial Sequence: Synthetic peptide
QEEEIRATNPVATEQYGSASTVLQHGMR

SEQ ID NO: 32238 - protein, 29 aa, Artificial Sequence
  Description of Artificial Sequence: Synthetic peptide
QEQEISTTNPVATEQYGDVSAENLQRGNR

SEQ ID NO: 32239 - protein, 29 aa, Artificial Sequence
  Description of Artificial Sequence: Synthetic peptide
DENEIRTTNPVATEIYGSVSTNLEIGNDE

SEQ ID NO: 32240 - protein, 28 aa, Artificial Sequence
  Description of Artificial Sequence: Synthetic peptide
DEQEIRTTNPVATECYGSVSENLQTGTQ

SEQ ID NO: 32241 - protein, 28 aa, Artificial Sequence
  Description of Artificial Sequence: Synthetic peptide
DEVEIAATNPVATECYGSVSTELQRGNF

SEQ ID NO: 32242 - protein, 28 aa, Artificial Sequence
  Description of Artificial Sequence: Synthetic peptide
DEEEIRSTNPVATEIYGSVDTADQTGNR

SEQ ID NO: 32243 - protein, 28 aa, Artificial Sequence
  Description of Artificial Sequence: Synthetic peptide
DEEEIRQTNPVATEQYGSVSTGQEHGNV

SEQ ID NO: 32244 - protein, 32 aa, Artificial Sequence
  Description of Artificial Sequence: Synthetic polypeptide
DEEEIRTTNPVATEQYGSVEETNEQIRKGDNR

SEQ ID NO: 32245 - protein, 28 aa, Artificial Sequence
  Description of Artificial Sequence: Synthetic peptide
DEEEVRTTNPVCTEVYGFVSNNLQRGNQ

SEQ ID NO: 32246 - protein, 28 aa, Artificial Sequence
  Description of Artificial Sequence: Synthetic peptide
SEEEIRATNPVATEMFGSVSENLQRGTR

SEQ ID NO: 32247 - protein, 28 aa, Artificial Sequence
  Description of Artificial Sequence: Synthetic peptide
AEEEIAQTNPVATEQYGVVSENQQRGNR

SEQ ID NO: 32248 - protein, 30 aa, Artificial Sequence
  Description of Artificial Sequence: Synthetic polypeptide
DEEEIATTNPVATEQYGDVSCTMDLCRGNR

SEQ ID NO: 32249 - protein, 31 aa, Artificial Sequence
  Description of Artificial Sequence: Synthetic polypeptide
DEEEIRTTNPVATEQYGSVGSTNLHNKGNDW

SEQ ID NO: 32250 - protein, 28 aa, Artificial Sequence
  Description of Artificial Sequence: Synthetic peptide
DEEEIRTTNPVATEQYGSVETNDEREEF

SEQ ID NO: 32251 - protein, 28 aa, Artificial Sequence
  Description of Artificial Sequence: Synthetic peptide
DEHEITTTNPVATEQYGDVSENDQRGNA

SEQ ID NO: 32252 - protein, 28 aa, Artificial Sequence
  Description of Artificial Sequence: Synthetic peptide
DEEEIRTVNPVATEQYGSASSNWQRLNF

SEQ ID NO: 32253 - protein, 31 aa, Artificial Sequence
  Description of Artificial Sequence: Synthetic polypeptide
DEGEIRTTNPVATEQYGSVISTNEQDRGPTR

SEQ ID NO: 32254 - protein, 32 aa, Artificial Sequence
  Description of Artificial Sequence: Synthetic polypeptide
DEEEIRTTNPVATEQYGSVSVTPLVQRGDEPR

SEQ ID NO: 32255 - protein, 28 aa, Artificial Sequence
  Description of Artificial Sequence: Synthetic peptide
DEEEIAPTNPVATEHYGQVSTVLQRGNM

SEQ ID NO: 32256 - protein, 31 aa, Artificial Sequence
  Description of Artificial Sequence: Synthetic polypeptide
DEEEIRTTNPVATEQYGESVEETNLQREGDP

SEQ ID NO: 32257 - protein, 28 aa, Artificial Sequence
  Description of Artificial Sequence: Synthetic peptide
DEAEIVTTNPVATEQYGSVSMELQVGNY

SEQ ID NO: 32258 - protein, 28 aa, Artificial Sequence
  Description of Artificial Sequence: Synthetic peptide
DEVEIATTNPVATEQYGSVPTNEQHFNR

SEQ ID NO: 32259 - protein, 28 aa, Artificial Sequence
  Description of Artificial Sequence: Synthetic peptide
DEEEIRTTNPVATEQWGDVSTILMRENA

SEQ ID NO: 32260 - protein, 31 aa, Artificial Sequence
  Description of Artificial Sequence: Synthetic polypeptide
DEEEIRTTNPVATEQYGSVSTANPQELGNTG

SEQ ID NO: 32261 - protein, 29 aa, Artificial Sequence
  Description of Artificial Sequence: Synthetic peptide
DENEIRTTNPVATEQWGSVSENEQMQGNR

SEQ ID NO: 32262 - protein, 28 aa, Artificial Sequence
  Description of Artificial Sequence: Synthetic peptide
DEEEIRTTNPVATEVYGGVRTNLQNSNT

SEQ ID NO: 32263 - protein, 28 aa, Artificial Sequence
  Description of Artificial Sequence: Synthetic peptide
DEDEIRCTNPVATEQYGSVGTNLQQGTV

SEQ ID NO: 32264 - protein, 30 aa, Artificial Sequence
  Description of Artificial Sequence: Synthetic polypeptide
SEEEIRTTNPVATESYGSVSNTNLHRGDQR

SEQ ID NO: 32265 - protein, 31 aa, Artificial Sequence
  Description of Artificial Sequence: Synthetic polypeptide
DEEEIATTNPVATEQYGDVSCTMDLQCRGNR

SEQ ID NO: 32266 - protein, 28 aa, Artificial Sequence
  Description of Artificial Sequence: Synthetic peptide
DEHEIRTTNPVATEQYGDVSEDLQAGNE

SEQ ID NO: 32267 - protein, 28 aa, Artificial Sequence
  Description of Artificial Sequence: Synthetic peptide
DEEEIRTTNPCATEQYGSVFTNWCNGND

SEQ ID NO: 32268 - protein, 28 aa, Artificial Sequence
  Description of Artificial Sequence: Synthetic peptide
CESEIRTTNPVATEQYGSVANNVQGGNR

SEQ ID NO: 32269 - protein, 28 aa, Artificial Sequence
  Description of Artificial Sequence: Synthetic peptide
AENEIATTNPVATEQYGSVSTNDEPGNR

SEQ ID NO: 32270 - protein, 28 aa, Artificial Sequence
  Description of Artificial Sequence: Synthetic peptide
DEEEIRTTNPECTEVFGSVSTNEQLGNR

SEQ ID NO: 32271 - protein, 30 aa, Artificial Sequence
  Description of Artificial Sequence: Synthetic polypeptide
DEEEIRTTNPVATEQYGSVVSEMLLQRGDT

SEQ ID NO: 32272 - protein, 29 aa, Artificial Sequence
  Description of Artificial Sequence: Synthetic peptide
DEEEIRTTNPVATEQYGIVDTNDQWRGDQ

SEQ ID NO: 32273 - protein, 28 aa, Artificial Sequence
  Description of Artificial Sequence: Synthetic peptide
DEEEIRTTNPVATECWGIVSENLQVGNS

SEQ ID NO: 32274 - protein, 28 aa, Artificial Sequence
  Description of Artificial Sequence: Synthetic peptide
SEGEIITTNPVATEQYGSVSTNGQVGNQ

SEQ ID NO: 32275 - protein, 29 aa, Artificial Sequence
  Description of Artificial Sequence: Synthetic peptide
DEEEIYQTNPVATEQYGSVSTNLQGQGQT

SEQ ID NO: 32276 - protein, 28 aa, Artificial Sequence
  Description of Artificial Sequence: Synthetic peptide
DEQEIRATNPVSTEIYGEVSTNIQRGNR

SEQ ID NO: 32277 - protein, 30 aa, Artificial Sequence
  Description of Artificial Sequence: Synthetic polypeptide
DEEEIRQTNPVATEQYGSVSTNQQVGENDF

SEQ ID NO: 32278 - protein, 28 aa, Artificial Sequence
  Description of Artificial Sequence: Synthetic peptide
DENEIRTTNPVSTEQYGSVSDNLMRGQQ

SEQ ID NO: 32279 - protein, 29 aa, Artificial Sequence
  Description of Artificial Sequence: Synthetic peptide
DEEEIRTTNPVATEQYGGVSENLQDVGPF

SEQ ID NO: 32280 - protein, 31 aa, Artificial Sequence
  Description of Artificial Sequence: Synthetic polypeptide
DEEEIRTTNPVATEQYGSVDSETNDQRGDDE

SEQ ID NO: 32281 - protein, 28 aa, Artificial Sequence
  Description of Artificial Sequence: Synthetic peptide
DEEEICTTNPVATEQYGMVSDQDQRGNT

SEQ ID NO: 32282 - protein, 29 aa, Artificial Sequence
  Description of Artificial Sequence: Synthetic peptide
VEEEIRTTNPVATECYGVVATNLQREGDR

SEQ ID NO: 32283 - protein, 32 aa, Artificial Sequence
  Description of Artificial Sequence: Synthetic polypeptide
DEEEIRTTNPVATEQYGLSVSTGNLPQHGNEM

SEQ ID NO: 32284 - protein, 28 aa, Artificial Sequence
  Description of Artificial Sequence: Synthetic peptide
DENEIRTTNPVATEQYGSVSENEMRGTF

SEQ ID NO: 32285 - protein, 29 aa, Artificial Sequence
  Description of Artificial Sequence: Synthetic peptide
DEEEIRTTNPVATEQYGWVSDVLQHAGGR

SEQ ID NO: 32286 - protein, 29 aa, Artificial Sequence
  Description of Artificial Sequence: Synthetic peptide
DENEIRTTNPVATECYGSVSTNDMMRGNF

SEQ ID NO: 32287 - protein, 28 aa, Artificial Sequence
  Description of Artificial Sequence: Synthetic peptide
SEEEIRATNPVATEMFGSVSTNLQRENF

SEQ ID NO: 32288 - protein, 28 aa, Artificial Sequence
  Description of Artificial Sequence: Synthetic peptide
YEEEITCTNPVATEQYGSASTNLQGGNL

SEQ ID NO: 32289 - protein, 30 aa, Artificial Sequence
  Description of Artificial Sequence: Synthetic polypeptide
DEQEIRTTNPVATEVYGCVSATNLEREGNR

SEQ ID NO: 32290 - protein, 28 aa, Artificial Sequence
  Description of Artificial Sequence: Synthetic peptide
DEEEIRTTNPDAYEQYGSVFTPDDRGNR

SEQ ID NO: 32291 - protein, 30 aa, Artificial Sequence
  Description of Artificial Sequence: Synthetic polypeptide
DEQEIRTTNPVATEQYGDSVSVTNDNRGNI

SEQ ID NO: 32292 - protein, 28 aa, Artificial Sequence
  Description of Artificial Sequence: Synthetic peptide
MEQEIRTTNPVATEQYGEVSTDLQNGNF

SEQ ID NO: 32293 - protein, 31 aa, Artificial Sequence
  Description of Artificial Sequence: Synthetic polypeptide
DEEEIRTTNPVATEQYGSVSTMNPQELKGNF

SEQ ID NO: 32294 - protein, 28 aa, Artificial Sequence
  Description of Artificial Sequence: Synthetic peptide
DEQEIVTTNPVATEMYGSVSENLTHGNR

SEQ ID NO: 32295 - protein, 28 aa, Artificial Sequence
  Description of Artificial Sequence: Synthetic peptide
DENEIRTTNPVATEQYGDVSENLQRFQQ

SEQ ID NO: 32296 - protein, 29 aa, Artificial Sequence
  Description of Artificial Sequence: Synthetic peptide
QEEEIATTNPVATEQYGSVSEVLQHAGNR

SEQ ID NO: 32297 - protein, 28 aa, Artificial Sequence
  Description of Artificial Sequence: Synthetic peptide
DENEIRTTNPDATEQYGVVSTELERGNW

SEQ ID NO: 32298 - protein, 30 aa, Artificial Sequence
  Description of Artificial Sequence: Synthetic polypeptide
SEEEIRTTNPVATEQYGQVACTNLIRGINR

SEQ ID NO: 32299 - protein, 29 aa, Artificial Sequence
  Description of Artificial Sequence: Synthetic peptide
DEEEIVTTNPVATEQYGMVSEGNLGLGNR

SEQ ID NO: 32300 - protein, 30 aa, Artificial Sequence
  Description of Artificial Sequence: Synthetic polypeptide
DEQEIRCTNPVASETYGSVSATNLQREGNR

SEQ ID NO: 32301 - protein, 30 aa, Artificial Sequence
  Description of Artificial Sequence: Synthetic polypeptide
MEEEIRTTNPVATECYGSVSTNLQDVSGNF

SEQ ID NO: 32302 - protein, 28 aa, Artificial Sequence
  Description of Artificial Sequence: Synthetic peptide
HEEEIRTTNPVATEQWGSASTDLLGGNR

SEQ ID NO: 32303 - protein, 28 aa, Artificial Sequence
  Description of Artificial Sequence: Synthetic peptide
GEEEIATTNPVATEIYGVVSTNLQFGNT

SEQ ID NO: 32304 - protein, 29 aa, Artificial Sequence
  Description of Artificial Sequence: Synthetic peptide
DEEEIAQTNPVATEVYGSVSTNLMRAGNQ

SEQ ID NO: 32305 - protein, 28 aa, Artificial Sequence
  Description of Artificial Sequence: Synthetic peptide
DENEIRTVNPVATEQYGSMSTDLQLGNM

SEQ ID NO: 32306 - protein, 28 aa, Artificial Sequence
  Description of Artificial Sequence: Synthetic peptide
MEEEIDTTNPVATEQYGSVSEDLQNGNA

SEQ ID NO: 32307 - protein, 29 aa, Artificial Sequence
  Description of Artificial Sequence: Synthetic peptide
DEEEIRATNPVATEQYGSASDNLQSHGQR

SEQ ID NO: 32308 - protein, 29 aa, Artificial Sequence
  Description of Artificial Sequence: Synthetic peptide
DENEIRTVNPVATEQYGWVSTNLQENGNT

SEQ ID NO: 32309 - protein, 28 aa, Artificial Sequence
  Description of Artificial Sequence: Synthetic peptide
DEVEIATTNPVATEQYGDVPENLQRGER

SEQ ID NO: 32310 - protein, 28 aa, Artificial Sequence
  Description of Artificial Sequence: Synthetic peptide
DEQEIATTNPVATECYGSVSTDLQHGNL

SEQ ID NO: 32311 - protein, 28 aa, Artificial Sequence
  Description of Artificial Sequence: Synthetic peptide
HEEEIRTVNPCATEQYGSTATNLQRGER

SEQ ID NO: 32312 - protein, 28 aa, Artificial Sequence
  Description of Artificial Sequence: Synthetic peptide
DEEEIRATNPVATEQYGNVSENLQTGAV

SEQ ID NO: 32313 - protein, 28 aa, Artificial Sequence
  Description of Artificial Sequence: Synthetic peptide
QEEEIATVNPVATEVYGEASTNLQRGNR

SEQ ID NO: 32314 - protein, 30 aa, Artificial Sequence
  Description of Artificial Sequence: Synthetic polypeptide
DEEEIRTTNPVATQCYGSVTSDHNLQRGER

SEQ ID NO: 32315 - protein, 28 aa, Artificial Sequence
  Description of Artificial Sequence: Synthetic peptide
DEEEIRTTNPVAWAQFGSVSANPQNGNR

SEQ ID NO: 32316 - protein, 28 aa, Artificial Sequence
  Description of Artificial Sequence: Synthetic peptide
DENEIATTNPVATECYGAVSTNLQIGNI

SEQ ID NO: 32317 - protein, 31 aa, Artificial Sequence
  Description of Artificial Sequence: Synthetic polypeptide
DEEEINTTNPVATEQYGSVSTNSLFQVRGEF

SEQ ID NO: 32318 - protein, 28 aa, Artificial Sequence
  Description of Artificial Sequence: Synthetic peptide
DEEEIRTTNPVATELWGSVSENLMQGNL

SEQ ID NO: 32319 - protein, 31 aa, Artificial Sequence
  Description of Artificial Sequence: Synthetic polypeptide
DEQEIRTTNPVATEQYGSVSATDLQDREGNL

SEQ ID NO: 32320 - protein, 31 aa, Artificial Sequence
  Description of Artificial Sequence: Synthetic polypeptide
DEEEIRTTNPVATEQYGSVSEMNLPQDQGNF

SEQ ID NO: 32321 - protein, 28 aa, Artificial Sequence
  Description of Artificial Sequence: Synthetic peptide
DEEEIRTTNPVATEQFGGVSENEQQGNF

SEQ ID NO: 32322 - protein, 30 aa, Artificial Sequence
  Description of Artificial Sequence: Synthetic polypeptide
DEEEIRSTNPVATEQYGCVAANNLQREGNR

SEQ ID NO: 32323 - protein, 28 aa, Artificial Sequence
  Description of Artificial Sequence: Synthetic peptide
VEEEIRTTNPVASEIYGSVSTNLEFGER

SEQ ID NO: 32324 - protein, 28 aa, Artificial Sequence
  Description of Artificial Sequence: Synthetic peptide
DEEEIATTNPVCTEQYGSASTVVQRGNT

SEQ ID NO: 32325 - protein, 32 aa, Artificial Sequence
  Description of Artificial Sequence: Synthetic polypeptide
DEEEIRTTNPVATEQYGSVDSETDPLQIGENR

SEQ ID NO: 32326 - protein, 28 aa, Artificial Sequence
  Description of Artificial Sequence: Synthetic peptide
DENEIATTNPVATEQYGSVPTNLQREEL

SEQ ID NO: 32327 - protein, 28 aa, Artificial Sequence
  Description of Artificial Sequence: Synthetic peptide
VEEEIRTTNPVATEQYGSAGDNLQQQNR

SEQ ID NO: 32328 - protein, 28 aa, Artificial Sequence
  Description of Artificial Sequence: Synthetic peptide
SEEEIRATNPVATELYGTVSTNLQRGTN

SEQ ID NO: 32329 - protein, 32 aa, Artificial Sequence
  Description of Artificial Sequence: Synthetic polypeptide
DEEEIRTTNPVATEQYGSVSDTLADQRKGENR

SEQ ID NO: 32330 - protein, 32 aa, Artificial Sequence
  Description of Artificial Sequence: Synthetic polypeptide
DEEEIRTTNPVATEQYGSVYSTNGEQLRGVNQ

SEQ ID NO: 32331 - protein, 30 aa, Artificial Sequence
  Description of Artificial Sequence: Synthetic polypeptide
SEKEIRTTNPVANEQYGSVATNLQHRGNER

SEQ ID NO: 32332 - protein, 29 aa, Artificial Sequence
  Description of Artificial Sequence: Synthetic peptide
QEIEIRTTNPVATEGYGVASTNLQRAGNR

SEQ ID NO: 32333 - protein, 28 aa, Artificial Sequence
  Description of Artificial Sequence: Synthetic peptide
DEEEIRTTNPVATEQYWSVSEDEQAGNS

SEQ ID NO: 32334 - protein, 28 aa, Artificial Sequence
  Description of Artificial Sequence: Synthetic peptide
DESEIRTVNPVATEQYGTVSTNLEMGDR

SEQ ID NO: 32335 - protein, 28 aa, Artificial Sequence
  Description of Artificial Sequence: Synthetic peptide
DEEEIRTTNPEATEQYGSVSTEDQEGEE

SEQ ID NO: 32336 - protein, 28 aa, Artificial Sequence
  Description of Artificial Sequence: Synthetic peptide
NDEEIRTTNPVATEPYGCVSTNLQRGTD

SEQ ID NO: 32337 - protein, 28 aa, Artificial Sequence
  Description of Artificial Sequence: Synthetic peptide
DEQEIRTTNPVATEQYGSVSTDDQIGEF

SEQ ID NO: 32338 - protein, 28 aa, Artificial Sequence
  Description of Artificial Sequence: Synthetic peptide
DESEIRSVNPVATETYGSVSNNLQRGNQ

SEQ ID NO: 32339 - protein, 28 aa, Artificial Sequence
  Description of Artificial Sequence: Synthetic peptide
DEEEIATTNPVCTEQYGVVSDNLQSGNQ

SEQ ID NO: 32340 - protein, 28 aa, Artificial Sequence
  Description of Artificial Sequence: Synthetic peptide
DEEEIVTTNPVATEVYGSVAENIQRGGR

SEQ ID NO: 32341 - protein, 29 aa, Artificial Sequence
  Description of Artificial Sequence: Synthetic peptide
DEEEIRTTNPVATEQYGSVSDALEETGNS

SEQ ID NO: 32342 - protein, 28 aa, Artificial Sequence
  Description of Artificial Sequence: Synthetic peptide
SEEEIRTTNPAATEQYGSVSTNWQLGDT

SEQ ID NO: 32343 - protein, 28 aa, Artificial Sequence
  Description of Artificial Sequence: Synthetic peptide
DENEIATTNPVATECYGSVSTNLEHGNL

SEQ ID NO: 32344 - protein, 31 aa, Artificial Sequence
  Description of Artificial Sequence: Synthetic polypeptide
QENEIRTTNPVATEQYGDVCSCTNLQRSGNR

SEQ ID NO: 32345 - protein, 28 aa, Artificial Sequence
  Description of Artificial Sequence: Synthetic peptide
DEDEIRTTNPVATEQYGGVSDTLQHGNT

SEQ ID NO: 32346 - protein, 28 aa, Artificial Sequence
  Description of Artificial Sequence: Synthetic peptide
NEEEIRTTNPVATEIYGDVSTNLQYMNQ

SEQ ID NO: 32347 - protein, 32 aa, Artificial Sequence
  Description of Artificial Sequence: Synthetic polypeptide
DEEEIRTTNPVATEQYGTVSCTNLQDRNGNNT

SEQ ID NO: 32348 - protein, 31 aa, Artificial Sequence
  Description of Artificial Sequence: Synthetic polypeptide
DEEEIRTTNPVATEQYGSVSTNGDQQDGNDC

SEQ ID NO: 32349 - protein, 29 aa, Artificial Sequence
  Description of Artificial Sequence: Synthetic peptide
DENEIRTTNPVATEQYGSASENLQREFER

SEQ ID NO: 32350 - protein, 29 aa, Artificial Sequence
  Description of Artificial Sequence: Synthetic peptide
DENEIWTTNPVATEQYGFVSAFNLQRGNM

SEQ ID NO: 32351 - protein, 29 aa, Artificial Sequence
  Description of Artificial Sequence: Synthetic peptide
DEEEIRTTNPEATEQYGVVSTCLQYDGNV

SEQ ID NO: 32352 - protein, 30 aa, Artificial Sequence
  Description of Artificial Sequence: Synthetic polypeptide
DESEIRTTNPVATEQYGSVSTDLEPEGNER

SEQ ID NO: 32353 - protein, 29 aa, Artificial Sequence
  Description of Artificial Sequence: Synthetic peptide
DEEEIRTTNPVAGEQYWSIVSEGLQRGER

SEQ ID NO: 32354 - protein, 31 aa, Artificial Sequence
  Description of Artificial Sequence: Synthetic polypeptide
DEEEIRTTNPVATEQYGSWTDTNNLDRGNER

SEQ ID NO: 32355 - protein, 30 aa, Artificial Sequence
  Description of Artificial Sequence: Synthetic polypeptide
SEEEIRTTNPVATEMYGSVSENLPQRSGNF

SEQ ID NO: 32356 - protein, 28 aa, Artificial Sequence
  Description of Artificial Sequence: Synthetic peptide
DENEIRTTNPVATEQWGSVSTNEMQGNF

SEQ ID NO: 32357 - protein, 29 aa, Artificial Sequence
  Description of Artificial Sequence: Synthetic peptide
DEDEIGTTNPVATEQYGSVSDNIQGAGNR

SEQ ID NO: 32358 - protein, 28 aa, Artificial Sequence
  Description of Artificial Sequence: Synthetic peptide
DEEEIRTVNPVATEQYGSVPTNCMHGNK

SEQ ID NO: 32359 - protein, 28 aa, Artificial Sequence
  Description of Artificial Sequence: Synthetic peptide
DEVEIRTTNPVATEVYGSVSTALETGNG

SEQ ID NO: 32360 - protein, 28 aa, Artificial Sequence
  Description of Artificial Sequence: Synthetic peptide
QEAEIRTTNPVATEQYGSVSTDLEHGNL

SEQ ID NO: 32361 - protein, 28 aa, Artificial Sequence
  Description of Artificial Sequence: Synthetic peptide
DENEIRTTNPVATEQWGDVSEIEQRGNR

SEQ ID NO: 32362 - protein, 31 aa, Artificial Sequence
  Description of Artificial Sequence: Synthetic polypeptide
DEEEIRTTNPVATEQYGSYVSDTNLEMENER

SEQ ID NO: 32363 - protein, 28 aa, Artificial Sequence
  Description of Artificial Sequence: Synthetic peptide
YEEEIRCTNPVATEQYGSVSSNICTGNR

SEQ ID NO: 32364 - protein, 28 aa, Artificial Sequence
  Description of Artificial Sequence: Synthetic peptide
DENEIRTTNPVATEQWGIVSTNLMQGNF

SEQ ID NO: 32365 - protein, 28 aa, Artificial Sequence
  Description of Artificial Sequence: Synthetic peptide
QENEIATTNPVATEQYGDVSTCLQRENR

SEQ ID NO: 32366 - protein, 29 aa, Artificial Sequence
  Description of Artificial Sequence: Synthetic peptide
DEEEIRCTNPVSTESYGSVSSNLQRGENA

SEQ ID NO: 32367 - protein, 30 aa, Artificial Sequence
  Description of Artificial Sequence: Synthetic polypeptide
DEEIIRTTNPVATEQWYWSVETPLQRGNPR

SEQ ID NO: 32368 - protein, 28 aa, Artificial Sequence
  Description of Artificial Sequence: Synthetic peptide
DEDEIRCTNPVGWEQFGSVSDNLQRGNR

SEQ ID NO: 32369 - protein, 28 aa, Artificial Sequence
  Description of Artificial Sequence: Synthetic peptide
DEEEIGTTNPVATEMWGFVSTNLQRLNL

SEQ ID NO: 32370 - protein, 28 aa, Artificial Sequence
  Description of Artificial Sequence: Synthetic peptide
DEESIRATNPTATHFYGSVSTNLDRGNR

SEQ ID NO: 32371 - protein, 29 aa, Artificial Sequence
  Description of Artificial Sequence: Synthetic peptide
DEEEIRTTNPVATEWYGSVSENEQMQGNF

SEQ ID NO: 32372 - protein, 28 aa, Artificial Sequence
  Description of Artificial Sequence: Synthetic peptide
KEEEIATVNPVATEQYGSVSTELQIGER

SEQ ID NO: 32373 - protein, 28 aa, Artificial Sequence
  Description of Artificial Sequence: Synthetic peptide
DEEEIHPTNPVAYFQYGSVSNNLQVGNR

SEQ ID NO: 32374 - protein, 30 aa, Artificial Sequence
  Description of Artificial Sequence: Synthetic polypeptide
QEEEITTTNPVATEIYGSVSETNLQDQGNR

SEQ ID NO: 32375 - protein, 28 aa, Artificial Sequence
  Description of Artificial Sequence: Synthetic peptide
SEEEITTTNPTATEQFGSVSENLQRGNI

SEQ ID NO: 32376 - protein, 28 aa, Artificial Sequence
  Description of Artificial Sequence: Synthetic peptide
DECEIRTTNIVATEQYGSVATNLQSANT

SEQ ID NO: 32377 - protein, 28 aa, Artificial Sequence
  Description of Artificial Sequence: Synthetic peptide
DEEEIRTTNPVATEQYGSVETPDQLGEI

SEQ ID NO: 32378 - protein, 28 aa, Artificial Sequence
  Description of Artificial Sequence: Synthetic peptide
DEEEIATTNPVATEQYGDVSENLQREEM

SEQ ID NO: 32379 - protein, 28 aa, Artificial Sequence
  Description of Artificial Sequence: Synthetic peptide
QEEEIAATNPVATEQYGSASTVLQHGNR

SEQ ID NO: 32380 - protein, 31 aa, Artificial Sequence
  Description of Artificial Sequence: Synthetic polypeptide
DEEEIRTTNPVATEQYGSVSTNLEEREGEDA

SEQ ID NO: 32381 - protein, 28 aa, Artificial Sequence
  Description of Artificial Sequence: Synthetic peptide
DEAEIAQTNPVATEMYGSVSCNLQRGNY

SEQ ID NO: 32382 - protein, 28 aa, Artificial Sequence
  Description of Artificial Sequence: Synthetic peptide
DEDEIRTTNPVATEQFGGVSTNPQLGNI

SEQ ID NO: 32383 - protein, 28 aa, Artificial Sequence
  Description of Artificial Sequence: Synthetic peptide
DEEELRSTNPVSTEQYGSVAMNLQRGNQ

SEQ ID NO: 32384 - protein, 28 aa, Artificial Sequence
  Description of Artificial Sequence: Synthetic peptide
DEEEVRSTNPVATEQYGEVATVLQSGNR

SEQ ID NO: 32385 - protein, 30 aa, Artificial Sequence
  Description of Artificial Sequence: Synthetic polypeptide
DENEIRTTNPVATEQYGSVSEELQHTGNSR

SEQ ID NO: 32386 - protein, 31 aa, Artificial Sequence
  Description of Artificial Sequence: Synthetic polypeptide
DEEEIRTTNPVATEQYGSVITTNLQANGNPL

SEQ ID NO: 32387 - protein, 29 aa, Artificial Sequence
  Description of Artificial Sequence: Synthetic peptide
DEEEIRTTNPVATEQYGIVSENEMMIGNR

SEQ ID NO: 32388 - protein, 28 aa, Artificial Sequence
  Description of Artificial Sequence: Synthetic peptide
AENEIAATNPVATEQYGEVSTNLQRGQR

SEQ ID NO: 32389 - protein, 28 aa, Artificial Sequence
  Description of Artificial Sequence: Synthetic peptide
DEEEIRTTNPVATEQYGTTATNLQSSNT

SEQ ID NO: 32390 - protein, 28 aa, Artificial Sequence
  Description of Artificial Sequence: Synthetic peptide
DEEEIRTTNPVATECYGSVSTEIERLER

SEQ ID NO: 32391 - protein, 28 aa, Artificial Sequence
  Description of Artificial Sequence: Synthetic peptide
DEQEIATTNPVATEQYGSVSTDDQHGNA

SEQ ID NO: 32392 - protein, 28 aa, Artificial Sequence
  Description of Artificial Sequence: Synthetic peptide
DEFELYTTNPVATEIYGSVSTNLQNGNN

SEQ ID NO: 32393 - protein, 30 aa, Artificial Sequence
  Description of Artificial Sequence: Synthetic polypeptide
QEEEIRCTNPVATEQYGSVSDTDLQIRGNH

SEQ ID NO: 32394 - protein, 32 aa, Artificial Sequence
  Description of Artificial Sequence: Synthetic polypeptide
DEEEIRTTNPVATEQYGSVSCTMDLQCRGNDV

SEQ ID NO: 32395 - protein, 28 aa, Artificial Sequence
  Description of Artificial Sequence: Synthetic peptide
DEEEIATTNIVATEQYGSVSTDLENGNF

SEQ ID NO: 32396 - protein, 28 aa, Artificial Sequence
  Description of Artificial Sequence: Synthetic peptide
DEEEIRATNPVSTEMYGSVATNLQQENR

SEQ ID NO: 32397 - protein, 29 aa, Artificial Sequence
  Description of Artificial Sequence: Synthetic peptide
DENEIRTTNPVATEQYGDVSTNEQNRGDA

SEQ ID NO: 32398 - protein, 28 aa, Artificial Sequence
  Description of Artificial Sequence: Synthetic peptide
DEVEIRTTNPCATELYGWVSTNLQTGNF

SEQ ID NO: 32399 - protein, 28 aa, Artificial Sequence
  Description of Artificial Sequence: Synthetic peptide
DEEEIRTTNPVATEQYGDVSENLMQGDM

SEQ ID NO: 32400 - protein, 28 aa, Artificial Sequence
  Description of Artificial Sequence: Synthetic peptide
MEEEICTTNPVATECYGSVSTELQNGNL

SEQ ID NO: 32401 - protein, 28 aa, Artificial Sequence
  Description of Artificial Sequence: Synthetic peptide
DESEIRQTNPVATEQFGSAASNLQRGNR

SEQ ID NO: 32402 - protein, 31 aa, Artificial Sequence
  Description of Artificial Sequence: Synthetic polypeptide
MEEEIRTTNPVATEQYGSVSTNLQENEGNDS

SEQ ID NO: 32403 - protein, 30 aa, Artificial Sequence
  Description of Artificial Sequence: Synthetic polypeptide
DEEEIRTTNPFATEQYGSVPCTINLQHGNQ

SEQ ID NO: 32404 - protein, 28 aa, Artificial Sequence
  Description of Artificial Sequence: Synthetic peptide
SEEEIRTTNPVATECYGSVSTNEQNGTV

SEQ ID NO: 32405 - protein, 32 aa, Artificial Sequence
  Description of Artificial Sequence: Synthetic polypeptide
DEEEIRTTNPVATEQYGSVSTNPLQEEGDNDY

SEQ ID NO: 32406 - protein, 33 aa, Artificial Sequence
  Description of Artificial Sequence: Synthetic polypeptide
DEEEIRTTNPVATEQYGSVYSTENGLQQNGVNR

SEQ ID NO: 32407 - protein, 28 aa, Artificial Sequence
  Description of Artificial Sequence: Synthetic peptide
DEEEIRQTNPVATEQYGVVSTNDQDGEC

SEQ ID NO: 32408 - protein, 28 aa, Artificial Sequence
  Description of Artificial Sequence: Synthetic peptide
DENEIRTTNPVATEQWGSVSTNEMIGNF

SEQ ID NO: 32409 - protein, 30 aa, Artificial Sequence
  Description of Artificial Sequence: Synthetic polypeptide
DENEIRTTNPVATEQYGVVSTDLERGENDR

SEQ ID NO: 32410 - protein, 28 aa, Artificial Sequence
  Description of Artificial Sequence: Synthetic peptide
DEEEIRTTNPVATEQYGSYSEILMQGNA

SEQ ID NO: 32411 - protein, 28 aa, Artificial Sequence
  Description of Artificial Sequence: Synthetic peptide
MENEISTTNPVATECYGSVSTLLQRENR

SEQ ID NO: 32412 - protein, 30 aa, Artificial Sequence
  Description of Artificial Sequence: Synthetic polypeptide
DEEEIRTTNPVATEMYGSVSTVNWQSGTTR

SEQ ID NO: 32413 - protein, 31 aa, Artificial Sequence
  Description of Artificial Sequence: Synthetic polypeptide
DENEIRTTNPVATEQYGSVSVTPNLQQGNDW

SEQ ID NO: 32414 - protein, 28 aa, Artificial Sequence
  Description of Artificial Sequence: Synthetic peptide
MDEEIRTTNPVAYEQYGTVSTNLQRGEL

SEQ ID NO: 32415 - protein, 28 aa, Artificial Sequence
  Description of Artificial Sequence: Synthetic peptide
DENEIRTTNPVATEQYGSYSTILQQEDR

SEQ ID NO: 32416 - protein, 28 aa, Artificial Sequence
  Description of Artificial Sequence: Synthetic peptide
DEEEIRPTNPDATQQYGSVSTPLDRENR

SEQ ID NO: 32417 - protein, 28 aa, Artificial Sequence
  Description of Artificial Sequence: Synthetic peptide
DEEEIRTTNPVATEQYGSVETDLEIGEW

SEQ ID NO: 32418 - protein, 32 aa, Artificial Sequence
  Description of Artificial Sequence: Synthetic polypeptide
DEEEIRTTNPVATEQYGSVSDTNLQEPGENDW

SEQ ID NO: 32419 - protein, 28 aa, Artificial Sequence
  Description of Artificial Sequence: Synthetic peptide
DEEEIRTTNPVATEWYGSVSDNLQSMDT

SEQ ID NO: 32420 - protein, 29 aa, Artificial Sequence
  Description of Artificial Sequence: Synthetic peptide
DEEEIRSVNPVATEQYGTVSTNLQHAGMR

SEQ ID NO: 32421 - protein, 28 aa, Artificial Sequence
  Description of Artificial Sequence: Synthetic peptide
DEEEIRTTNPVATEQYGSVSTPPQLTMI

SEQ ID NO: 32422 - protein, 28 aa, Artificial Sequence
  Description of Artificial Sequence: Synthetic peptide
DEEEIRTTNPVATEQYGECSEQLQNGNQ

SEQ ID NO: 32423 - protein, 28 aa, Artificial Sequence
  Description of Artificial Sequence: Synthetic peptide
DENEIRTTNPVATECWGSVSTNEMRGNF

SEQ ID NO: 32424 - protein, 28 aa, Artificial Sequence
  Description of Artificial Sequence: Synthetic peptide
DEEEIRTTNPVATENYGSVQTNLAPGEQ

SEQ ID NO: 32425 - protein, 30 aa, Artificial Sequence
  Description of Artificial Sequence: Synthetic polypeptide
DEEEIRTTNPVATEIYGEVSEMNLQERGNY

SEQ ID NO: 32426 - protein, 28 aa, Artificial Sequence
  Description of Artificial Sequence: Synthetic peptide
REEEIRTTNPVATAQYGSVSIALERNNR

SEQ ID NO: 32427 - protein, 28 aa, Artificial Sequence
  Description of Artificial Sequence: Synthetic peptide
DEEEIRTTNPVATELYGVVSENLQNFNI

SEQ ID NO: 32428 - protein, 29 aa, Artificial Sequence
  Description of Artificial Sequence: Synthetic peptide
DEEEIRTTNPVCTEQYGSVSTYEQNNGMR

SEQ ID NO: 32429 - protein, 30 aa, Artificial Sequence
  Description of Artificial Sequence: Synthetic polypeptide
DEEEIRCTNPVASEVYGCVSATNLQREGNR

SEQ ID NO: 32430 - protein, 28 aa, Artificial Sequence
  Description of Artificial Sequence: Synthetic peptide
DEEEIRTTNPVATEQYGIVSTNDMLGDY

SEQ ID NO: 32431 - protein, 28 aa, Artificial Sequence
  Description of Artificial Sequence: Synthetic peptide
DENEIRTTNPVGTEMFGSVSTELQIGNR

SEQ ID NO: 32432 - protein, 28 aa, Artificial Sequence
  Description of Artificial Sequence: Synthetic peptide
DEQEIRTTNPDATEQYGSVSTNEEYGNQ

SEQ ID NO: 32433 - protein, 28 aa, Artificial Sequence
  Description of Artificial Sequence: Synthetic peptide
DEQEIRTTNPVATELYGIVSTNLMLGNM

SEQ ID NO: 32434 - protein, 28 aa, Artificial Sequence
  Description of Artificial Sequence: Synthetic peptide
QEAEIRTTNPVATENYGAVATNLQDGNR

SEQ ID NO: 32435 - protein, 28 aa, Artificial Sequence
  Description of Artificial Sequence: Synthetic peptide
QEEEIRTVNPVATEQYGSVATVLQHGNM

SEQ ID NO: 32436 - protein, 29 aa, Artificial Sequence
  Description of Artificial Sequence: Synthetic peptide
QEQEIVTTNPVATEQYGDVSAENLQRGNR

SEQ ID NO: 32437 - protein, 28 aa, Artificial Sequence
  Description of Artificial Sequence: Synthetic peptide
DETEIATTNPVATEQYGWVSENLQDGNM

SEQ ID NO: 32438 - protein, 28 aa, Artificial Sequence
  Description of Artificial Sequence: Synthetic peptide
DEQEVRATNPVATEIYGCVATNLQRGNR

SEQ ID NO: 32439 - protein, 28 aa, Artificial Sequence
  Description of Artificial Sequence: Synthetic peptide
DEEEIRATNPVATEMYGGVSENLQQGTR

SEQ ID NO: 32440 - protein, 28 aa, Artificial Sequence
  Description of Artificial Sequence: Synthetic peptide
DESEIRCTNPVCTETYGSVSTELQYGNR

SEQ ID NO: 32441 - protein, 28 aa, Artificial Sequence
  Description of Artificial Sequence: Synthetic peptide
DEQEIRTTNPVSTEQYGEVSEVLQHGNR

SEQ ID NO: 32442 - protein, 28 aa, Artificial Sequence
  Description of Artificial Sequence: Synthetic peptide
DENEIATTNPVASEQFGSVSTLLQNGNR

SEQ ID NO: 32443 - protein, 29 aa, Artificial Sequence
  Description of Artificial Sequence: Synthetic peptide
DEEEIRSTNPVATEQYGNVSTNLEYAGNE

SEQ ID NO: 32444 - protein, 28 aa, Artificial Sequence
  Description of Artificial Sequence: Synthetic peptide
DENEIRCTNPVATEQWGSVSTNLMRGTA

SEQ ID NO: 32445 - protein, 28 aa, Artificial Sequence
  Description of Artificial Sequence: Synthetic peptide
DEEEIRTTNPVATEQYGSAPEVLMHGNR

SEQ ID NO: 32446 - protein, 31 aa, Artificial Sequence
  Description of Artificial Sequence: Synthetic polypeptide
DEEEIVTTNPVATEQYGSVSTCNLQDRKGEE

SEQ ID NO: 32447 - protein, 30 aa, Artificial Sequence
  Description of Artificial Sequence: Synthetic polypeptide
DEQEIRTTNPVATEQYGSVNSDNLDLRDNR

SEQ ID NO: 32448 - protein, 31 aa, Artificial Sequence
  Description of Artificial Sequence: Synthetic polypeptide
DEEEIRTTNPVATEQYWSVETPNPGQLRGNR

SEQ ID NO: 32449 - protein, 29 aa, Artificial Sequence
  Description of Artificial Sequence: Synthetic peptide
DEEEIRTTNPVATEQFGIVSANLQEHGLR

SEQ ID NO: 32450 - protein, 28 aa, Artificial Sequence
  Description of Artificial Sequence: Synthetic peptide
TEQEIATTNPVATEQYGMTSTNLLRGNR

SEQ ID NO: 32451 - protein, 28 aa, Artificial Sequence
  Description of Artificial Sequence: Synthetic peptide
NETEVTTTNPVATEQWGSVSENLQRGNR

SEQ ID NO: 32452 - protein, 28 aa, Artificial Sequence
  Description of Artificial Sequence: Synthetic peptide
DEEEIRTTNPVATEQYGSVSEGPQREEM

SEQ ID NO: 32453 - protein, 31 aa, Artificial Sequence
  Description of Artificial Sequence: Synthetic polypeptide
DEEEIRTTNPVATEQYGDVSCENLQCYGNDR

SEQ ID NO: 32454 - protein, 30 aa, Artificial Sequence
  Description of Artificial Sequence: Synthetic polypeptide
DEEEIRTTNPVATECYGSVSTDLQEPKGNI

SEQ ID NO: 32455 - protein, 28 aa, Artificial Sequence
  Description of Artificial Sequence: Synthetic peptide
DEEEICTTNPVATEIYGTVSTNLQVMNQ

SEQ ID NO: 32456 - protein, 28 aa, Artificial Sequence
  Description of Artificial Sequence: Synthetic peptide
DEYEIRCTNPVATELYGAASTNLQRGDR

SEQ ID NO: 32457 - protein, 29 aa, Artificial Sequence
  Description of Artificial Sequence: Synthetic peptide
DEEEIAATNPVATEQYGSVSELLPQQGNR

SEQ ID NO: 32458 - protein, 28 aa, Artificial Sequence
  Description of Artificial Sequence: Synthetic peptide
DEQEIRTTNPDATEQYGSVSTNDQREEF

SEQ ID NO: 32459 - protein, 30 aa, Artificial Sequence
  Description of Artificial Sequence: Synthetic polypeptide
SEEEIRATNPVATEQFGSVSTNLPQRGNTF

SEQ ID NO: 32460 - protein, 30 aa, Artificial Sequence
  Description of Artificial Sequence: Synthetic polypeptide
MEEEIRTTNPVATEQYGDVSTNLQMPGSNQ

SEQ ID NO: 32461 - protein, 28 aa, Artificial Sequence
  Description of Artificial Sequence: Synthetic peptide
DEFEIRTTNPVSTEQYGEVCTNIQRGNM

SEQ ID NO: 32462 - protein, 30 aa, Artificial Sequence
  Description of Artificial Sequence: Synthetic polypeptide
CEEEIRTTNPVATEQYGNVSTDLTRNGNDR

SEQ ID NO: 32463 - protein, 28 aa, Artificial Sequence
  Description of Artificial Sequence: Synthetic peptide
SEEEIMTTNPVATEQYGTVSVNEQRGNH

SEQ ID NO: 32464 - protein, 28 aa, Artificial Sequence
  Description of Artificial Sequence: Synthetic peptide
DESEIRCTNPVASEQYGIVATNLQRGDR

SEQ ID NO: 32465 - protein, 30 aa, Artificial Sequence
  Description of Artificial Sequence: Synthetic polypeptide
DEEEIRTTNPVATEQYGSVSELNLQRSWTI

SEQ ID NO: 32466 - protein, 28 aa, Artificial Sequence
  Description of Artificial Sequence: Synthetic peptide
MENEIATTNPVATEQYGSVSENLQQGNM

SEQ ID NO: 32467 - protein, 28 aa, Artificial Sequence
  Description of Artificial Sequence: Synthetic peptide
AEQEIATTNPVATEQYGDASENLQRGNR

SEQ ID NO: 32468 - protein, 28 aa, Artificial Sequence
  Description of Artificial Sequence: Synthetic peptide
GEDEISTTNPVATEQYGFVSENLQRGNS

SEQ ID NO: 32469 - protein, 31 aa, Artificial Sequence
  Description of Artificial Sequence: Synthetic polypeptide
DEEEIRTTNPVATEQYGSVSTNLEDDEGNDL

SEQ ID NO: 32470 - protein, 28 aa, Artificial Sequence
  Description of Artificial Sequence: Synthetic peptide
DESEIRTTNPVATEVYGDVSTGLQSGNA

SEQ ID NO: 32471 - protein, 32 aa, Artificial Sequence
  Description of Artificial Sequence: Synthetic polypeptide
DEEEIRTTNPVATEQYGSVSCTMDLQCRGNDD

SEQ ID NO: 32472 - protein, 31 aa, Artificial Sequence
  Description of Artificial Sequence: Synthetic polypeptide
QEEEIRTTNPVATEQYGSVSTENEQVRGDER

SEQ ID NO: 32473 - protein, 31 aa, Artificial Sequence
  Description of Artificial Sequence: Synthetic polypeptide
DEEEIRTTNPVATEQYGSVETEEGLQRGNDQ

SEQ ID NO: 32474 - protein, 28 aa, Artificial Sequence
  Description of Artificial Sequence: Synthetic peptide
DEQEIATTNPVSTEQYGSVSENLQHGGR

SEQ ID NO: 32475 - protein, 28 aa, Artificial Sequence
  Description of Artificial Sequence: Synthetic peptide
DEQEIATTNPVATEQYGSVSTNLEHGEL

SEQ ID NO: 32476 - protein, 28 aa, Artificial Sequence
  Description of Artificial Sequence: Synthetic peptide
DENEIRTTNPVATEWYGSVSTNEMTGNA

SEQ ID NO: 32477 - protein, 28 aa, Artificial Sequence
  Description of Artificial Sequence: Synthetic peptide
DEEEVSTTNPVSTEMYGSVATNLQRGNQ

SEQ ID NO: 32478 - protein, 28 aa, Artificial Sequence
  Description of Artificial Sequence: Synthetic peptide
SEVEIATTNPTATEQFGSVSTNLQRGTR

SEQ ID NO: 32479 - protein, 29 aa, Artificial Sequence
  Description of Artificial Sequence: Synthetic peptide
DENEIRTTNPVCTEQYGSVDTNLQSGNDV

SEQ ID NO: 32480 - protein, 28 aa, Artificial Sequence
  Description of Artificial Sequence: Synthetic peptide
DEQEIRTTNPEATEQYGSVSTDLEIGNF

SEQ ID NO: 32481 - protein, 28 aa, Artificial Sequence
  Description of Artificial Sequence: Synthetic peptide
SESEIRTTNPVATEQYGSVAENLMRGNF

SEQ ID NO: 32482 - protein, 28 aa, Artificial Sequence
  Description of Artificial Sequence: Synthetic peptide
DDEEIRATNPIATEVYGVVATNLQRGNR

SEQ ID NO: 32483 - protein, 28 aa, Artificial Sequence
  Description of Artificial Sequence: Synthetic peptide
DEEEIRTTNPVATEQYGSVETPDEPGNF

SEQ ID NO: 32484 - protein, 28 aa, Artificial Sequence
  Description of Artificial Sequence: Synthetic peptide
DENEIRTTNIVATEMWGSVSENLQRGDR

SEQ ID NO: 32485 - protein, 28 aa, Artificial Sequence
  Description of Artificial Sequence: Synthetic peptide
DEEEIRTTNPVATECYGSYSENLMRENM

SEQ ID NO: 32486 - protein, 28 aa, Artificial Sequence
  Description of Artificial Sequence: Synthetic peptide
SEEEIRTTNPVATEQYGSVSENEQNGTS

SEQ ID NO: 32487 - protein, 29 aa, Artificial Sequence
  Description of Artificial Sequence: Synthetic peptide
DEQEIRTTNPVATECWGSVDTNLQNRGNA

SEQ ID NO: 32488 - protein, 31 aa, Artificial Sequence
  Description of Artificial Sequence: Synthetic polypeptide
DEEEIRTTNPVATEQYGSVESETDLERNGNV

SEQ ID NO: 32489 - protein, 32 aa, Artificial Sequence
  Description of Artificial Sequence: Synthetic polypeptide
DEEEIRTTNPVATEQYGSVSCTMDLQCYGNDR

SEQ ID NO: 32490 - protein, 29 aa, Artificial Sequence
  Description of Artificial Sequence: Synthetic peptide
DEEEIRTTNPVATEQYGSVEHNGILRGNP

SEQ ID NO: 32491 - protein, 31 aa, Artificial Sequence
  Description of Artificial Sequence: Synthetic polypeptide
DEEEIRTTNPTATEQYGGVSTCNLQRGETDR

SEQ ID NO: 32492 - protein, 28 aa, Artificial Sequence
  Description of Artificial Sequence: Synthetic peptide
DENEIRCTNPVATEQYGVVSEEGQRGNR

SEQ ID NO: 32493 - protein, 29 aa, Artificial Sequence
  Description of Artificial Sequence: Synthetic peptide
QDEEIRTTNPVATEFFGSVSTNEQRGDNR

SEQ ID NO: 32494 - protein, 31 aa, Artificial Sequence
  Description of Artificial Sequence: Synthetic polypeptide
DEEEIRTTNPVATEQYGSVSCTMDLQCMGNS

SEQ ID NO: 32495 - protein, 28 aa, Artificial Sequence
  Description of Artificial Sequence: Synthetic peptide
DENEIRTTNPVATECWGSVSENEQRGNA

SEQ ID NO: 32496 - protein, 29 aa, Artificial Sequence
  Description of Artificial Sequence: Synthetic peptide
DEEEIRPTNPVATEQYWSYVETNLQPGER

SEQ ID NO: 32497 - protein, 30 aa, Artificial Sequence
  Description of Artificial Sequence: Synthetic polypeptide
DEGEIRTTNPVATECYGSVSTNLQVNGNDT

SEQ ID NO: 32498 - protein, 28 aa, Artificial Sequence
  Description of Artificial Sequence: Synthetic peptide
DEEEIRTTNPVATECYGWVSEELQNGNS

SEQ ID NO: 32499 - protein, 28 aa, Artificial Sequence
  Description of Artificial Sequence: Synthetic peptide
DEEEIRATNPVATEQYGSVSTGPQNGLF

SEQ ID NO: 32500 - protein, 28 aa, Artificial Sequence
  Description of Artificial Sequence: Synthetic peptide
DEEEIRTTNPVATEQYGAVSANFDYLNR

SEQ ID NO: 32501 - protein, 29 aa, Artificial Sequence
  Description of Artificial Sequence: Synthetic peptide
DENEIRTTNPVATEQWGSVSTNEMRGNDA

SEQ ID NO: 32502 - protein, 30 aa, Artificial Sequence
  Description of Artificial Sequence: Synthetic polypeptide
DEHEIRTTNPVATEQYGSVSCTMDLQRENA

SEQ ID NO: 32503 - protein, 28 aa, Artificial Sequence
  Description of Artificial Sequence: Synthetic peptide
AEEEIRTTNPVATEQYGDVSEDQQRGER

SEQ ID NO: 32504 - protein, 30 aa, Artificial Sequence
  Description of Artificial Sequence: Synthetic polypeptide
DEEEIRATNPVATENYGSVSTHNLQRRNDN

SEQ ID NO: 32505 - protein, 28 aa, Artificial Sequence
  Description of Artificial Sequence: Synthetic peptide
DEEEIATTNPVATECYGVVSTDLQRGEA

SEQ ID NO: 32506 - protein, 28 aa, Artificial Sequence
  Description of Artificial Sequence: Synthetic peptide
GEEEIRTTNPVATECYGVVSTELQQGER

SEQ ID NO: 32507 - protein, 29 aa, Artificial Sequence
  Description of Artificial Sequence: Synthetic peptide
DEEEIRTTNPVATEQYGCVATDGLQSGNS

SEQ ID NO: 32508 - protein, 28 aa, Artificial Sequence
  Description of Artificial Sequence: Synthetic peptide
MEEEISTTNPVATEQYGSVSDNLQNGEY

SEQ ID NO: 32509 - protein, 31 aa, Artificial Sequence
  Description of Artificial Sequence: Synthetic polypeptide
DEEEIRTTNPVATEQYGSVSSTGNPGQDGNF

SEQ ID NO: 32510 - protein, 29 aa, Artificial Sequence
  Description of Artificial Sequence: Synthetic peptide
AEEEIATTNPVATEQYGSASENLQRAGQR

SEQ ID NO: 32511 - protein, 30 aa, Artificial Sequence
  Description of Artificial Sequence: Synthetic polypeptide
DENEIRTTNPVATEQYGSVSDTNLQQKGDQ

SEQ ID NO: 32512 - protein, 29 aa, Artificial Sequence
  Description of Artificial Sequence: Synthetic peptide
DEEEIGTTNPVATEQYGTASCVLQRAGNR

SEQ ID NO: 32513 - protein, 28 aa, Artificial Sequence
  Description of Artificial Sequence: Synthetic peptide
DEEEIRTTNPVATECYGSVETNDDPGER

SEQ ID NO: 32514 - protein, 29 aa, Artificial Sequence
  Description of Artificial Sequence: Synthetic peptide
DEESIMTTNPVATECYGSVNTNTLQRGNM

SEQ ID NO: 32515 - protein, 29 aa, Artificial Sequence
  Description of Artificial Sequence: Synthetic peptide
DENEIRSTNPVATEIYGTVATNLQRNGNR

SEQ ID NO: 32516 - protein, 30 aa, Artificial Sequence
  Description of Artificial Sequence: Synthetic polypeptide
DEEEICTTNPVATEQYGSMSEINLQVGNDR

SEQ ID NO: 32517 - protein, 28 aa, Artificial Sequence
  Description of Artificial Sequence: Synthetic peptide
DEQEIATVNPVSTEVYGSVSTNLQHGNR

SEQ ID NO: 32518 - protein, 28 aa, Artificial Sequence
  Description of Artificial Sequence: Synthetic peptide
DEVEIAATNPVATEQYGSVSEDLQQGNR

SEQ ID NO: 32519 - protein, 28 aa, Artificial Sequence
  Description of Artificial Sequence: Synthetic peptide
DEEEIRTTNIDATEQYGSVSTGLFRGEV

SEQ ID NO: 32520 - protein, 28 aa, Artificial Sequence
  Description of Artificial Sequence: Synthetic peptide
DELEIATTNPVATENYGDVGTNLQRGND

SEQ ID NO: 32521 - protein, 28 aa, Artificial Sequence
  Description of Artificial Sequence: Synthetic peptide
DEEEIRTTNPVATEQYWSVSEELWEGNQ

SEQ ID NO: 32522 - protein, 30 aa, Artificial Sequence
  Description of Artificial Sequence: Synthetic polypeptide
DEQEIRTTNPVAYEQYGCVAATNLQRNGNR

SEQ ID NO: 32523 - protein, 29 aa, Artificial Sequence
  Description of Artificial Sequence: Synthetic peptide
QEEEIATTNPVATEQYGDVSTNLQRKGEN

SEQ ID NO: 32524 - protein, 31 aa, Artificial Sequence
  Description of Artificial Sequence: Synthetic polypeptide
DHEEIRTTNPVAYQQYGSVSSTNLQREGNDR

SEQ ID NO: 32525 - protein, 28 aa, Artificial Sequence
  Description of Artificial Sequence: Synthetic peptide
DEEEIATTNPVCTEQYGSVSEDLQHGNA

SEQ ID NO: 32526 - protein, 28 aa, Artificial Sequence
  Description of Artificial Sequence: Synthetic peptide
MEQEIRTTNPVATECYGSVSTNLQQGDQ

SEQ ID NO: 32527 - protein, 28 aa, Artificial Sequence
  Description of Artificial Sequence: Synthetic peptide
DEEEIRQTNPVATEQYGDVSTNDQYGEM

SEQ ID NO: 32528 - protein, 28 aa, Artificial Sequence
  Description of Artificial Sequence: Synthetic peptide
DENEIATTNPVATEVYGDVSTNLQRGQQ

SEQ ID NO: 32529 - protein, 32 aa, Artificial Sequence
  Description of Artificial Sequence: Synthetic polypeptide
DEEEIRTVNPVATEQYGSVGTNGLQVRKGNDR

SEQ ID NO: 32530 - protein, 28 aa, Artificial Sequence
  Description of Artificial Sequence: Synthetic peptide
DEAEIRCTNPVATEQYGGVSTNLQEGTD

SEQ ID NO: 32531 - protein, 28 aa, Artificial Sequence
  Description of Artificial Sequence: Synthetic peptide
DEEEIRCTNPVSTECWGSVSTNLERGNA

SEQ ID NO: 32532 - protein, 28 aa, Artificial Sequence
  Description of Artificial Sequence: Synthetic peptide
DEEEIRATNPVATETYGCVSTNLQTGDF

SEQ ID NO: 32533 - protein, 28 aa, Artificial Sequence
  Description of Artificial Sequence: Synthetic peptide
DEEEIRCTNPVATEHYGAVSDNLQVGNA

SEQ ID NO: 32534 - protein, 29 aa, Artificial Sequence
  Description of Artificial Sequence: Synthetic peptide
QEQEIRQTNPVATEQYGSVSAENLQHGNR

SEQ ID NO: 32535 - protein, 30 aa, Artificial Sequence
  Description of Artificial Sequence: Synthetic polypeptide
DEEEIRTTNPVATEQYGECSATVLQAAGNR

SEQ ID NO: 32536 - protein, 28 aa, Artificial Sequence
  Description of Artificial Sequence: Synthetic peptide
DEEEIRTTNPVATEQYWSVSDDLEHGNN

SEQ ID NO: 32537 - protein, 28 aa, Artificial Sequence
  Description of Artificial Sequence: Synthetic peptide
DEEEICSTNPVATEPYGNVSTNQQRGNA

SEQ ID NO: 32538 - protein, 30 aa, Artificial Sequence
  Description of Artificial Sequence: Synthetic polypeptide
DEEEIRTTNPVATEQYGSVSTLDDPQTGDR

SEQ ID NO: 32539 - protein, 28 aa, Artificial Sequence
  Description of Artificial Sequence: Synthetic peptide
DEEEIVTTNPVATELYGSVSMPLQRGEQ

SEQ ID NO: 32540 - protein, 28 aa, Artificial Sequence
  Description of Artificial Sequence: Synthetic peptide
DDEEIRTTNPVAYEQYGEVSTALDRGND

SEQ ID NO: 32541 - protein, 28 aa, Artificial Sequence
  Description of Artificial Sequence: Synthetic peptide
DEEEIVATNPVATEQYGSVSTNLMHGQQ

SEQ ID NO: 32542 - protein, 29 aa, Artificial Sequence
  Description of Artificial Sequence: Synthetic peptide
REEEIRATNPIATEQYGAVATNLQREGNR

SEQ ID NO: 32543 - protein, 29 aa, Artificial Sequence
  Description of Artificial Sequence: Synthetic peptide
DENEIRSTNPVATECYGSVSTNLQHEGNI

SEQ ID NO: 32544 - protein, 29 aa, Artificial Sequence
  Description of Artificial Sequence: Synthetic peptide
DEEEIRTTNPIASEIYGCVAATNLQRGNR

SEQ ID NO: 32545 - protein, 28 aa, Artificial Sequence
  Description of Artificial Sequence: Synthetic peptide
DEEEIRTTNPVATECYGSVSTDLEYGEN

SEQ ID NO: 32546 - protein, 29 aa, Artificial Sequence
  Description of Artificial Sequence: Synthetic peptide
DEMEIRCTNPVATEQYGTASDNLQRAGNR

SEQ ID NO: 32547 - protein, 29 aa, Artificial Sequence
  Description of Artificial Sequence: Synthetic peptide
DEHEISTTNPVATEQYGSVIENLFMRGNR

SEQ ID NO: 32548 - protein, 31 aa, Artificial Sequence
  Description of Artificial Sequence: Synthetic polypeptide
DEEEIRTTNPVATEQYGESWETNDQRKGNDR

SEQ ID NO: 32549 - protein, 28 aa, Artificial Sequence
  Description of Artificial Sequence: Synthetic peptide
DEEEIRATNPVSTEIYGSASTNIQHGNR

SEQ ID NO: 32550 - protein, 30 aa, Artificial Sequence
  Description of Artificial Sequence: Synthetic polypeptide
DENEIRTTNPVATEQYGSVSTDLQDHEGNN

SEQ ID NO: 32551 - protein, 28 aa, Artificial Sequence
  Description of Artificial Sequence: Synthetic peptide
DENEIVTTNPVSTEQYGSVSMNLQRGEL

SEQ ID NO: 32552 - protein, 28 aa, Artificial Sequence
  Description of Artificial Sequence: Synthetic peptide
DEEEIRTTNPVATEQYGSVSEELQHEEN

SEQ ID NO: 32553 - protein, 28 aa, Artificial Sequence
  Description of Artificial Sequence: Synthetic peptide
DEEEIRTTNPVATEQYGSYSEAEQGGTR

SEQ ID NO: 32554 - protein, 30 aa, Artificial Sequence
  Description of Artificial Sequence: Synthetic polypeptide
DEEEIRTTNPVATETYGSVSTANGEQRGTF

SEQ ID NO: 32555 - protein, 28 aa, Artificial Sequence
  Description of Artificial Sequence: Synthetic peptide
DEQEIRATNPVATEQYGVVSMNLQAGNY

SEQ ID NO: 32556 - protein, 29 aa, Artificial Sequence
  Description of Artificial Sequence: Synthetic peptide
DENEITCTNPVATEQYGSVSTNLQTNGND

SEQ ID NO: 32557 - protein, 28 aa, Artificial Sequence
  Description of Artificial Sequence: Synthetic peptide
DEEEIRTTNPVATEMYGNVSENLMTFNR

SEQ ID NO: 32558 - protein, 30 aa, Artificial Sequence
  Description of Artificial Sequence: Synthetic polypeptide
QEEEIATTNPVATEQYGSVSTNLQDFKGDR

SEQ ID NO: 32559 - protein, 30 aa, Artificial Sequence
  Description of Artificial Sequence: Synthetic polypeptide
DEEEIRTTNPVCTEQYGVVSTNDQVRNGNH

SEQ ID NO: 32560 - protein, 28 aa, Artificial Sequence
  Description of Artificial Sequence: Synthetic peptide
DENEIRTTNPCATEQYGSVSTALQHLNE

SEQ ID NO: 32561 - protein, 31 aa, Artificial Sequence
  Description of Artificial Sequence: Synthetic polypeptide
DEEEIRTTNPVSTECYGSVSENLQCRKGNDR

SEQ ID NO: 32562 - protein, 30 aa, Artificial Sequence
  Description of Artificial Sequence: Synthetic polypeptide
DEEEIRPTNPVATEQYGSVAMDNLQVGNLR

SEQ ID NO: 32563 - protein, 28 aa, Artificial Sequence
  Description of Artificial Sequence: Synthetic peptide
DEEEIRTTNPVATEQWGSYSENLQQENA

SEQ ID NO: 32564 - protein, 28 aa, Artificial Sequence
  Description of Artificial Sequence: Synthetic peptide
SEEEIATTNPVATEQFGSVSENEQQGNR

SEQ ID NO: 32565 - protein, 28 aa, Artificial Sequence
  Description of Artificial Sequence: Synthetic peptide
DENEIRTTNPVSTECYGSVSENEQRGNA

SEQ ID NO: 32566 - protein, 28 aa, Artificial Sequence
  Description of Artificial Sequence: Synthetic peptide
DENEIRTTNPVATECYGVVDTNLQHGNF

SEQ ID NO: 32567 - protein, 28 aa, Artificial Sequence
  Description of Artificial Sequence: Synthetic peptide
DENEIRTTNPVATEQWGSVSTNEMLGNF

SEQ ID NO: 32568 - protein, 28 aa, Artificial Sequence
  Description of Artificial Sequence: Synthetic peptide
QEEEIRTVNPVATEVYGEVSTNLQHGGR

SEQ ID NO: 32569 - protein, 28 aa, Artificial Sequence
  Description of Artificial Sequence: Synthetic peptide
DENEIVTTNPVATECYGSVSTELQTGNQ

SEQ ID NO: 32570 - protein, 31 aa, Artificial Sequence
  Description of Artificial Sequence: Synthetic polypeptide
DEEEIRQTNPVATEQWGSVCSDTGNLQRGER

SEQ ID NO: 32571 - protein, 28 aa, Artificial Sequence
  Description of Artificial Sequence: Synthetic peptide
DENEIRTTNPVATEQYGSYHEILQRGNQ

SEQ ID NO: 32572 - protein, 28 aa, Artificial Sequence
  Description of Artificial Sequence: Synthetic peptide
DEQEIGTTNPVATEMYGCVSTNLQRGMS

SEQ ID NO: 32573 - protein, 28 aa, Artificial Sequence
  Description of Artificial Sequence: Synthetic peptide
DEQEIVTTNPVATEQYGSVSTELQVGDQ

SEQ ID NO: 32574 - protein, 29 aa, Artificial Sequence
  Description of Artificial Sequence: Synthetic peptide
MEEEIRTTNPVATESYGVCVSTPLQRGND

SEQ ID NO: 32575 - protein, 30 aa, Artificial Sequence
  Description of Artificial Sequence: Synthetic polypeptide
DENEIRTTNPVATENFGSVSTGNGLQRGNI

SEQ ID NO: 32576 - protein, 28 aa, Artificial Sequence
  Description of Artificial Sequence: Synthetic peptide
SEEEIRTTNPVATEMGGSVSTNLQNGAQ

SEQ ID NO: 32577 - protein, 31 aa, Artificial Sequence
  Description of Artificial Sequence: Synthetic polypeptide
DEEEIRTTNPVATEQYWGSVDSEIDLQRGER

SEQ ID NO: 32578 - protein, 28 aa, Artificial Sequence
  Description of Artificial Sequence: Synthetic peptide
DENEISTTNPVCTEMYGDVSTNLQRGNF

SEQ ID NO: 32579 - protein, 28 aa, Artificial Sequence
  Description of Artificial Sequence: Synthetic peptide
DEEEIRTTNPVSTEQFGSVGENLQYGMR

SEQ ID NO: 32580 - protein, 28 aa, Artificial Sequence
  Description of Artificial Sequence: Synthetic peptide
SEEEICTTNPVATELYGSVSENPQRGTR

SEQ ID NO: 32581 - protein, 29 aa, Artificial Sequence
  Description of Artificial Sequence: Synthetic peptide
KEEEIRATNPVATEQYGSVSTNLQSGDDT

SEQ ID NO: 32582 - protein, 28 aa, Artificial Sequence
  Description of Artificial Sequence: Synthetic peptide
DEEEIRSTNPVATEVYGVVSTALIGGNR

SEQ ID NO: 32583 - protein, 31 aa, Artificial Sequence
  Description of Artificial Sequence: Synthetic polypeptide
DEEEIRTTNPVATEQYGSWSLTNGPQRGVER

SEQ ID NO: 32584 - protein, 28 aa, Artificial Sequence
  Description of Artificial Sequence: Synthetic peptide
DEQEIAATNPVATEQYGSVSTDLQAGNS

SEQ ID NO: 32585 - protein, 28 aa, Artificial Sequence
  Description of Artificial Sequence: Synthetic peptide
KEEEIATTNPVATECYGSVSTDLQTGNV

SEQ ID NO: 32586 - protein, 28 aa, Artificial Sequence
  Description of Artificial Sequence: Synthetic peptide
DENEIRTTNPVATECYGTVSTDLQHGNI

SEQ ID NO: 32587 - protein, 31 aa, Artificial Sequence
  Description of Artificial Sequence: Synthetic polypeptide
DEEEIRTTNPVATEQYGSVDTNLMMINGENR

SEQ ID NO: 32588 - protein, 28 aa, Artificial Sequence
  Description of Artificial Sequence: Synthetic peptide
NEEEIKTVNPVATEAYGSVSTNQQVGNR

SEQ ID NO: 32589 - protein, 28 aa, Artificial Sequence
  Description of Artificial Sequence: Synthetic peptide
DEEEIKTTNVVAWEHYGSVSTNEQNGNR

SEQ ID NO: 32590 - protein, 28 aa, Artificial Sequence
  Description of Artificial Sequence: Synthetic peptide
MENEIRTTNPVATECYGWVSTNLQQGNS

SEQ ID NO: 32591 - protein, 28 aa, Artificial Sequence
  Description of Artificial Sequence: Synthetic peptide
KEDEIRTTNPVATEMYGSVSTDLERGDR

SEQ ID NO: 32592 - protein, 33 aa, Artificial Sequence
  Description of Artificial Sequence: Synthetic polypeptide
DEEEIRTTNPVATEQYGSVSITPNPLQIRGDER

SEQ ID NO: 32593 - protein, 28 aa, Artificial Sequence
  Description of Artificial Sequence: Synthetic peptide
QEQEITTTNPVATEQYGSVSTELQDGNL

SEQ ID NO: 32594 - protein, 30 aa, Artificial Sequence
  Description of Artificial Sequence: Synthetic polypeptide
DEEEIRATNPVATEQYGSVSTINDQRGLAS

SEQ ID NO: 32595 - protein, 29 aa, Artificial Sequence
  Description of Artificial Sequence: Synthetic peptide
DEEEIRTTNPVATEQYGIVSAENLQWMQR

SEQ ID NO: 32596 - protein, 28 aa, Artificial Sequence
  Description of Artificial Sequence: Synthetic peptide
DEEEIVCTNPVCTEQYGSVSDDLQRGDR

SEQ ID NO: 32597 - protein, 28 aa, Artificial Sequence
  Description of Artificial Sequence: Synthetic peptide
DEEEIRTTNPVATEQYGSVETDDQHENF

SEQ ID NO: 32598 - protein, 28 aa, Artificial Sequence
  Description of Artificial Sequence: Synthetic peptide
DEEEITTVNPVATEQYGSVATNEQRGTW

SEQ ID NO: 32599 - protein, 29 aa, Artificial Sequence
  Description of Artificial Sequence: Synthetic peptide
DEQEIRTTNPVATECYGSVSATNLEHGER

SEQ ID NO: 32600 - protein, 28 aa, Artificial Sequence
  Description of Artificial Sequence: Synthetic peptide
SEEEIRTTNPTATEQYGSVSENEQRGDF

SEQ ID NO: 32601 - protein, 30 aa, Artificial Sequence
  Description of Artificial Sequence: Synthetic polypeptide
SEEEIRTTNPVATEVYGSVSVENPQERGNR

SEQ ID NO: 32602 - protein, 31 aa, Artificial Sequence
  Description of Artificial Sequence: Synthetic polypeptide
DEEEIRTTNPVATEQYGSVSTNLQDDKGEDQ

SEQ ID NO: 32603 - protein, 29 aa, Artificial Sequence
  Description of Artificial Sequence: Synthetic peptide
DEEEIRTTNPVATEQYGSVDCENLCHGNA

SEQ ID NO: 32604 - protein, 29 aa, Artificial Sequence
  Description of Artificial Sequence: Synthetic peptide
DEEEIRTTNPVASEIYGCVSASNLERGNR

SEQ ID NO: 32605 - protein, 32 aa, Artificial Sequence
  Description of Artificial Sequence: Synthetic polypeptide
DEEEIRTTNPVATECYGSVSATNLQDHNGNDR

SEQ ID NO: 32606 - protein, 28 aa, Artificial Sequence
  Description of Artificial Sequence: Synthetic peptide
DEEEVRTTNPVASEIYGCVSTNLEPGNR

SEQ ID NO: 32607 - protein, 28 aa, Artificial Sequence
  Description of Artificial Sequence: Synthetic peptide
DEQEIRTTNPVATECWGSVSENLQRGDA

SEQ ID NO: 32608 - protein, 28 aa, Artificial Sequence
  Description of Artificial Sequence: Synthetic peptide
MEEEIRTTNPVATECYGAVSTNLQHGEE

SEQ ID NO: 32609 - protein, 28 aa, Artificial Sequence
  Description of Artificial Sequence: Synthetic peptide
DESEIRTTNPVATEAYGSVAYNLERGNL

SEQ ID NO: 32610 - protein, 31 aa, Artificial Sequence
  Description of Artificial Sequence: Synthetic polypeptide
QEEEIRTTNPVATEVYGSVSATLDLQLRGNR

SEQ ID NO: 32611 - protein, 30 aa, Artificial Sequence
  Description of Artificial Sequence: Synthetic polypeptide
DEEEIRTTNPVATEQWGHSVSTNLQNREDA

SEQ ID NO: 32612 - protein, 28 aa, Artificial Sequence
  Description of Artificial Sequence: Synthetic peptide
DENEIATTNPVATEIYGSVSTNLEAGNN

SEQ ID NO: 32613 - protein, 28 aa, Artificial Sequence
  Description of Artificial Sequence: Synthetic peptide
DEEMIRTTNPVATEWWGSWSTGDQRGNR

SEQ ID NO: 32614 - protein, 30 aa, Artificial Sequence
  Description of Artificial Sequence: Synthetic polypeptide
DEEEIRTTNPTATEQYGSVSTMNEQNGDNV

SEQ ID NO: 32615 - protein, 33 aa, Artificial Sequence
  Description of Artificial Sequence: Synthetic polypeptide
DEEEIRTTNPVATEQYGSASSTTGNLQRNGENR

SEQ ID NO: 32616 - protein, 28 aa, Artificial Sequence
  Description of Artificial Sequence: Synthetic peptide
TEEEIYTTNPVAYEQYGSVSEDLQLGNR

SEQ ID NO: 32617 - protein, 31 aa, Artificial Sequence
  Description of Artificial Sequence: Synthetic polypeptide
DEEEIRTTNPVATEQYGTVSTMNPQDGGNWR

SEQ ID NO: 32618 - protein, 28 aa, Artificial Sequence
  Description of Artificial Sequence: Synthetic peptide
DEQEIATTNPVATEQYGSVSTDLQHGEQ

SEQ ID NO: 32619 - protein, 28 aa, Artificial Sequence
  Description of Artificial Sequence: Synthetic peptide
NEVEIRTTNPVATEQYGSVDENLEAGNR

SEQ ID NO: 32620 - protein, 29 aa, Artificial Sequence
  Description of Artificial Sequence: Synthetic peptide
DEHEIATTNPVATEVYGSVSTNLQHNPNR

SEQ ID NO: 32621 - protein, 30 aa, Artificial Sequence
  Description of Artificial Sequence: Synthetic polypeptide
DEVEIRTTNPVATEQFGGVSTMNLQQEGNR

SEQ ID NO: 32622 - protein, 32 aa, Artificial Sequence
  Description of Artificial Sequence: Synthetic polypeptide
DEEEIRTTNPVATEQYGSVDSETNLQTGDNEM

SEQ ID NO: 32623 - protein, 28 aa, Artificial Sequence
  Description of Artificial Sequence: Synthetic peptide
AEQEIVATNPVATEIYGVVSTNLQRGNR

SEQ ID NO: 32624 - protein, 28 aa, Artificial Sequence
  Description of Artificial Sequence: Synthetic peptide
DEEEVRSTNPVATEQYGVAATNLQRGNA

SEQ ID NO: 32625 - protein, 28 aa, Artificial Sequence
  Description of Artificial Sequence: Synthetic peptide
DENEIVTTNPVATEIYGSVSTDLQTGNV

SEQ ID NO: 32626 - protein, 28 aa, Artificial Sequence
  Description of Artificial Sequence: Synthetic peptide
GEEEIRSTNPVATEQYGVVSTNLEPGDR

SEQ ID NO: 32627 - protein, 28 aa, Artificial Sequence
  Description of Artificial Sequence: Synthetic peptide
DEEEIRTTNPTATEQYGEVSENPQRGDH

SEQ ID NO: 32628 - protein, 28 aa, Artificial Sequence
  Description of Artificial Sequence: Synthetic peptide
DEEEIRTTNPVSTECWGSVSDNLQIGTR

SEQ ID NO: 32629 - protein, 29 aa, Artificial Sequence
  Description of Artificial Sequence: Synthetic peptide
DEEEIRTTNPVATENYGVVSAEHLQRGLR

SEQ ID NO: 32630 - protein, 30 aa, Artificial Sequence
  Description of Artificial Sequence: Synthetic polypeptide
DEEEIRTTNPVASEQYGCVAAMNLQRNGNR

SEQ ID NO: 32631 - protein, 28 aa, Artificial Sequence
  Description of Artificial Sequence: Synthetic peptide
DEQEIRTTNPVATEQYGSVSTEDEPGNI

SEQ ID NO: 32632 - protein, 29 aa, Artificial Sequence
  Description of Artificial Sequence: Synthetic peptide
DENEIRTTNPVATEWYGSVSTNEQIRGTQ

SEQ ID NO: 32633 - protein, 28 aa, Artificial Sequence
  Description of Artificial Sequence: Synthetic peptide
QEEEIATVNPVATEQYGVVATNLERGNR

SEQ ID NO: 32634 - protein, 30 aa, Artificial Sequence
  Description of Artificial Sequence: Synthetic polypeptide
DEVEIAATNPVSTEQYGSVSTNLQRSGNSR

SEQ ID NO: 32635 - protein, 28 aa, Artificial Sequence
  Description of Artificial Sequence: Synthetic peptide
AEEEITTTNPDATEQYGEVSTNLQLGNA

SEQ ID NO: 32636 - protein, 28 aa, Artificial Sequence
  Description of Artificial Sequence: Synthetic peptide
DEQEIRTTNPVATEQYGSVSTDDDTGER

SEQ ID NO: 32637 - protein, 31 aa, Artificial Sequence
  Description of Artificial Sequence: Synthetic polypeptide
DEQEIRTTNPVATEQYGSVSTNDPQDGGVNR

SEQ ID NO: 32638 - protein, 28 aa, Artificial Sequence
  Description of Artificial Sequence: Synthetic peptide
AEEEIATTNPVATEQYGSVSENQERGER

SEQ ID NO: 32639 - protein, 28 aa, Artificial Sequence
  Description of Artificial Sequence: Synthetic peptide
DEEEIAQTNPVATEPYGEVSENLQRGNY

SEQ ID NO: 32640 - protein, 28 aa, Artificial Sequence
  Description of Artificial Sequence: Synthetic peptide
DEQEIRTTNPVCTEQYGCASTNLQHGNM

SEQ ID NO: 32641 - protein, 28 aa, Artificial Sequence
  Description of Artificial Sequence: Synthetic peptide
DEEEIATTNPVATEQYGDASENLMHGNR

SEQ ID NO: 32642 - protein, 31 aa, Artificial Sequence
  Description of Artificial Sequence: Synthetic polypeptide
DDEEIRTTNPVATEQYGSVSTNLQNVAGNDF

SEQ ID NO: 32643 - protein, 28 aa, Artificial Sequence
  Description of Artificial Sequence: Synthetic peptide
EEQEIRCTNPVATEQYGSVSENLQHGNQ

SEQ ID NO: 32644 - protein, 31 aa, Artificial Sequence
  Description of Artificial Sequence: Synthetic polypeptide
DEEEIRTTNPVATEQYGVVSCNNLQRNGINI

SEQ ID NO: 32645 - protein, 29 aa, Artificial Sequence
  Description of Artificial Sequence: Synthetic peptide
DEQEIRTTNPDATEQYGSVSTDLEREGNP

SEQ ID NO: 32646 - protein, 28 aa, Artificial Sequence
  Description of Artificial Sequence: Synthetic peptide
DENEISTTNPVATEMYGSVSTDLQRGDN

SEQ ID NO: 32647 - protein, 29 aa, Artificial Sequence
  Description of Artificial Sequence: Synthetic peptide
DENEIRTTNPVATEQWGIVSTNLQNGGNF

SEQ ID NO: 32648 - protein, 31 aa, Artificial Sequence
  Description of Artificial Sequence: Synthetic polypeptide
DEEELRTTNPVATEQYGCVSAMNLQRNGENR

SEQ ID NO: 32649 - protein, 28 aa, Artificial Sequence
  Description of Artificial Sequence: Synthetic peptide
DEEEIRTTNPVCTEIYGVVSTDLQHGDR

SEQ ID NO: 32650 - protein, 28 aa, Artificial Sequence
  Description of Artificial Sequence: Synthetic peptide
SEEEIVCTNPVATEQYGGVSTNLQRGDH

SEQ ID NO: 32651 - protein, 28 aa, Artificial Sequence
  Description of Artificial Sequence: Synthetic peptide
DENEIRCTNPVATETYGSVSENLQSGNA

SEQ ID NO: 32652 - protein, 28 aa, Artificial Sequence
  Description of Artificial Sequence: Synthetic peptide
DEEEIRTTNPYATEQYGSVHEGEMRGNR

SEQ ID NO: 32653 - protein, 29 aa, Artificial Sequence
  Description of Artificial Sequence: Synthetic peptide
QEEEVRTTNPVATEQYGSVATNEQQRGDR

SEQ ID NO: 32654 - protein, 28 aa, Artificial Sequence
  Description of Artificial Sequence: Synthetic peptide
DEEEIRTTNPVASENYGSVSTNDEIGNN

SEQ ID NO: 32655 - protein, 28 aa, Artificial Sequence
  Description of Artificial Sequence: Synthetic peptide
DEQEIATTNPVATECYGSVSTNLEHGNL

SEQ ID NO: 32656 - protein, 30 aa, Artificial Sequence
  Description of Artificial Sequence: Synthetic polypeptide
DEEEIRPTNPVATEQYGSVDSTCNPQRGES

SEQ ID NO: 32657 - protein, 32 aa, Artificial Sequence
  Description of Artificial Sequence: Synthetic polypeptide
DEEEIRTTNPVATELYGSVISTMNLQQGDNTR

SEQ ID NO: 32658 - protein, 28 aa, Artificial Sequence
  Description of Artificial Sequence: Synthetic peptide
DEQEIRQTNPVATEIYGEVSTQLQRGAR

SEQ ID NO: 32659 - protein, 28 aa, Artificial Sequence
  Description of Artificial Sequence: Synthetic peptide
DEEEIRTTNPVATEQYGDVSTDDERENQ

SEQ ID NO: 32660 - protein, 28 aa, Artificial Sequence
  Description of Artificial Sequence: Synthetic peptide
DEEEIRTTNPTATQFYGGVSTNLQNGNH

SEQ ID NO: 32661 - protein, 29 aa, Artificial Sequence
  Description of Artificial Sequence: Synthetic peptide
AEEEITTTNPVATEQYGSVSENLQHAGMR

SEQ ID NO: 32662 - protein, 28 aa, Artificial Sequence
  Description of Artificial Sequence: Synthetic peptide
DEEEIRCTNPVSTEWYGSVSTNDQRGDF

SEQ ID NO: 32663 - protein, 28 aa, Artificial Sequence
  Description of Artificial Sequence: Synthetic peptide
QEEEIRTTNPVATECYGDVPDNLQHGNR

SEQ ID NO: 32664 - protein, 31 aa, Artificial Sequence
  Description of Artificial Sequence: Synthetic polypeptide
MENEIRTTNPVATEVYGSVSTNLTQRAGNDR

SEQ ID NO: 32665 - protein, 28 aa, Artificial Sequence
  Description of Artificial Sequence: Synthetic peptide
DEHEIRTTNPCATEQYGSASTNLEGGNE

SEQ ID NO: 32666 - protein, 28 aa, Artificial Sequence
  Description of Artificial Sequence: Synthetic peptide
DEEEIRSTNPVATEQYGGVSSNLQRPTF

SEQ ID NO: 32667 - protein, 28 aa, Artificial Sequence
  Description of Artificial Sequence: Synthetic peptide
DEECIRTTNPVATEQGWSVETNLQQENR

SEQ ID NO: 32668 - protein, 28 aa, Artificial Sequence
  Description of Artificial Sequence: Synthetic peptide
DECEIRATNPVATEPYGSVSTNEQQGNL

SEQ ID NO: 32669 - protein, 30 aa, Artificial Sequence
  Description of Artificial Sequence: Synthetic polypeptide
DEEEIRATNPTATEQYGDVSTNLQQGDNTR

SEQ ID NO: 32670 - protein, 28 aa, Artificial Sequence
  Description of Artificial Sequence: Synthetic peptide
DEEEIATTNPVATEQYGDASEDLQHGNR

SEQ ID NO: 32671 - protein, 30 aa, Artificial Sequence
  Description of Artificial Sequence: Synthetic polypeptide
DEEEVRATNPVATELYGSVSATNLEREGNR

SEQ ID NO: 32672 - protein, 29 aa, Artificial Sequence
  Description of Artificial Sequence: Synthetic peptide
KENEIATTNPVATEQYGDVSTNLQERGNM

SEQ ID NO: 32673 - protein, 28 aa, Artificial Sequence
  Description of Artificial Sequence: Synthetic peptide
DEEEIRPTNPFAYEQYGSVSTGLDPGNR

SEQ ID NO: 32674 - protein, 30 aa, Artificial Sequence
  Description of Artificial Sequence: Synthetic polypeptide
DEEEIRTTNPVATEQYWSVADTNNDQRENR

SEQ ID NO: 32675 - protein, 28 aa, Artificial Sequence
  Description of Artificial Sequence: Synthetic peptide
DEEEICTTNPVCTEQYGDASTALQDGNR

SEQ ID NO: 32676 - protein, 33 aa, Artificial Sequence
  Description of Artificial Sequence: Synthetic polypeptide
DEEEIRTTNPVATEQYGSVSDTTNGLVQNNGNR

SEQ ID NO: 32677 - protein, 31 aa, Artificial Sequence
  Description of Artificial Sequence: Synthetic polypeptide
DEEEIRTTNPVATEQYGSVSTNLELVNGENC

SEQ ID NO: 32678 - protein, 29 aa, Artificial Sequence
  Description of Artificial Sequence: Synthetic peptide
AENEISTTNPVATEQYGWVSADNLQRGNR

SEQ ID NO: 32679 - protein, 28 aa, Artificial Sequence
  Description of Artificial Sequence: Synthetic peptide
QESEIRTVNPVSTEQYGSASCNLQRGNR

SEQ ID NO: 32680 - protein, 28 aa, Artificial Sequence
  Description of Artificial Sequence: Synthetic peptide
DEQEIATTNPVATEQYGSVSEDDQRGNA

SEQ ID NO: 32681 - protein, 28 aa, Artificial Sequence
  Description of Artificial Sequence: Synthetic peptide
DEQEIRTTNPVATEQWGSVSENLMGGNM

SEQ ID NO: 32682 - protein, 28 aa, Artificial Sequence
  Description of Artificial Sequence: Synthetic peptide
DEQEIRTTNPVATECYGSVSTNEMIGNA

SEQ ID NO: 32683 - protein, 28 aa, Artificial Sequence
  Description of Artificial Sequence: Synthetic peptide
KEDEIRCTNPVATEVYGSCSTELQRGNR

SEQ ID NO: 32684 - protein, 28 aa, Artificial Sequence
  Description of Artificial Sequence: Synthetic peptide
DEVEIATTNPVATEQYGSVSENEQRGTF

SEQ ID NO: 32685 - protein, 29 aa, Artificial Sequence
  Description of Artificial Sequence: Synthetic peptide
AEEEIATTNPVSTEQYGEVSAENLQRGNR

SEQ ID NO: 32686 - protein, 30 aa, Artificial Sequence
  Description of Artificial Sequence: Synthetic polypeptide
DENEIRTTNPVCTEQYGSVSDFFLLQRGNR

SEQ ID NO: 32687 - protein, 29 aa, Artificial Sequence
  Description of Artificial Sequence: Synthetic peptide
DEQEIRTTNPVATEQWGSVSTNEQMQGNW

SEQ ID NO: 32688 - protein, 30 aa, Artificial Sequence
  Description of Artificial Sequence: Synthetic polypeptide
DEEEIRTTNPVATEIYGVVSATNLQVAGNA

SEQ ID NO: 32689 - protein, 28 aa, Artificial Sequence
  Description of Artificial Sequence: Synthetic peptide
NEDEIRCTNPVATEQYGSVSENLQVGNS

SEQ ID NO: 32690 - protein, 28 aa, Artificial Sequence
  Description of Artificial Sequence: Synthetic peptide
DENEIATTNPVATEQYGSASTCLQRENL

SEQ ID NO: 32691 - protein, 32 aa, Artificial Sequence
  Description of Artificial Sequence: Synthetic polypeptide
DEEEIRTTNPVATEQYGESVSTALQLWKGNPR

SEQ ID NO: 32692 - protein, 31 aa, Artificial Sequence
  Description of Artificial Sequence: Synthetic polypeptide
DEEEIRTTNPVATEQYGTVSENGLCCRGNDR

SEQ ID NO: 32693 - protein, 29 aa, Artificial Sequence
  Description of Artificial Sequence: Synthetic peptide
DEEEIRTTNPVATEWYGGVSENLQRSGDT

SEQ ID NO: 32694 - protein, 28 aa, Artificial Sequence
  Description of Artificial Sequence: Synthetic peptide
DEQEIRTTNPVATECWGSVSTNEQQGNA

SEQ ID NO: 32695 - protein, 28 aa, Artificial Sequence
  Description of Artificial Sequence: Synthetic peptide
DEEEIATTNPVCTEQYGSVPTCLQHENR

SEQ ID NO: 32696 - protein, 31 aa, Artificial Sequence
  Description of Artificial Sequence: Synthetic polypeptide
DEEEIRTTNPVATECYGSVSDTPPDVQRGNR

SEQ ID NO: 32697 - protein, 28 aa, Artificial Sequence
  Description of Artificial Sequence: Synthetic peptide
DEQEIRTTNPVATEQWGSVSENEMQGNR

SEQ ID NO: 32698 - protein, 28 aa, Artificial Sequence
  Description of Artificial Sequence: Synthetic peptide
DEEEIRTTNPVATEQYGSVWTNLCEMQQ

SEQ ID NO: 32699 - protein, 28 aa, Artificial Sequence
  Description of Artificial Sequence: Synthetic peptide
DENEIRTTNPVATECYGSVSTNLQTLEN

SEQ ID NO: 32700 - protein, 28 aa, Artificial Sequence
  Description of Artificial Sequence: Synthetic peptide
DEVEIRTTNPVATEQYGVVSTMLQGGTF

SEQ ID NO: 32701 - protein, 31 aa, Artificial Sequence
  Description of Artificial Sequence: Synthetic polypeptide
DEEEIRTTNPVATEQYGSVSCTDLQCNGNDC

SEQ ID NO: 32702 - protein, 29 aa, Artificial Sequence
  Description of Artificial Sequence: Synthetic peptide
DEQEIRTTNPVATEIYGCVSTNLQQHGNT

SEQ ID NO: 32703 - protein, 28 aa, Artificial Sequence
  Description of Artificial Sequence: Synthetic peptide
DEEEIVTVNPCATEQYGSVSENLQRENL

SEQ ID NO: 32704 - protein, 29 aa, Artificial Sequence
  Description of Artificial Sequence: Synthetic peptide
DEEEIRTTNPVATEWWGSVSTNLQITGTA

SEQ ID NO: 32705 - protein, 29 aa, Artificial Sequence
  Description of Artificial Sequence: Synthetic peptide
DEEEIVTTNPVATECYGWVSTNLQRKGEV

SEQ ID NO: 32706 - protein, 28 aa, Artificial Sequence
  Description of Artificial Sequence: Synthetic peptide
DENEIATTNPVATECYGSVSTDLERGER

SEQ ID NO: 32707 - protein, 28 aa, Artificial Sequence
  Description of Artificial Sequence: Synthetic peptide
DESEIRTTNPVCTECYGDVSCNLQRGNY

SEQ ID NO: 32708 - protein, 31 aa, Artificial Sequence
  Description of Artificial Sequence: Synthetic polypeptide
DEEEIRTTNPVATECYGSVSTNLQDLEGNDT

SEQ ID NO: 32709 - protein, 28 aa, Artificial Sequence
  Description of Artificial Sequence: Synthetic peptide
DENEIRTTNPVCTEPYGSVATNLQYGND

SEQ ID NO: 32710 - protein, 30 aa, Artificial Sequence
  Description of Artificial Sequence: Synthetic polypeptide
DEEEIRTTNPVATEQYGSVSTDLQEAGDDC

SEQ ID NO: 32711 - protein, 30 aa, Artificial Sequence
  Description of Artificial Sequence: Synthetic polypeptide
DENEIRATNPVATEQYGSVSETNLQYGNDV

SEQ ID NO: 32712 - protein, 28 aa, Artificial Sequence
  Description of Artificial Sequence: Synthetic peptide
DENEIRTTNPVATECYGSVSTDLEHGER

SEQ ID NO: 32713 - protein, 28 aa, Artificial Sequence
  Description of Artificial Sequence: Synthetic peptide
DENEITTTNPVATEQYGSVSYELQHGND

SEQ ID NO: 32714 - protein, 29 aa, Artificial Sequence
  Description of Artificial Sequence: Synthetic peptide
FEHEIRTTNPVATEWWGSVSTNLQSRGNH

SEQ ID NO: 32715 - protein, 28 aa, Artificial Sequence
  Description of Artificial Sequence: Synthetic peptide
DEECIRTTNPVATEQYWFVSENDQRGNP

SEQ ID NO: 32716 - protein, 28 aa, Artificial Sequence
  Description of Artificial Sequence: Synthetic peptide
DDEEIRATNPVATECYGVVSTDLQRGNQ

SEQ ID NO: 32717 - protein, 28 aa, Artificial Sequence
  Description of Artificial Sequence: Synthetic peptide
DEEYIRTTNPVATEQYGSVFTPLDDGND

SEQ ID NO: 32718 - protein, 30 aa, Artificial Sequence
  Description of Artificial Sequence: Synthetic polypeptide
DEMEIRTTNPIATEQYGQVSTQNLQSRGNA

SEQ ID NO: 32719 - protein, 28 aa, Artificial Sequence
  Description of Artificial Sequence: Synthetic peptide
DEAEIYTTNPVATEIYGSVSCNLQRLGR

SEQ ID NO: 32720 - protein, 28 aa, Artificial Sequence
  Description of Artificial Sequence: Synthetic peptide
DEEEIRPTNPMATEQYGSISTNLQEPNW

SEQ ID NO: 32721 - protein, 28 aa, Artificial Sequence
  Description of Artificial Sequence: Synthetic peptide
DEEEIRTTNPVATMQCGSVDGNLQRPNV

SEQ ID NO: 32722 - protein, 29 aa, Artificial Sequence
  Description of Artificial Sequence: Synthetic peptide
DEEEIAQTNPVATEVYGSVSDNLQARGQR

SEQ ID NO: 32723 - protein, 28 aa, Artificial Sequence
  Description of Artificial Sequence: Synthetic peptide
DEEEIATTNPVATEQYGTVSENLQRFDT

SEQ ID NO: 32724 - protein, 28 aa, Artificial Sequence
  Description of Artificial Sequence: Synthetic peptide
SENEIRCTNPVATELWGSVSENLQRGNR

SEQ ID NO: 32725 - protein, 29 aa, Artificial Sequence
  Description of Artificial Sequence: Synthetic peptide
QEEEITTTNPVATEPYGSVDTNLQRGENA

SEQ ID NO: 32726 - protein, 28 aa, Artificial Sequence
  Description of Artificial Sequence: Synthetic peptide
SEEEIRTTNPVATEQFGSVSTDLQSGLL

SEQ ID NO: 32727 - protein, 30 aa, Artificial Sequence
  Description of Artificial Sequence: Synthetic polypeptide
DENEIRTTNPVATEQYGVVSTNLQDYKGND

SEQ ID NO: 32728 - protein, 28 aa, Artificial Sequence
  Description of Artificial Sequence: Synthetic peptide
DEKEIRTTNPVATEQYGSVSPYLGRDNN

SEQ ID NO: 32729 - protein, 31 aa, Artificial Sequence
  Description of Artificial Sequence: Synthetic polypeptide
DEEEIRTTNPVATEQYGSVSTANPQEIGNTQ

SEQ ID NO: 32730 - protein, 28 aa, Artificial Sequence
  Description of Artificial Sequence: Synthetic peptide
DEEEIRTTNPVATEIFGEVSTNLQNGTE

SEQ ID NO: 32731 - protein, 29 aa, Artificial Sequence
  Description of Artificial Sequence: Synthetic peptide
SEEEIRATNPVATELYGSVISTNEQRGNF

SEQ ID NO: 32732 - protein, 29 aa, Artificial Sequence
  Description of Artificial Sequence: Synthetic peptide
DEECIRCTNPVATETYGGVSSANLQRGNR

SEQ ID NO: 32733 - protein, 28 aa, Artificial Sequence
  Description of Artificial Sequence: Synthetic peptide
MEEEISTVNPVATEQYGSASTNLQREER

SEQ ID NO: 32734 - protein, 29 aa, Artificial Sequence
  Description of Artificial Sequence: Synthetic peptide
DDEEIRTTNPVATELYGSVSTNLQGLINI

SEQ ID NO: 32735 - protein, 28 aa, Artificial Sequence
  Description of Artificial Sequence: Synthetic peptide
DESEIACTNPVATEQYGSVSENLQSGNE

SEQ ID NO: 32736 - protein, 30 aa, Artificial Sequence
  Description of Artificial Sequence: Synthetic polypeptide
DEEEIRTTNPVATEQWYGSVSEDDQRDENR

SEQ ID NO: 32737 - protein, 28 aa, Artificial Sequence
  Description of Artificial Sequence: Synthetic peptide
DEEEIKTTNPVATECYGSEWTGLERGNR

SEQ ID NO: 32738 - protein, 28 aa, Artificial Sequence
  Description of Artificial Sequence: Synthetic peptide
DEEEIRTTNPDATEQYGSVDTYVQLGNI

SEQ ID NO: 32739 - protein, 28 aa, Artificial Sequence
  Description of Artificial Sequence: Synthetic peptide
DEEEIRTTNPVSTEIWGIVSTELQIGNR

SEQ ID NO: 32740 - protein, 28 aa, Artificial Sequence
  Description of Artificial Sequence: Synthetic peptide
DENEIRTTNPVATEQYGDASENLQNGNM

SEQ ID NO: 32741 - protein, 28 aa, Artificial Sequence
  Description of Artificial Sequence: Synthetic peptide
DEQEIRCTNPVASEVYGCVSMNLQRGNR

SEQ ID NO: 32742 - protein, 33 aa, Artificial Sequence
  Description of Artificial Sequence: Synthetic polypeptide
DEEEIRTTNPVATEQYGSVISTMNLPQLRGDNF

SEQ ID NO: 32743 - protein, 28 aa, Artificial Sequence
  Description of Artificial Sequence: Synthetic peptide
GEEEICTTNPVATEVYGSVSANLQRGTY

SEQ ID NO: 32744 - protein, 28 aa, Artificial Sequence
  Description of Artificial Sequence: Synthetic peptide
DEEEIRTTNPVATEQYGFVSDNVMRPTR

SEQ ID NO: 32745 - protein, 28 aa, Artificial Sequence
  Description of Artificial Sequence: Synthetic peptide
DEEEIRTTNPVATEQYGSWSDNDDTDNR

SEQ ID NO: 32746 - protein, 29 aa, Artificial Sequence
  Description of Artificial Sequence: Synthetic peptide
DDEEIRTTNPVATEWYGAVSTILQSRGQR

SEQ ID NO: 32747 - protein, 29 aa, Artificial Sequence
  Description of Artificial Sequence: Synthetic peptide
DEEEVRSTNPCATEVYGCVSTNLQRNGNR

SEQ ID NO: 32748 - protein, 31 aa, Artificial Sequence
  Description of Artificial Sequence: Synthetic polypeptide
DEEEIRTTNPVATEQYWSVESTPNLDEPGNR

SEQ ID NO: 32749 - protein, 30 aa, Artificial Sequence
  Description of Artificial Sequence: Synthetic polypeptide
DENEIRTTNPVATEQYGHSYSENLQRGNNA

SEQ ID NO: 32750 - protein, 28 aa, Artificial Sequence
  Description of Artificial Sequence: Synthetic peptide
DDSEIRATNPVATEQYGVVANNLQRGNR

SEQ ID NO: 32751 - protein, 28 aa, Artificial Sequence
  Description of Artificial Sequence: Synthetic peptide
DENEIATTNPVATEQYGSVPTNEQHENR

SEQ ID NO: 32752 - protein, 28 aa, Artificial Sequence
  Description of Artificial Sequence: Synthetic peptide
DEQEISAVNPVATECYGSVSTNLQRGNM

SEQ ID NO: 32753 - protein, 28 aa, Artificial Sequence
  Description of Artificial Sequence: Synthetic peptide
DEEEIATTNPVATEQYGSAPTCLQRGEL

SEQ ID NO: 32754 - protein, 30 aa, Artificial Sequence
  Description of Artificial Sequence: Synthetic polypeptide
REEEIRTTNPVATEQYGSVSDMNLQDAGNH

SEQ ID NO: 32755 - protein, 29 aa, Artificial Sequence
  Description of Artificial Sequence: Synthetic peptide
NEEEITTTNPVATEVYGWVSSNLQLRGNR

SEQ ID NO: 32756 - protein, 28 aa, Artificial Sequence
  Description of Artificial Sequence: Synthetic peptide
YEEEIRTTNPVATEQYGSVEHNLEEGNQ

SEQ ID NO: 32757 - protein, 28 aa, Artificial Sequence
  Description of Artificial Sequence: Synthetic peptide
DEEEICPTNPVATEPYGSVSTLLQRFNA

SEQ ID NO: 32758 - protein, 28 aa, Artificial Sequence
  Description of Artificial Sequence: Synthetic peptide
DEEASRTTNPLATGQYGNVSTNLQDGNR

SEQ ID NO: 32759 - protein, 28 aa, Artificial Sequence
  Description of Artificial Sequence: Synthetic peptide
KEEEIRTTNPVATEVYGVVSTNLENGER

SEQ ID NO: 32760 - protein, 28 aa, Artificial Sequence
  Description of Artificial Sequence: Synthetic peptide
DEEEIRTVNPVATECYGVVSTELQRGEM

SEQ ID NO: 32761 - protein, 33 aa, Artificial Sequence
  Description of Artificial Sequence: Synthetic polypeptide
DEEEIRTTNPVATEQYGSVDITPNLQYRGENER

SEQ ID NO: 32762 - protein, 28 aa, Artificial Sequence
  Description of Artificial Sequence: Synthetic peptide
DEVEIRTTNPTATEQFGSVSTNLQNGTA

SEQ ID NO: 32763 - protein, 28 aa, Artificial Sequence
  Description of Artificial Sequence: Synthetic peptide
DEEEVRTVNPDATEQYGSVSTNLQGGGI

SEQ ID NO: 32764 - protein, 31 aa, Artificial Sequence
  Description of Artificial Sequence: Synthetic polypeptide
DEEEIRTTNPVATEQYGSVDSDTNLEVEGNG

SEQ ID NO: 32765 - protein, 31 aa, Artificial Sequence
  Description of Artificial Sequence: Synthetic polypeptide
DEEEIRTTNPVATEQYGSVSTDLEERNGNDS

SEQ ID NO: 32766 - protein, 28 aa, Artificial Sequence
  Description of Artificial Sequence: Synthetic peptide
KEEEIRTTNPVATEQYGDASTDLQHENR

SEQ ID NO: 32767 - protein, 33 aa, Artificial Sequence
  Description of Artificial Sequence: Synthetic polypeptide
DEEEIRTTNPVATEQYGSVSETNGLQLDGENER

SEQ ID NO: 32768 - protein, 28 aa, Artificial Sequence
  Description of Artificial Sequence: Synthetic peptide
DEVEIATTNPVATEQYGSVSENEQQGTR

SEQ ID NO: 32769 - protein, 28 aa, Artificial Sequence
  Description of Artificial Sequence: Synthetic peptide
DETEIRTTNPVATEGYGCVSEFLQRGMR

SEQ ID NO: 32770 - protein, 28 aa, Artificial Sequence
  Description of Artificial Sequence: Synthetic peptide
DEEEICTTNPVATEQYGSVSEEMQMGNN

SEQ ID NO: 32771 - protein, 28 aa, Artificial Sequence
  Description of Artificial Sequence: Synthetic peptide
DEEEITTTNPVGTEQYGSVSENLAVGNH

SEQ ID NO: 32772 - protein, 28 aa, Artificial Sequence
  Description of Artificial Sequence: Synthetic peptide
DEEEIYTTNPIATEQYGSVSNAVQHGNR

SEQ ID NO: 32773 - protein, 30 aa, Artificial Sequence
  Description of Artificial Sequence: Synthetic polypeptide
DENEIRTTNPVATEQYGSASTNLEIRENDR

SEQ ID NO: 32774 - protein, 28 aa, Artificial Sequence
  Description of Artificial Sequence: Synthetic peptide
DEQEIRTTNPVATETYGGVSENLQIGNH

SEQ ID NO: 32775 - protein, 31 aa, Artificial Sequence
  Description of Artificial Sequence: Synthetic polypeptide
DEEEIRTTNPVATEQYGSVSATNLQINGTHG

SEQ ID NO: 32776 - protein, 28 aa, Artificial Sequence
  Description of Artificial Sequence: Synthetic peptide
SENEISTTNPVATEQYGSVSENEQRGNS

SEQ ID NO: 32777 - protein, 29 aa, Artificial Sequence
  Description of Artificial Sequence: Synthetic peptide
DEYEIRTTNPVAYEQYGDVSTELQDVGNR

SEQ ID NO: 32778 - protein, 28 aa, Artificial Sequence
  Description of Artificial Sequence: Synthetic peptide
DEEEIRCTNPIAYEMYGAVSSNLQRGNR

SEQ ID NO: 32779 - protein, 30 aa, Artificial Sequence
  Description of Artificial Sequence: Synthetic polypeptide
DEEEIATTNPVATEIYGSASTCNLQREGNL

SEQ ID NO: 32780 - protein, 29 aa, Artificial Sequence
  Description of Artificial Sequence: Synthetic peptide
DEVEIAQTNPVATEQYGEVSTNLQSRGGR

SEQ ID NO: 32781 - protein, 29 aa, Artificial Sequence
  Description of Artificial Sequence: Synthetic peptide
DEEEIRTTNPAATETYGSVSTNWQFGETR

SEQ ID NO: 32782 - protein, 28 aa, Artificial Sequence
  Description of Artificial Sequence: Synthetic peptide
AEEEIRATNPVATEQYGEVGTVLQRGMR

SEQ ID NO: 32783 - protein, 29 aa, Artificial Sequence
  Description of Artificial Sequence: Synthetic peptide
DEEEITTTNPVATECYGSVSTNLQHKGET

SEQ ID NO: 32784 - protein, 28 aa, Artificial Sequence
  Description of Artificial Sequence: Synthetic peptide
DEEEIVTTNPVATEQYGEVSTDPQGGDR

SEQ ID NO: 32785 - protein, 31 aa, Artificial Sequence
  Description of Artificial Sequence: Synthetic polypeptide
DEEEIRTTNPDAWEQYGSVSCTNGLQRGDLR

SEQ ID NO: 32786 - protein, 28 aa, Artificial Sequence
  Description of Artificial Sequence: Synthetic peptide
QECEIKTTNPVATEVYGIVSSNLQRGNR

SEQ ID NO: 32787 - protein, 28 aa, Artificial Sequence
  Description of Artificial Sequence: Synthetic peptide
DENEIRTTNPVATEQYGSVSNNIGTGNA

SEQ ID NO: 32788 - protein, 30 aa, Artificial Sequence
  Description of Artificial Sequence: Synthetic polypeptide
DEDEIRTTNPVSTEQYGEVSATNLQRGPNK

SEQ ID NO: 32789 - protein, 32 aa, Artificial Sequence
  Description of Artificial Sequence: Synthetic polypeptide
DEEEIRTTNPVATEIYGSMVNSTNLQREGENP

SEQ ID NO: 32790 - protein, 28 aa, Artificial Sequence
  Description of Artificial Sequence: Synthetic peptide
DEEEIRCTNPVSTECYGCVAMNLQRGNR

SEQ ID NO: 32791 - protein, 28 aa, Artificial Sequence
  Description of Artificial Sequence: Synthetic peptide
SEDEIRTTNPVATELYGSVSDNLQGGNV

SEQ ID NO: 32792 - protein, 28 aa, Artificial Sequence
  Description of Artificial Sequence: Synthetic peptide
DECPISTTNPVATYGYGSPSTNLQRGNR

SEQ ID NO: 32793 - protein, 29 aa, Artificial Sequence
  Description of Artificial Sequence: Synthetic peptide
DEEEIRTTNPVATEQYGEASTVLQHAGGR

SEQ ID NO: 32794 - protein, 28 aa, Artificial Sequence
  Description of Artificial Sequence: Synthetic peptide
DEEEIRTTNPVSTMQYGSVAMNWERGNR

SEQ ID NO: 32795 - protein, 28 aa, Artificial Sequence
  Description of Artificial Sequence: Synthetic peptide
DEDEIRTTNPVSTEQFGDVSTNLQFGNF

SEQ ID NO: 32796 - protein, 28 aa, Artificial Sequence
  Description of Artificial Sequence: Synthetic peptide
DEQEIRTTNPVATEQYGSSSESLQRGTA

SEQ ID NO: 32797 - protein, 31 aa, Artificial Sequence
  Description of Artificial Sequence: Synthetic polypeptide
DEEEIRTTNPVATEQYGSASTAEQQRAGVNR

SEQ ID NO: 32798 - protein, 28 aa, Artificial Sequence
  Description of Artificial Sequence: Synthetic peptide
HEEEIRTTNPVATEQYGSVATNWAQENR

SEQ ID NO: 32799 - protein, 31 aa, Artificial Sequence
  Description of Artificial Sequence: Synthetic polypeptide
DESEIRTTNPVATEQYGSVSTNLQMTELNDR

SEQ ID NO: 32800 - protein, 28 aa, Artificial Sequence
  Description of Artificial Sequence: Synthetic peptide
DEQEIRSTNPVASEQYGAVAMNLQRGNR

SEQ ID NO: 32801 - protein, 28 aa, Artificial Sequence
  Description of Artificial Sequence: Synthetic peptide
DEQEIRTVNPVATEVYGVVAMNLQRGNR

SEQ ID NO: 32802 - protein, 28 aa, Artificial Sequence
  Description of Artificial Sequence: Synthetic peptide
DENEIRQTNPVATEQYGSVSTDDQHGNL

SEQ ID NO: 32803 - protein, 28 aa, Artificial Sequence
  Description of Artificial Sequence: Synthetic peptide
DEQEIATTNPVATEVYGSVGMNLQVGNR

SEQ ID NO: 32804 - protein, 28 aa, Artificial Sequence
  Description of Artificial Sequence: Synthetic peptide
DEQEIATVNPVATEQYGSVSTNLQNGEM

SEQ ID NO: 32805 - protein, 28 aa, Artificial Sequence
  Description of Artificial Sequence: Synthetic peptide
DEEEIRCTNPVATENYGSVSNPLQDGNS

SEQ ID NO: 32806 - protein, 33 aa, Artificial Sequence
  Description of Artificial Sequence: Synthetic polypeptide
DEEEIRTTNPVATEQYGSVASTVELDQFRGNER

SEQ ID NO: 32807 - protein, 29 aa, Artificial Sequence
  Description of Artificial Sequence: Synthetic peptide
DEVEIRTTNPVATEPYGSVSTNLLMGNDG

SEQ ID NO: 32808 - protein, 28 aa, Artificial Sequence
  Description of Artificial Sequence: Synthetic peptide
DEEEIIATNPVCTEMYGSVSTNLQQGNH

SEQ ID NO: 32809 - protein, 28 aa, Artificial Sequence
  Description of Artificial Sequence: Synthetic peptide
DETEVRTTNPVATEQYGSVAENLQRFNS

SEQ ID NO: 32810 - protein, 28 aa, Artificial Sequence
  Description of Artificial Sequence: Synthetic peptide
DEEEIRTTNPIAYEIYGAVGTNLERGNR

SEQ ID NO: 32811 - protein, 29 aa, Artificial Sequence
  Description of Artificial Sequence: Synthetic peptide
DEEEIRTTNPVATELWGSVSTNDMNRGNW

SEQ ID NO: 32812 - protein, 30 aa, Artificial Sequence
  Description of Artificial Sequence: Synthetic polypeptide
MEEEIRTTNPVATEQYGSVSTDLQELGNDQ

SEQ ID NO: 32813 - protein, 28 aa, Artificial Sequence
  Description of Artificial Sequence: Synthetic peptide
SEEEIATTNPTATEQYGSVSENEQLGNR

SEQ ID NO: 32814 - protein, 28 aa, Artificial Sequence
  Description of Artificial Sequence: Synthetic peptide
DETEIRSTNPVATEQYGSVSAGLNRGND

SEQ ID NO: 32815 - protein, 30 aa, Artificial Sequence
  Description of Artificial Sequence: Synthetic polypeptide
DEHEIRTTNPVATEQYGDVSENLQCQGNDR

SEQ ID NO: 32816 - protein, 28 aa, Artificial Sequence
  Description of Artificial Sequence: Synthetic peptide
DEEEICCTNPVATECFGEVSTNLQRGNQ

SEQ ID NO: 32817 - protein, 28 aa, Artificial Sequence
  Description of Artificial Sequence: Synthetic peptide
DEEEIRTTNPVCTEQYGSVSAYPEQGNR

SEQ ID NO: 32818 - protein, 28 aa, Artificial Sequence
  Description of Artificial Sequence: Synthetic peptide
DEEEIATTNPVLWEQYGSVSTNPQRENF

SEQ ID NO: 32819 - protein, 29 aa, Artificial Sequence
  Description of Artificial Sequence: Synthetic peptide
DEEEIRTTNPVATEQYGDVSENLCCHGNA

SEQ ID NO: 32820 - protein, 32 aa, Artificial Sequence
  Description of Artificial Sequence: Synthetic polypeptide
DEEEIRTTNPVATEQYGIVSKTANLAWRGNER

SEQ ID NO: 32821 - protein, 28 aa, Artificial Sequence
  Description of Artificial Sequence: Synthetic peptide
DEEEIRTTNPVATEQYGSVDTEEEWGNQ

SEQ ID NO: 32822 - protein, 30 aa, Artificial Sequence
  Description of Artificial Sequence: Synthetic polypeptide
DEEEIAQTNPVATEQYGSVSTTNQVQRGNV

SEQ ID NO: 32823 - protein, 28 aa, Artificial Sequence
  Description of Artificial Sequence: Synthetic peptide
DEEEIMATNPVATEMYGSVSTNLQNGPS

SEQ ID NO: 32824 - protein, 29 aa, Artificial Sequence
  Description of Artificial Sequence: Synthetic peptide
DEEEIRTTNPVATEQYGDVSENLMNQGNA

SEQ ID NO: 32825 - protein, 28 aa, Artificial Sequence
  Description of Artificial Sequence: Synthetic peptide
DEEEIRTTNPVATECYGSVSTDLEYGEF

SEQ ID NO: 32826 - protein, 28 aa, Artificial Sequence
  Description of Artificial Sequence: Synthetic peptide
DEEEIRATNPVATEQFGSVEAGLYRGNR

SEQ ID NO: 32827 - protein, 28 aa, Artificial Sequence
  Description of Artificial Sequence: Synthetic peptide
DEEEISATNPVATEQYGSVSTDDQRGDE

SEQ ID NO: 32828 - protein, 29 aa, Artificial Sequence
  Description of Artificial Sequence: Synthetic peptide
DENEIRTTNPVATEQWGSVSTNLMRELNA

SEQ ID NO: 32829 - protein, 30 aa, Artificial Sequence
  Description of Artificial Sequence: Synthetic polypeptide
DEEEIRTTNPVATCQWGSVSENLQRSGLNV

SEQ ID NO: 32830 - protein, 28 aa, Artificial Sequence
  Description of Artificial Sequence: Synthetic peptide
SEEEIRTTNPVSTEVYGSVSTNLMRGTY

SEQ ID NO: 32831 - protein, 28 aa, Artificial Sequence
  Description of Artificial Sequence: Synthetic peptide
CENEIRTTNPTATEIYGGVSTNLQRGND

SEQ ID NO: 32832 - protein, 28 aa, Artificial Sequence
  Description of Artificial Sequence: Synthetic peptide
SEEEIRTTNPVATEQYGSVSENPQQGTQ

SEQ ID NO: 32833 - protein, 32 aa, Artificial Sequence
  Description of Artificial Sequence: Synthetic polypeptide
DEEEIRTTNPVATEQYGSVSTNLVEDHEGNDR

SEQ ID NO: 32834 - protein, 28 aa, Artificial Sequence
  Description of Artificial Sequence: Synthetic peptide
DDNETRTTNPVAYETYGCVSTNLQRGNR

SEQ ID NO: 32835 - protein, 29 aa, Artificial Sequence
  Description of Artificial Sequence: Synthetic peptide
DEQEIRTTNPVATEQWGSVSENLMMQGNR

SEQ ID NO: 32836 - protein, 28 aa, Artificial Sequence
  Description of Artificial Sequence: Synthetic peptide
SEEEIMTTNPVATEQYGSVSANGQNGNV

SEQ ID NO: 32837 - protein, 28 aa, Artificial Sequence
  Description of Artificial Sequence: Synthetic peptide
DEQEIRTTNPVATEQWGSVSTNEMIGNW

SEQ ID NO: 32838 - protein, 28 aa, Artificial Sequence
  Description of Artificial Sequence: Synthetic peptide
DEEEIRTVNPVATEHYGQVSTNPQNGNV

SEQ ID NO: 32839 - protein, 28 aa, Artificial Sequence
  Description of Artificial Sequence: Synthetic peptide
DEEEIYATNPVATEQYGAVSTNPQRGTE

SEQ ID NO: 32840 - protein, 29 aa, Artificial Sequence
  Description of Artificial Sequence: Synthetic peptide
DEEEIATTNPVATEQYWGSVSENLMHFNR

SEQ ID NO: 32841 - protein, 28 aa, Artificial Sequence
  Description of Artificial Sequence: Synthetic peptide
RESEIRTTNPVATEQYGSVSTEIEMGNR

SEQ ID NO: 32842 - protein, 28 aa, Artificial Sequence
  Description of Artificial Sequence: Synthetic peptide
HEEEIRCTNPIATEVFGSVSMNLQRGNR

SEQ ID NO: 32843 - protein, 29 aa, Artificial Sequence
  Description of Artificial Sequence: Synthetic peptide
DESEIMTTNPVATEQYGSISENLQRGQNN

SEQ ID NO: 32844 - protein, 31 aa, Artificial Sequence
  Description of Artificial Sequence: Synthetic polypeptide
DEEEIRTTNPVATEQYWSVSTPNPLQRGDEP

SEQ ID NO: 32845 - protein, 28 aa, Artificial Sequence
  Description of Artificial Sequence: Synthetic peptide
GENEIVTTNPVATEIYGSVSTNLQPGNP

SEQ ID NO: 32846 - protein, 28 aa, Artificial Sequence
  Description of Artificial Sequence: Synthetic peptide
DEEEIRTTNPAATEMFGSVSTNPQRGTL

SEQ ID NO: 32847 - protein, 28 aa, Artificial Sequence
  Description of Artificial Sequence: Synthetic peptide
DEELIRTTNPVATELYGSVWTNLEEGNV

SEQ ID NO: 32848 - protein, 28 aa, Artificial Sequence
  Description of Artificial Sequence: Synthetic peptide
DEEEIRTTNPVATEQYGDVSTALWMGDG

SEQ ID NO: 32849 - protein, 33 aa, Artificial Sequence
  Description of Artificial Sequence: Synthetic polypeptide
DEEEIRTTNPEATEQYGSVDSTNLVQRDGDNER

SEQ ID NO: 32850 - protein, 28 aa, Artificial Sequence
  Description of Artificial Sequence: Synthetic peptide
DEEEIATTNPVATEQYGDASTNLMRMNQ

SEQ ID NO: 32851 - protein, 28 aa, Artificial Sequence
  Description of Artificial Sequence: Synthetic peptide
DEEEIRTTNPVATEQYGSMATELQMGDA

SEQ ID NO: 32852 - protein, 32 aa, Artificial Sequence
  Description of Artificial Sequence: Synthetic polypeptide
DEEEIRTTNPFATEQYGSVSCNLNQQRAGSNR

SEQ ID NO: 32853 - protein, 28 aa, Artificial Sequence
  Description of Artificial Sequence: Synthetic peptide
DEVEIRTTNPVATEQYGSVSEDLIHGNE

SEQ ID NO: 32854 - protein, 31 aa, Artificial Sequence
  Description of Artificial Sequence: Synthetic polypeptide
DENEIRTTNPVATEQYGSVSATDLQREGEDR

SEQ ID NO: 32855 - protein, 29 aa, Artificial Sequence
  Description of Artificial Sequence: Synthetic peptide
DECEIRQTNPVATELYGDVSTNLQQRGQR

SEQ ID NO: 32856 - protein, 29 aa, Artificial Sequence
  Description of Artificial Sequence: Synthetic peptide
DELEIRTTNPVATETYGSVSENLQDRGTG

SEQ ID NO: 32857 - protein, 29 aa, Artificial Sequence
  Description of Artificial Sequence: Synthetic peptide
DEEEIRTTNPVATEQYGDVSENLQCTGEI

SEQ ID NO: 32858 - protein, 28 aa, Artificial Sequence
  Description of Artificial Sequence: Synthetic peptide
DEEEIRPTNPVATEVYGTVSENLQGGNQ

SEQ ID NO: 32859 - protein, 28 aa, Artificial Sequence
  Description of Artificial Sequence: Synthetic peptide
DEEEIRTTNPEATEQYGSVSEGEQYGNW

SEQ ID NO: 32860 - protein, 28 aa, Artificial Sequence
  Description of Artificial Sequence: Synthetic peptide
SEEEIRTTNPEATETYGSVSTNLQGGPI

SEQ ID NO: 32861 - protein, 31 aa, Artificial Sequence
  Description of Artificial Sequence: Synthetic polypeptide
DEEEIMTTNPVATEQYGSVSEMNGLQREGGR

SEQ ID NO: 32862 - protein, 28 aa, Artificial Sequence
  Description of Artificial Sequence: Synthetic peptide
DEEEIAATNPTATEMYGSVSENEQRGNR

SEQ ID NO: 32863 - protein, 30 aa, Artificial Sequence
  Description of Artificial Sequence: Synthetic polypeptide
MEEEIRTTNPVATEQYGSVSTDLQENEGNS

SEQ ID NO: 32864 - protein, 28 aa, Artificial Sequence
  Description of Artificial Sequence: Synthetic peptide
SEEEIRTTNPVATEQYGSVSENPQLGTN

SEQ ID NO: 32865 - protein, 28 aa, Artificial Sequence
  Description of Artificial Sequence: Synthetic peptide
SEEEIRCTNPVATECWGSYSTNLQGGNR

SEQ ID NO: 32866 - protein, 30 aa, Artificial Sequence
  Description of Artificial Sequence: Synthetic polypeptide
DEEEIRTTNPVAHEQYGWVTSTNLHERGNF

SEQ ID NO: 32867 - protein, 30 aa, Artificial Sequence
  Description of Artificial Sequence: Synthetic polypeptide
DEQEIRTTNPEATEQYGSVSTDLVQIEGNR

SEQ ID NO: 32868 - protein, 30 aa, Artificial Sequence
  Description of Artificial Sequence: Synthetic polypeptide
DEGEIRTTNPVATEQFGSVSTNLQDRDGTA

SEQ ID NO: 32869 - protein, 28 aa, Artificial Sequence
  Description of Artificial Sequence: Synthetic peptide
DEAEIWCTNPVATEIYGSVSENLQRENR

SEQ ID NO: 32870 - protein, 28 aa, Artificial Sequence
  Description of Artificial Sequence: Synthetic peptide
DEMEIRTTNPVATEGYGIVSDNLQHGMR

SEQ ID NO: 32871 - protein, 28 aa, Artificial Sequence
  Description of Artificial Sequence: Synthetic peptide
DEVEIATTNPTATEQYGSVSTNEQVGNL

SEQ ID NO: 32872 - protein, 28 aa, Artificial Sequence
  Description of Artificial Sequence: Synthetic peptide
DEQEIRTTNPVATEHYGTVSENLQLGNQ

SEQ ID NO: 32873 - protein, 28 aa, Artificial Sequence
  Description of Artificial Sequence: Synthetic peptide
QEEEIRTTNPVSTEQYGSVSTLVQHGNI

SEQ ID NO: 32874 - protein, 28 aa, Artificial Sequence
  Description of Artificial Sequence: Synthetic peptide
HETEICSTNPVATEQYGSVATNLQRGNI

SEQ ID NO: 32875 - protein, 28 aa, Artificial Sequence
  Description of Artificial Sequence: Synthetic peptide
YESEINTTNPVATEPYGSVSENLQRGTR

SEQ ID NO: 32876 - protein, 31 aa, Artificial Sequence
  Description of Artificial Sequence: Synthetic polypeptide
DEEEIRTTNPDAYEQYGSVSTTNPLQVEGNR

SEQ ID NO: 32877 - protein, 28 aa, Artificial Sequence
  Description of Artificial Sequence: Synthetic peptide
DEEEIRTTNPVATEQYGSVSTGDQGEEM

SEQ ID NO: 32878 - protein, 28 aa, Artificial Sequence
  Description of Artificial Sequence: Synthetic peptide
DEEEIAATNPVATEQYGSASTVLQHGGR

SEQ ID NO: 32879 - protein, 31 aa, Artificial Sequence
  Description of Artificial Sequence: Synthetic polypeptide
DEEEIRTTNPVATEQYGSVSTDPLPDRGNPN

SEQ ID NO: 32880 - protein, 31 aa, Artificial Sequence
  Description of Artificial Sequence: Synthetic polypeptide
DEEEIRTTNPVATEQYGSVSTNLQDHEGEDF

SEQ ID NO: 32881 - protein, 31 aa, Artificial Sequence
  Description of Artificial Sequence: Synthetic polypeptide
DEQEIRTTNPVATEQYGSVDETEDLQREGNR

SEQ ID NO: 32882 - protein, 28 aa, Artificial Sequence
  Description of Artificial Sequence: Synthetic peptide
DEVEICTTNPVSTEQYGCVSTNDQLGNR

SEQ ID NO: 32883 - protein, 28 aa, Artificial Sequence
  Description of Artificial Sequence: Synthetic peptide
NEEEIACTNPVATEVYGSASSNLQRGNR

SEQ ID NO: 32884 - protein, 29 aa, Artificial Sequence
  Description of Artificial Sequence: Synthetic peptide
QENEIRTTNPVATECYGVVSTNLQMRGND

SEQ ID NO: 32885 - protein, 28 aa, Artificial Sequence
  Description of Artificial Sequence: Synthetic peptide
DEEEIRTTNPVATEQYWSVSDEPLRGNN

SEQ ID NO: 32886 - protein, 28 aa, Artificial Sequence
  Description of Artificial Sequence: Synthetic peptide
DEAEIRATNPVATELYGSCSTVLQRGGR

SEQ ID NO: 32887 - protein, 28 aa, Artificial Sequence
  Description of Artificial Sequence: Synthetic peptide
DENEIKTTNPVATEQYGSVSTNEQLGTF

SEQ ID NO: 32888 - protein, 28 aa, Artificial Sequence
  Description of Artificial Sequence: Synthetic peptide
DEEELRTTNPVATEQWGSVGTDWQPGNR

SEQ ID NO: 32889 - protein, 28 aa, Artificial Sequence
  Description of Artificial Sequence: Synthetic peptide
DENEIATTNPTCTEQYGSVCTALQRGNR

SEQ ID NO: 32890 - protein, 28 aa, Artificial Sequence
  Description of Artificial Sequence: Synthetic peptide
DEQEIATTNPVCTEQYGSVSTNDQHGNA

SEQ ID NO: 32891 - protein, 29 aa, Artificial Sequence
  Description of Artificial Sequence: Synthetic peptide
HEDEIRTTNPVATDQYGSVSAENLQRGGR

SEQ ID NO: 32892 - protein, 28 aa, Artificial Sequence
  Description of Artificial Sequence: Synthetic peptide
DEQEIVTTNPVSTEQYGSVSNNLQLGNQ

SEQ ID NO: 32893 - protein, 33 aa, Artificial Sequence
  Description of Artificial Sequence: Synthetic polypeptide
DEEEIRTTNPVATEQYGESVSTQNLQFREINDR

SEQ ID NO: 32894 - protein, 28 aa, Artificial Sequence
  Description of Artificial Sequence: Synthetic peptide
QEEEIRTTNPVATEQYGSASEVLQHGGR

SEQ ID NO: 32895 - protein, 30 aa, Artificial Sequence
  Description of Artificial Sequence: Synthetic polypeptide
DEEEIETTNPDATEQYGSVSTNDDDRGLNR

SEQ ID NO: 32896 - protein, 28 aa, Artificial Sequence
  Description of Artificial Sequence: Synthetic peptide
DEEEIRTTNPVATELWGSVSTNEMQGNL

SEQ ID NO: 32897 - protein, 28 aa, Artificial Sequence
  Description of Artificial Sequence: Synthetic peptide
DEGEIVTTNPVATEQYGSVSDVLQHGMR

SEQ ID NO: 32898 - protein, 28 aa, Artificial Sequence
  Description of Artificial Sequence: Synthetic peptide
DEEEIRCTNPVATEHYGDVGENLQRGNF

SEQ ID NO: 32899 - protein, 28 aa, Artificial Sequence
  Description of Artificial Sequence: Synthetic peptide
REEEIRATNPVATETYGIVSTNLMRGNQ

SEQ ID NO: 32900 - protein, 28 aa, Artificial Sequence
  Description of Artificial Sequence: Synthetic peptide
DEGEIRTTNPVATEQFGYVSTALQGGNH

SEQ ID NO: 32901 - protein, 30 aa, Artificial Sequence
  Description of Artificial Sequence: Synthetic polypeptide
DEEEIVTTNPVATEQYGGVSATNPQTRGNS

SEQ ID NO: 32902 - protein, 28 aa, Artificial Sequence
  Description of Artificial Sequence: Synthetic peptide
DEEEIRTVNPVCTEVYGIVSTNLQRGPQ

SEQ ID NO: 32903 - protein, 28 aa, Artificial Sequence
  Description of Artificial Sequence: Synthetic peptide
DEEEIRATNPVATEQYGVVSTNLEFGEA

SEQ ID NO: 32904 - protein, 28 aa, Artificial Sequence
  Description of Artificial Sequence: Synthetic peptide
DENEIATTNPVATECYGSVSTPLQIGNL

SEQ ID NO: 32905 - protein, 30 aa, Artificial Sequence
  Description of Artificial Sequence: Synthetic polypeptide
DETEIRTTNPVATEQYGEVITNLQRHGNYT

SEQ ID NO: 32906 - protein, 32 aa, Artificial Sequence
  Description of Artificial Sequence: Synthetic polypeptide
DEEEIRTTNPVAYEQYWSMVSTPNLQREGNDR

SEQ ID NO: 32907 - protein, 30 aa, Artificial Sequence
  Description of Artificial Sequence: Synthetic polypeptide
DEEEIRATNPVATEQYGSVSEANLQRGDTV

SEQ ID NO: 32908 - protein, 28 aa, Artificial Sequence
  Description of Artificial Sequence: Synthetic peptide
DEEEIRTTNPVATEQYGIVPTEQQYGNL

SEQ ID NO: 32909 - protein, 31 aa, Artificial Sequence
  Description of Artificial Sequence: Synthetic polypeptide
DEYEIRTTNPVATEQYGSVSTNLGRNGVNEY

SEQ ID NO: 32910 - protein, 31 aa, Artificial Sequence
  Description of Artificial Sequence: Synthetic polypeptide
DEEEIRATNPTATEQYGEVSTGNLQREGENR

SEQ ID NO: 32911 - protein, 28 aa, Artificial Sequence
  Description of Artificial Sequence: Synthetic peptide
DEEEITTTNPEATEQYGSVSTDPQFGTR

SEQ ID NO: 32912 - protein, 28 aa, Artificial Sequence
  Description of Artificial Sequence: Synthetic peptide
QEEEIRATNPVSTEQYGSCSTNIQRGQR

SEQ ID NO: 32913 - protein, 28 aa, Artificial Sequence
  Description of Artificial Sequence: Synthetic peptide
DENEIATTNPVATEQYGSVSTDLERGEI

SEQ ID NO: 32914 - protein, 28 aa, Artificial Sequence
  Description of Artificial Sequence: Synthetic peptide
DENEIRTTNPVATEQYGDVSENLMRENA

SEQ ID NO: 32915 - protein, 28 aa, Artificial Sequence
  Description of Artificial Sequence: Synthetic peptide
DENEIRCTNPVATEQWGSVSENLQLGNA

SEQ ID NO: 32916 - protein, 30 aa, Artificial Sequence
  Description of Artificial Sequence: Synthetic polypeptide
DEEEIRTTNPFATEQYGSVSTCNEQMMGDR

SEQ ID NO: 32917 - protein, 33 aa, Artificial Sequence
  Description of Artificial Sequence: Synthetic polypeptide
DEEEIRTTNPVATEQYGSVNSTGNLQYLGTNDR

SEQ ID NO: 32918 - protein, 29 aa, Artificial Sequence
  Description of Artificial Sequence: Synthetic peptide
DENEIRTTNPVATEQYGSASTDLQSEGNM

SEQ ID NO: 32919 - protein, 28 aa, Artificial Sequence
  Description of Artificial Sequence: Synthetic peptide
DEEEIRTTNPVATEQYGSVETPDEVGNY

SEQ ID NO: 32920 - protein, 28 aa, Artificial Sequence
  Description of Artificial Sequence: Synthetic peptide
DESEIACVNPVSTEQYGCVSTNLQRGNR

SEQ ID NO: 32921 - protein, 28 aa, Artificial Sequence
  Description of Artificial Sequence: Synthetic peptide
CEAEIWTTNPVATEQYGDVCTNLQRGTR

SEQ ID NO: 32922 - protein, 28 aa, Artificial Sequence
  Description of Artificial Sequence: Synthetic peptide
DECEIRCTNPVATEIYGSASTELQRLNR

SEQ ID NO: 32923 - protein, 28 aa, Artificial Sequence
  Description of Artificial Sequence: Synthetic peptide
DEEEIAGTNPVATEQYGNVSDNLQHGGR

SEQ ID NO: 32924 - protein, 30 aa, Artificial Sequence
  Description of Artificial Sequence: Synthetic polypeptide
DEEEIRTTNPVATEQYGSVSEALQQYGANP

SEQ ID NO: 32925 - protein, 28 aa, Artificial Sequence
  Description of Artificial Sequence: Synthetic peptide
SEEEIRTTNPTATEQYGSVSTNWQFGTI

SEQ ID NO: 32926 - protein, 30 aa, Artificial Sequence
  Description of Artificial Sequence: Synthetic polypeptide
DEEEIRTTNPVATECYGSVSTELQDRGDDY

SEQ ID NO: 32927 - protein, 28 aa, Artificial Sequence
  Description of Artificial Sequence: Synthetic peptide
DENEIRTTNPVATEMYGTMSTNLQRGDL

SEQ ID NO: 32928 - protein, 28 aa, Artificial Sequence
  Description of Artificial Sequence: Synthetic peptide
DEEEIATTNIVATECYGSVSTELQIGND

SEQ ID NO: 32929 - protein, 28 aa, Artificial Sequence
  Description of Artificial Sequence: Synthetic peptide
DESEIRQTNPVATEGYGWVSTLLQRGTR

SEQ ID NO: 32930 - protein, 32 aa, Artificial Sequence
  Description of Artificial Sequence: Synthetic polypeptide
DEEEIRTTNPVATEQYGVVSATNLQLRGDEDR

SEQ ID NO: 32931 - protein, 28 aa, Artificial Sequence
  Description of Artificial Sequence: Synthetic peptide
DEEEIGTTNPVATEQYGFASENLQRGTV

SEQ ID NO: 32932 - protein, 28 aa, Artificial Sequence
  Description of Artificial Sequence: Synthetic peptide
DEGEISATNPVATETYGSVSTNWQRGPR

SEQ ID NO: 32933 - protein, 28 aa, Artificial Sequence
  Description of Artificial Sequence: Synthetic peptide
GEEEIRTTNPVATEQYGSVSTPLETGGW

SEQ ID NO: 32934 - protein, 28 aa, Artificial Sequence
  Description of Artificial Sequence: Synthetic peptide
DEHEIRTTNPVATEQYGDVSRNLQHFNT

SEQ ID NO: 32935 - protein, 28 aa, Artificial Sequence
  Description of Artificial Sequence: Synthetic peptide
DEEEIATTNIVATEQYGSVSTILQGGEM

SEQ ID NO: 32936 - protein, 28 aa, Artificial Sequence
  Description of Artificial Sequence: Synthetic peptide
DEDEIRTTNPVATEIYGTVSTNVQVGNE

SEQ ID NO: 32937 - protein, 28 aa, Artificial Sequence
  Description of Artificial Sequence: Synthetic peptide
DEEEIRTTNPVATEQYGAVSTELEYGDI

SEQ ID NO: 32938 - protein, 28 aa, Artificial Sequence
  Description of Artificial Sequence: Synthetic peptide
DPEEIRTTNPVAYQQYGSVSHNLQRGEP

SEQ ID NO: 32939 - protein, 33 aa, Artificial Sequence
  Description of Artificial Sequence: Synthetic polypeptide
DEEEIRTTNPVATEQYGSVISTMNLPQLRGDNG

SEQ ID NO: 32940 - protein, 28 aa, Artificial Sequence
  Description of Artificial Sequence: Synthetic peptide
MEEEIRTVNPVATEQYGSVSYNLGSGGR

SEQ ID NO: 32941 - protein, 29 aa, Artificial Sequence
  Description of Artificial Sequence: Synthetic peptide
DEQEIRTTNPVATEQWGSVSENEMMRGNR

SEQ ID NO: 32942 - protein, 28 aa, Artificial Sequence
  Description of Artificial Sequence: Synthetic peptide
DESEIRTVNPCATEQYGTVSTNLQFGNC

SEQ ID NO: 32943 - protein, 28 aa, Artificial Sequence
  Description of Artificial Sequence: Synthetic peptide
DEEEITATNPVATEQYGWVSTPLQIGNE

SEQ ID NO: 32944 - protein, 29 aa, Artificial Sequence
  Description of Artificial Sequence: Synthetic peptide
DEEEIRTTNPVATECYGSVSEDLQDHGNT

SEQ ID NO: 32945 - protein, 30 aa, Artificial Sequence
  Description of Artificial Sequence: Synthetic polypeptide
DEHEIRTTNPVATEQYGSVSEMNLQHNGNA

SEQ ID NO: 32946 - protein, 28 aa, Artificial Sequence
  Description of Artificial Sequence: Synthetic peptide
DETEIRTTNPCATEQYGDVSTDLLRGNG

SEQ ID NO: 32947 - protein, 28 aa, Artificial Sequence
  Description of Artificial Sequence: Synthetic peptide
DEEEIKTTNPICTEQYGSVSTNWERLNR

SEQ ID NO: 32948 - protein, 28 aa, Artificial Sequence
  Description of Artificial Sequence: Synthetic peptide
KEEEIATTNPVAYEQYGNVSTNLERGTR

SEQ ID NO: 32949 - protein, 28 aa, Artificial Sequence
  Description of Artificial Sequence: Synthetic peptide
DEEEIRTTNPTATECFGSVSTNLQVGDN

SEQ ID NO: 32950 - protein, 28 aa, Artificial Sequence
  Description of Artificial Sequence: Synthetic peptide
DEEEIRTTNPVATEQYGSVETPDDPGER

SEQ ID NO: 32951 - protein, 28 aa, Artificial Sequence
  Description of Artificial Sequence: Synthetic peptide
QEGEIRTVNPVATEQYGQVATNLQYGNR

SEQ ID NO: 32952 - protein, 30 aa, Artificial Sequence
  Description of Artificial Sequence: Synthetic polypeptide
DEEEIRCTNPVATEIYGCVAATNLQREGNR

SEQ ID NO: 32953 - protein, 32 aa, Artificial Sequence
  Description of Artificial Sequence: Synthetic polypeptide
DEEEIRTTNPVATEQYGSVSCTMDLQCRGNDE

SEQ ID NO: 32954 - protein, 28 aa, Artificial Sequence
  Description of Artificial Sequence: Synthetic peptide
QEVEIATTNPVATEQFGSVSTNLQRGDQ

SEQ ID NO: 32955 - protein, 28 aa, Artificial Sequence
  Description of Artificial Sequence: Synthetic peptide
DEHEIRTTNPVATEQYGDVSEDLQGGNI

SEQ ID NO: 32956 - protein, 31 aa, Artificial Sequence
  Description of Artificial Sequence: Synthetic polypeptide
AEEEIRTTNPVATEQYGSVSTLNLESMGENR

SEQ ID NO: 32957 - protein, 28 aa, Artificial Sequence
  Description of Artificial Sequence: Synthetic peptide
DEEEIATTNPVATEQYGSVSFNLQQQMF

SEQ ID NO: 32958 - protein, 28 aa, Artificial Sequence
  Description of Artificial Sequence: Synthetic peptide
DEEETRTTNPMATEQYGSVSTELIDGNA

SEQ ID NO: 32959 - protein, 28 aa, Artificial Sequence
  Description of Artificial Sequence: Synthetic peptide
DEEEIRATNPTATEQYGSVSTNEQLGTG

SEQ ID NO: 32960 - protein, 32 aa, Artificial Sequence
  Description of Artificial Sequence: Synthetic polypeptide
DEEEIRTTNPVATEQYGSVSETNLEETDGNDR

SEQ ID NO: 32961 - protein, 28 aa, Artificial Sequence
  Description of Artificial Sequence: Synthetic peptide
NEEEIRTTNGVATEQYGSVSVGLQRANT

SEQ ID NO: 32962 - protein, 28 aa, Artificial Sequence
  Description of Artificial Sequence: Synthetic peptide
DEEEIATTNPVATECYGSVSTDLQHGEL

SEQ ID NO: 32963 - protein, 29 aa, Artificial Sequence
  Description of Artificial Sequence: Synthetic peptide
DEEEIATTNPVATEQYGEASTNLQREPNA

SEQ ID NO: 32964 - protein, 30 aa, Artificial Sequence
  Description of Artificial Sequence: Synthetic polypeptide
DEEEISTTNPVATEQYGVVSTNWQDRGNTI

SEQ ID NO: 32965 - protein, 28 aa, Artificial Sequence
  Description of Artificial Sequence: Synthetic peptide
SEEEIRTTNPVATEQYGEVIDNSQSGNR

SEQ ID NO: 32966 - protein, 31 aa, Artificial Sequence
  Description of Artificial Sequence: Synthetic polypeptide
DENEIRTTNPVATEQYGSVSENLQQYRPNVR

SEQ ID NO: 32967 - protein, 28 aa, Artificial Sequence
  Description of Artificial Sequence: Synthetic peptide
QEEEIVTTNPCATEQYGSVSENLQSGNT

SEQ ID NO: 32968 - protein, 29 aa, Artificial Sequence
  Description of Artificial Sequence: Synthetic peptide
SEEEIRSTNPVATEQYGSVSTNLEFQGTR

SEQ ID NO: 32969 - protein, 28 aa, Artificial Sequence
  Description of Artificial Sequence: Synthetic peptide
AEEEIAQTNPVATEQYGVVSTDQQRGNR

SEQ ID NO: 32970 - protein, 30 aa, Artificial Sequence
  Description of Artificial Sequence: Synthetic polypeptide
DETEIRPTNPVATEQYGSVSTMNLQLREMR

SEQ ID NO: 32971 - protein, 29 aa, Artificial Sequence
  Description of Artificial Sequence: Synthetic peptide
LEEEIRATNPVATESYGSVSTNLQDQGQR

SEQ ID NO: 32972 - protein, 28 aa, Artificial Sequence
  Description of Artificial Sequence: Synthetic peptide
MEQEIRTTNPVATEQYGTVSTDLQNGNQ

SEQ ID NO: 32973 - protein, 28 aa, Artificial Sequence
  Description of Artificial Sequence: Synthetic peptide
DEEEIRTTNPVATEQYGVTATNLQSSNT

SEQ ID NO: 32974 - protein, 29 aa, Artificial Sequence
  Description of Artificial Sequence: Synthetic peptide
QEQEIVTTNPVATEQYGIVSAENLQRGNR

SEQ ID NO: 32975 - protein, 28 aa, Artificial Sequence
  Description of Artificial Sequence: Synthetic peptide
QDEEIRTTNPVATECYGSVSTNLQHGET

SEQ ID NO: 32976 - protein, 32 aa, Artificial Sequence
  Description of Artificial Sequence: Synthetic polypeptide
DEEEIRTTNPVATEQYGSVDCTMNLQCVGNDR

SEQ ID NO: 32977 - protein, 29 aa, Artificial Sequence
  Description of Artificial Sequence: Synthetic peptide
DENEIRTTNPVATEQWGSVSTNLMMQGNW

SEQ ID NO: 32978 - protein, 28 aa, Artificial Sequence
  Description of Artificial Sequence: Synthetic peptide
DEEEIATTNPVATEQYGQVATNLQNGTT

SEQ ID NO: 32979 - protein, 28 aa, Artificial Sequence
  Description of Artificial Sequence: Synthetic peptide
DEEEIRTTNPVATEQYGEVSEVLQHEER

SEQ ID NO: 32980 - protein, 28 aa, Artificial Sequence
  Description of Artificial Sequence: Synthetic peptide
DESEIRATNIVATEHYGSVSTNNQTGNR

SEQ ID NO: 32981 - protein, 28 aa, Artificial Sequence
  Description of Artificial Sequence: Synthetic peptide
NESEIRCTNPVCTEQYGGVSTNLQRLNR

SEQ ID NO: 32982 - protein, 30 aa, Artificial Sequence
  Description of Artificial Sequence: Synthetic polypeptide
DEEEIRTTNPVATEQYGSVSENPQDRGTTH

SEQ ID NO: 32983 - protein, 28 aa, Artificial Sequence
  Description of Artificial Sequence: Synthetic peptide
DEHEIRTTNPVATEQYGDVSEDLQMGNS

SEQ ID NO: 32984 - protein, 30 aa, Artificial Sequence
  Description of Artificial Sequence: Synthetic polypeptide
DEEEIRATNPVATEVYGSVSTEALQRKGNI

SEQ ID NO: 32985 - protein, 28 aa, Artificial Sequence
  Description of Artificial Sequence: Synthetic peptide
DEEEIRTTNPVATEQYGTTATNLQNSNT

SEQ ID NO: 32986 - protein, 28 aa, Artificial Sequence
  Description of Artificial Sequence: Synthetic peptide
SEEEIRTTNPEATELFGSVSTNLQRGDH

SEQ ID NO: 32987 - protein, 28 aa, Artificial Sequence
  Description of Artificial Sequence: Synthetic peptide
DEQEIATTNPVATECYGSVSTDLQHGER

SEQ ID NO: 32988 - protein, 28 aa, Artificial Sequence
  Description of Artificial Sequence: Synthetic peptide
SEEEIRTTNPVATEQFGSVSTNWQSGTQ

SEQ ID NO: 32989 - protein, 28 aa, Artificial Sequence
  Description of Artificial Sequence: Synthetic peptide
KEEEITTTNPVATEVYGSVACNLQHGNR

SEQ ID NO: 32990 - protein, 28 aa, Artificial Sequence
  Description of Artificial Sequence: Synthetic peptide
SEEEIRTTNPVSTEWYGSVSTNEQRGDL

SEQ ID NO: 32991 - protein, 29 aa, Artificial Sequence
  Description of Artificial Sequence: Synthetic peptide
SENEIRTTNPVATEQYGSVSTIEQNRGDR

SEQ ID NO: 32992 - protein, 30 aa, Artificial Sequence
  Description of Artificial Sequence: Synthetic polypeptide
DEEEIRTTNPVSTECYGSVSTNLQWLGNDY

SEQ ID NO: 32993 - protein, 28 aa, Artificial Sequence
  Description of Artificial Sequence: Synthetic peptide
DEQEIRTTNPVATEQYGSVSTDLEHGEL

SEQ ID NO: 32994 - protein, 31 aa, Artificial Sequence
  Description of Artificial Sequence: Synthetic polypeptide
DEEEIRTTNPVATEQYGSVSATNLQDHGEDL

SEQ ID NO: 32995 - protein, 32 aa, Artificial Sequence
  Description of Artificial Sequence: Synthetic polypeptide
DEEEINTTNPVATEPYGTSVGSTNLQRGVNSR

SEQ ID NO: 32996 - protein, 28 aa, Artificial Sequence
  Description of Artificial Sequence: Synthetic peptide
DDDEIRTTNPVAVEQYGSAATNLQQGNR

SEQ ID NO: 32997 - protein, 32 aa, Artificial Sequence
  Description of Artificial Sequence: Synthetic polypeptide
DEEEITTTNPVATEQYGSVSCTMNLQCRGNDA

SEQ ID NO: 32998 - protein, 30 aa, Artificial Sequence
  Description of Artificial Sequence: Synthetic polypeptide
DEEEIRTTNPDATEQYGSVSTMNLYRYNEL

SEQ ID NO: 32999 - protein, 28 aa, Artificial Sequence
  Description of Artificial Sequence: Synthetic peptide
GEEEIGTTNPVATEQYGEISTTLQQGNR

SEQ ID NO: 33000 - protein, 28 aa, Artificial Sequence
  Description of Artificial Sequence: Synthetic peptide
QEEEIRTTNPVATEQYGSNSQNWERGER

SEQ ID NO: 33001 - protein, 29 aa, Artificial Sequence
  Description of Artificial Sequence: Synthetic peptide
AEDEIVTTNPVATEQYGDVSADNLQRGNR

SEQ ID NO: 33002 - protein, 29 aa, Artificial Sequence
  Description of Artificial Sequence: Synthetic peptide
DENEIRTTNPVATEQWGSVSENEQMRGNF

SEQ ID NO: 33003 - protein, 30 aa, Artificial Sequence
  Description of Artificial Sequence: Synthetic polypeptide
DEEEIRTTNPVATCKYGDVLSTNLMRGLNR

SEQ ID NO: 33004 - protein, 28 aa, Artificial Sequence
  Description of Artificial Sequence: Synthetic peptide
DEEEIATTNPVATEQYGEAGTNLQHGMR

SEQ ID NO: 33005 - protein, 28 aa, Artificial Sequence
  Description of Artificial Sequence: Synthetic peptide
DEQEIATTNPVATECYGSVSTNLEHGER

SEQ ID NO: 33006 - protein, 28 aa, Artificial Sequence
  Description of Artificial Sequence: Synthetic peptide
DENEIRTTNPVATEQWGIVSTNEQLGNM

SEQ ID NO: 33007 - protein, 32 aa, Artificial Sequence
  Description of Artificial Sequence: Synthetic polypeptide
DEEEIRTTNPVATEQFGSVSTNGLQESGVNDR

SEQ ID NO: 33008 - protein, 28 aa, Artificial Sequence
  Description of Artificial Sequence: Synthetic peptide
DEEEIRTTNPEATEQYGSVSDPLQKGDT

SEQ ID NO: 33009 - protein, 28 aa, Artificial Sequence
  Description of Artificial Sequence: Synthetic peptide
DENEIRTTNPVATEWYGSVSENEQGGNF

SEQ ID NO: 33010 - protein, 28 aa, Artificial Sequence
  Description of Artificial Sequence: Synthetic peptide
DEMEIRTTNPVATEGYGEVSTNLQEGDV

SEQ ID NO: 33011 - protein, 28 aa, Artificial Sequence
  Description of Artificial Sequence: Synthetic peptide
DEEEIRTTNPVATEQYGENSDSLQWGGR

SEQ ID NO: 33012 - protein, 28 aa, Artificial Sequence
  Description of Artificial Sequence: Synthetic peptide
DEEEIRTTNPVATEQYGSVETEDQFGET

SEQ ID NO: 33013 - protein, 28 aa, Artificial Sequence
  Description of Artificial Sequence: Synthetic peptide
DENEIRTTNPVATECYGSVSENLMLGNA

SEQ ID NO: 33014 - protein, 28 aa, Artificial Sequence
  Description of Artificial Sequence: Synthetic peptide
DEIEIRTTNPCATEVYGSVSDNDQQGNR

SEQ ID NO: 33015 - protein, 28 aa, Artificial Sequence
  Description of Artificial Sequence: Synthetic peptide
DEEEIRTTNPVATEQYGVTATNLQNSNT

SEQ ID NO: 33016 - protein, 28 aa, Artificial Sequence
  Description of Artificial Sequence: Synthetic peptide
DEEEIRTTNPVATEQWGSVSTNEMTGTQ

SEQ ID NO: 33017 - protein, 28 aa, Artificial Sequence
  Description of Artificial Sequence: Synthetic peptide
SEEEIRTTNPVATELFGSVNTNLQQGPR

SEQ ID NO: 33018 - protein, 28 aa, Artificial Sequence
  Description of Artificial Sequence: Synthetic peptide
DEFEISTTNPVATEMYGSVSTNDQLGNH

SEQ ID NO: 33019 - protein, 29 aa, Artificial Sequence
  Description of Artificial Sequence: Synthetic peptide
DEQEIRTTNPVATECYGSVSTNEMNRGNF

SEQ ID NO: 33020 - protein, 29 aa, Artificial Sequence
  Description of Artificial Sequence: Synthetic peptide
DENEIATTNPVATEQYGSVSATNLEVGTR

SEQ ID NO: 33021 - protein, 28 aa, Artificial Sequence
  Description of Artificial Sequence: Synthetic peptide
DEIEIRTTNPVGTEQYGWVSTNVQGPNR

SEQ ID NO: 33022 - protein, 29 aa, Artificial Sequence
  Description of Artificial Sequence: Synthetic peptide
DEEEIRTTNPVATEQWGSVSENEMMRGNM

SEQ ID NO: 33023 - protein, 28 aa, Artificial Sequence
  Description of Artificial Sequence: Synthetic peptide
SEEEIRTTNPVATEQYGSVSENEQVGTA

SEQ ID NO: 33024 - protein, 28 aa, Artificial Sequence
  Description of Artificial Sequence: Synthetic peptide
DEEEIRTTNPYATEQYGSVHENEMRGNP

SEQ ID NO: 33025 - protein, 31 aa, Artificial Sequence
  Description of Artificial Sequence: Synthetic polypeptide
DENEIRTTNPVATEQYGVVDSTNQQLRGNDR

SEQ ID NO: 33026 - protein, 29 aa, Artificial Sequence
  Description of Artificial Sequence: Synthetic peptide
DEEEIRTTNPVSTEQYGSVPEVLQHGPNR

SEQ ID NO: 33027 - protein, 28 aa, Artificial Sequence
  Description of Artificial Sequence: Synthetic peptide
DENEIRQTNPVATEQYGSVSTDLEVGER

SEQ ID NO: 33028 - protein, 29 aa, Artificial Sequence
  Description of Artificial Sequence: Synthetic peptide
DEQEIRTVNPVATEVYGEVSTNLQHAGNR

SEQ ID NO: 33029 - protein, 28 aa, Artificial Sequence
  Description of Artificial Sequence: Synthetic peptide
DTEEIRTTNPYAMEQWGSWSTPLQRGNR

SEQ ID NO: 33030 - protein, 28 aa, Artificial Sequence
  Description of Artificial Sequence: Synthetic peptide
NEEEIRTTNIVATEEYGSVSTNLQNANT

SEQ ID NO: 33031 - protein, 29 aa, Artificial Sequence
  Description of Artificial Sequence: Synthetic peptide
DEEEVRATNPVAYETYGSVSSNLQREGNR

SEQ ID NO: 33032 - protein, 28 aa, Artificial Sequence
  Description of Artificial Sequence: Synthetic peptide
DENEIRTTNPVATEPYGTVSTALQQGNN

SEQ ID NO: 33033 - protein, 30 aa, Artificial Sequence
  Description of Artificial Sequence: Synthetic polypeptide
DEEEIATTNPVATEQYGSVSITNPDRKGNS

SEQ ID NO: 33034 - protein, 28 aa, Artificial Sequence
  Description of Artificial Sequence: Synthetic peptide
DEECIRTTNPVAWELYGSVETNLQRGLG

SEQ ID NO: 33035 - protein, 28 aa, Artificial Sequence
  Description of Artificial Sequence: Synthetic peptide
DDEEIRCTNPVATEQYGSVSTEEMIGNR

SEQ ID NO: 33036 - protein, 28 aa, Artificial Sequence
  Description of Artificial Sequence: Synthetic peptide
KENEIRTTNPVATEQYGSVSENLQTGDW

SEQ ID NO: 33037 - protein, 28 aa, Artificial Sequence
  Description of Artificial Sequence: Synthetic peptide
DEEEIRTTNPVATECYGSVSTDPQREEA

SEQ ID NO: 33038 - protein, 32 aa, Artificial Sequence
  Description of Artificial Sequence: Synthetic polypeptide
DEEEIRTTNPVATEQYGESVSETDGDVQRGNR

SEQ ID NO: 33039 - protein, 28 aa, Artificial Sequence
  Description of Artificial Sequence: Synthetic peptide
AENEIRQTNPVATEQYGSASTNLQHGNL

SEQ ID NO: 33040 - protein, 29 aa, Artificial Sequence
  Description of Artificial Sequence: Synthetic peptide
DEEEIATTNPTASQQYGSVATNLQREGNR

SEQ ID NO: 33041 - protein, 31 aa, Artificial Sequence
  Description of Artificial Sequence: Synthetic polypeptide
DENEIATTNPVATEQYGEVDSTNGLQRGENR

SEQ ID NO: 33042 - protein, 31 aa, Artificial Sequence
  Description of Artificial Sequence: Synthetic polypeptide
DEEEIRTTNPVATEQYWGSWSTPNPDDRGNR

SEQ ID NO: 33043 - protein, 28 aa, Artificial Sequence
  Description of Artificial Sequence: Synthetic peptide
SENEIATTNPVAYEQYGSVSTNLQRPNF

SEQ ID NO: 33044 - protein, 28 aa, Artificial Sequence
  Description of Artificial Sequence: Synthetic peptide
MENEIRTTNPVATECYGSVSENLQAGNS

SEQ ID NO: 33045 - protein, 28 aa, Artificial Sequence
  Description of Artificial Sequence: Synthetic peptide
DEQEVRTTNPVATEIYGCVATNLERGNR

SEQ ID NO: 33046 - protein, 32 aa, Artificial Sequence
  Description of Artificial Sequence: Synthetic polypeptide
DEEEIRTTNPVATEQYGVVSTEELQVRNGNDR

SEQ ID NO: 33047 - protein, 32 aa, Artificial Sequence
  Description of Artificial Sequence: Synthetic polypeptide
DEEEIRTTNPFATEQYGSVSTLNLTLRGDNPR

SEQ ID NO: 33048 - protein, 28 aa, Artificial Sequence
  Description of Artificial Sequence: Synthetic peptide
QENEIRTTNPVATECYGSVSECLQRGNN

SEQ ID NO: 33049 - protein, 28 aa, Artificial Sequence
  Description of Artificial Sequence: Synthetic peptide
DEEEIRQTNPVATEQYGSASTGENRGNN

SEQ ID NO: 33050 - protein, 29 aa, Artificial Sequence
  Description of Artificial Sequence: Synthetic peptide
DENEIGCTNPVATEQYGSASATNLQRGGR

SEQ ID NO: 33051 - protein, 28 aa, Artificial Sequence
  Description of Artificial Sequence: Synthetic peptide
DEDEIATTNPVAVEQYGSVSTNEFNGNR

SEQ ID NO: 33052 - protein, 31 aa, Artificial Sequence
  Description of Artificial Sequence: Synthetic polypeptide
DEEEIRTTNPVATEQYGSVSCTNPLDERGES

SEQ ID NO: 33053 - protein, 28 aa, Artificial Sequence
  Description of Artificial Sequence: Synthetic peptide
DENEIRTVNPVATECYGSVSTDLQQGNA

SEQ ID NO: 33054 - protein, 29 aa, Artificial Sequence
  Description of Artificial Sequence: Synthetic peptide
DENEIRTTNPVATEQWGIVSTNEQMRGNW

SEQ ID NO: 33055 - protein, 28 aa, Artificial Sequence
  Description of Artificial Sequence: Synthetic peptide
GENEIRTTNPVATECYGSVSTDLQLGNA

SEQ ID NO: 33056 - protein, 30 aa, Artificial Sequence
  Description of Artificial Sequence: Synthetic polypeptide
DEQELRTTNPVATELYGCVSATNLQREGNR

SEQ ID NO: 33057 - protein, 28 aa, Artificial Sequence
  Description of Artificial Sequence: Synthetic peptide
DEDEVRATNPVASEQYGSVAMNLQRGNR

SEQ ID NO: 33058 - protein, 28 aa, Artificial Sequence
  Description of Artificial Sequence: Synthetic peptide
DEQEIATTNPVSTENYGWVATNLQRGNR

SEQ ID NO: 33059 - protein, 28 aa, Artificial Sequence
  Description of Artificial Sequence: Synthetic peptide
DEEMIRTTNPSATEQYGSVSMGLQHGNS

SEQ ID NO: 33060 - protein, 28 aa, Artificial Sequence
  Description of Artificial Sequence: Synthetic peptide
DEEEIRTTNPVATEQYGSVETPDDDGER

SEQ ID NO: 33061 - protein, 28 aa, Artificial Sequence
  Description of Artificial Sequence: Synthetic peptide
DEQEIRTTNPVATEQYGSVSTNGWNDNP

SEQ ID NO: 33062 - protein, 28 aa, Artificial Sequence
  Description of Artificial Sequence: Synthetic peptide
QEDEIRTVNPVSTEQYGSVSTNLQHENR

SEQ ID NO: 33063 - protein, 28 aa, Artificial Sequence
  Description of Artificial Sequence: Synthetic peptide
SEEEIKTTNIVATEQYGQVSTNLQNGNT

SEQ ID NO: 33064 - protein, 29 aa, Artificial Sequence
  Description of Artificial Sequence: Synthetic peptide
DEEEIRCTNPVSTEQYGSVDTNDQIQGNR

SEQ ID NO: 33065 - protein, 28 aa, Artificial Sequence
  Description of Artificial Sequence: Synthetic peptide
DENEIRTTNPVSTECYGSVSTDLQVGNS

SEQ ID NO: 33066 - protein, 28 aa, Artificial Sequence
  Description of Artificial Sequence: Synthetic peptide
QESEIAATNIVATEQYGEVSTNLQRGNR

SEQ ID NO: 33067 - protein, 28 aa, Artificial Sequence
  Description of Artificial Sequence: Synthetic peptide
NEEEVATTNPVCTENYGSVSTNLQRGTR

SEQ ID NO: 33068 - protein, 28 aa, Artificial Sequence
  Description of Artificial Sequence: Synthetic peptide
DEQEIRTTNPVATELYGVVSTAPQRGDR

SEQ ID NO: 33069 - protein, 28 aa, Artificial Sequence
  Description of Artificial Sequence: Synthetic peptide
NEQEIRTTNPVATEQYGSVSDNLQAGAA

SEQ ID NO: 33070 - protein, 28 aa, Artificial Sequence
  Description of Artificial Sequence: Synthetic peptide
DENEIRTTNPVATECYGSVSTDDQIGNL

SEQ ID NO: 33071 - protein, 28 aa, Artificial Sequence
  Description of Artificial Sequence: Synthetic peptide
DEQEIRTTNPVATEQYGSVDTDEDRGER

SEQ ID NO: 33072 - protein, 28 aa, Artificial Sequence
  Description of Artificial Sequence: Synthetic peptide
DEEEITATNPVATEQYGSVSTDGQTGNA

SEQ ID NO: 33073 - protein, 31 aa, Artificial Sequence
  Description of Artificial Sequence: Synthetic polypeptide
DEEEIRSTNPVATEQYGSVGTNGLQLYGNDR

SEQ ID NO: 33074 - protein, 31 aa, Artificial Sequence
  Description of Artificial Sequence: Synthetic polypeptide
DEEEIRCTNPVATEQYGSVSITMNLEFGDNR

SEQ ID NO: 33075 - protein, 31 aa, Artificial Sequence
  Description of Artificial Sequence: Synthetic polypeptide
DEEEIRTTNPVATECYGSVSTNLQDRNGEDD

SEQ ID NO: 33076 - protein, 30 aa, Artificial Sequence
  Description of Artificial Sequence: Synthetic polypeptide
DEEEIATTNPVATEQFGSSVSTNLQQNGDR

SEQ ID NO: 33077 - protein, 28 aa, Artificial Sequence
  Description of Artificial Sequence: Synthetic peptide
DEEEIYTTNPVATESYGSVSTNWQHGDS

SEQ ID NO: 33078 - protein, 31 aa, Artificial Sequence
  Description of Artificial Sequence: Synthetic polypeptide
DEEEIRTTNPVATEQYGSVSCTMELCRGNDE

SEQ ID NO: 33079 - protein, 30 aa, Artificial Sequence
  Description of Artificial Sequence: Synthetic polypeptide
DEEEIRTTNPVATEQYGSVDSENLQTKGEI

SEQ ID NO: 33080 - protein, 28 aa, Artificial Sequence
  Description of Artificial Sequence: Synthetic peptide
DEQEIRTTNPVATEQYGSVSTEDETGNL

SEQ ID NO: 33081 - protein, 30 aa, Artificial Sequence
  Description of Artificial Sequence: Synthetic polypeptide
QEEEIRTTNPVATEVYGSVSATVIQRAGNR

SEQ ID NO: 33082 - protein, 30 aa, Artificial Sequence
  Description of Artificial Sequence: Synthetic polypeptide
DEEEIRTTNPEATEMYGSVSTMNLQLGNDY

SEQ ID NO: 33083 - protein, 30 aa, Artificial Sequence
  Description of Artificial Sequence: Synthetic polypeptide
NEEEIRTTNPVATEQYGVSVSTDLNVRGNL

SEQ ID NO: 33084 - protein, 30 aa, Artificial Sequence
  Description of Artificial Sequence: Synthetic polypeptide
DEEEITTTNPVAYEQYGSVCTGNLQERGNL

SEQ ID NO: 33085 - protein, 29 aa, Artificial Sequence
  Description of Artificial Sequence: Synthetic peptide
DECEIRGTNPVATEQYGNVESTNLQNGNM

SEQ ID NO: 33086 - protein, 30 aa, Artificial Sequence
  Description of Artificial Sequence: Synthetic polypeptide
DEEEIRATNPVATEQYGSVSENLQERGDDW

SEQ ID NO: 33087 - protein, 29 aa, Artificial Sequence
  Description of Artificial Sequence: Synthetic peptide
DDQEIRTTNPVATEQYGCVAMNLQRNGNR

SEQ ID NO: 33088 - protein, 30 aa, Artificial Sequence
  Description of Artificial Sequence: Synthetic polypeptide
DEEEIRTTNPDSTEQYGSVSMNPLQRGNDD

SEQ ID NO: 33089 - protein, 28 aa, Artificial Sequence
  Description of Artificial Sequence: Synthetic peptide
DEEEIRTTNPVATEQYGSVSTADFQDNV

SEQ ID NO: 33090 - protein, 28 aa, Artificial Sequence
  Description of Artificial Sequence: Synthetic peptide
CEEEIRTVNPVATEQYGSASCNLERGTR

SEQ ID NO: 33091 - protein, 32 aa, Artificial Sequence
  Description of Artificial Sequence: Synthetic polypeptide
DEEEIRTTNPVATEQYGESVEETNDPQREGNR

SEQ ID NO: 33092 - protein, 32 aa, Artificial Sequence
  Description of Artificial Sequence: Synthetic polypeptide
DEEEIRTTNPVATEQYGSVSCTNLQVDGENDC

SEQ ID NO: 33093 - protein, 29 aa, Artificial Sequence
  Description of Artificial Sequence: Synthetic peptide
MEEEIRATNPVATEQYGSVSEDLQERGNN

SEQ ID NO: 33094 - protein, 29 aa, Artificial Sequence
  Description of Artificial Sequence: Synthetic peptide
DEEEIRTTNPDATEQYGEVSTDLQQNGNF

SEQ ID NO: 33095 - protein, 32 aa, Artificial Sequence
  Description of Artificial Sequence: Synthetic polypeptide
DEEEIRTTNPVATEQYGSVDSTNPPQERGDDR

SEQ ID NO: 33096 - protein, 29 aa, Artificial Sequence
  Description of Artificial Sequence: Synthetic peptide
GEEEIRTTNPVATECYGSVSTELQDFGDR

SEQ ID NO: 33097 - protein, 28 aa, Artificial Sequence
  Description of Artificial Sequence: Synthetic peptide
MEEEIRTTNPVATECYGSVSEELQSGNL

SEQ ID NO: 33098 - protein, 29 aa, Artificial Sequence
  Description of Artificial Sequence: Synthetic peptide
DEEEIRCTNPVATEIYGCVSMNLERNGNR

SEQ ID NO: 33099 - protein, 28 aa, Artificial Sequence
  Description of Artificial Sequence: Synthetic peptide
DEEEIRTTNPVATEIYGSVSEDVIDGNR

SEQ ID NO: 33100 - protein, 30 aa, Artificial Sequence
  Description of Artificial Sequence: Synthetic polypeptide
QENEIRTTNPVATECYGSVSDTDLQRNGNR

SEQ ID NO: 33101 - protein, 28 aa, Artificial Sequence
  Description of Artificial Sequence: Synthetic peptide
DEEEIRTTNPDATEQYGSVSENLDNGEN

SEQ ID NO: 33102 - protein, 28 aa, Artificial Sequence
  Description of Artificial Sequence: Synthetic peptide
QEGEIRCTNPVATEQYGQVSTNPQRGNT

SEQ ID NO: 33103 - protein, 28 aa, Artificial Sequence
  Description of Artificial Sequence: Synthetic peptide
DEEEIRTTNPVATECYGVVSTALERGDW

SEQ ID NO: 33104 - protein, 29 aa, Artificial Sequence
  Description of Artificial Sequence: Synthetic peptide
QEEEIRCTNPVATEQYGSVSDNPQERGNH

SEQ ID NO: 33105 - protein, 31 aa, Artificial Sequence
  Description of Artificial Sequence: Synthetic polypeptide
DEEEIRTTNPVATEQYGSVDCTMNLQMGNDS

SEQ ID NO: 33106 - protein, 29 aa, Artificial Sequence
  Description of Artificial Sequence: Synthetic peptide
QEQEIRTTNPVATECYGSVSTDLQRKGER

SEQ ID NO: 33107 - protein, 28 aa, Artificial Sequence
  Description of Artificial Sequence: Synthetic peptide
DEEEIRTTNPVATEQYGSVSTEEQAEEI

SEQ ID NO: 33108 - protein, 32 aa, Artificial Sequence
  Description of Artificial Sequence: Synthetic polypeptide
DEEEIRTTNPVATEQYGSVSETDLQVRGENDN

SEQ ID NO: 33109 - protein, 29 aa, Artificial Sequence
  Description of Artificial Sequence: Synthetic peptide
DENEIRTTNPVATEQYGSYSTILQNQGDR

SEQ ID NO: 33110 - protein, 32 aa, Artificial Sequence
  Description of Artificial Sequence: Synthetic polypeptide
DEEEIRTTNPVATEHYGSVISTDLPQREGNTR

SEQ ID NO: 33111 - protein, 31 aa, Artificial Sequence
  Description of Artificial Sequence: Synthetic polypeptide
DEEEIRTTNPVATEQYGSVPSAGDNLERGND

SEQ ID NO: 33112 - protein, 30 aa, Artificial Sequence
  Description of Artificial Sequence: Synthetic polypeptide
DEEEIRTTNPEATEQYGSVSTPELQSKGNL

SEQ ID NO: 33113 - protein, 28 aa, Artificial Sequence
  Description of Artificial Sequence: Synthetic peptide
DEAEIRTTNPVATECYGSVSTELELGNN

SEQ ID NO: 33114 - protein, 30 aa, Artificial Sequence
  Description of Artificial Sequence: Synthetic polypeptide
DEEEIRATNPVATEQYGEVSTMNLQQEGNI

SEQ ID NO: 33115 - protein, 29 aa, Artificial Sequence
  Description of Artificial Sequence: Synthetic peptide
DEVEIATTNPVATEQFGGVSTNLQREGNF

SEQ ID NO: 33116 - protein, 28 aa, Artificial Sequence
  Description of Artificial Sequence: Synthetic peptide
DEEEIKTTNPVATEQYGSVSDLDERGNW

SEQ ID NO: 33117 - protein, 30 aa, Artificial Sequence
  Description of Artificial Sequence: Synthetic polypeptide
DEEEIRTTNPVATEIYGVVSTEEGLQRGND

SEQ ID NO: 33118 - protein, 28 aa, Artificial Sequence
  Description of Artificial Sequence: Synthetic peptide
DENEIRCTNPVATEQYGNVDTNLEIGNR

SEQ ID NO: 33119 - protein, 30 aa, Artificial Sequence
  Description of Artificial Sequence: Synthetic polypeptide
DEQEIRTTNPVATEIYGSVSATDLQRKGNE

SEQ ID NO: 33120 - protein, 29 aa, Artificial Sequence
  Description of Artificial Sequence: Synthetic peptide
DEEEIATTNPVATEQYGSVSTDLEHGNDM

SEQ ID NO: 33121 - protein, 29 aa, Artificial Sequence
  Description of Artificial Sequence: Synthetic peptide
DEEEIRTTNPVATECWGSVSTNEQMRGTF

SEQ ID NO: 33122 - protein, 28 aa, Artificial Sequence
  Description of Artificial Sequence: Synthetic peptide
DENEIATTNPVATEQYGSVSENLQNGEN

SEQ ID NO: 33123 - protein, 30 aa, Artificial Sequence
  Description of Artificial Sequence: Synthetic polypeptide
DEEEIRTTNPVATEQYGWVSENLQESFGNS

SEQ ID NO: 33124 - protein, 31 aa, Artificial Sequence
  Description of Artificial Sequence: Synthetic polypeptide
DEEEIRTTNPVATECYGSVSTELQERGENDM

SEQ ID NO: 33125 - protein, 31 aa, Artificial Sequence
  Description of Artificial Sequence: Synthetic polypeptide
SEEEIRTTNPVGTEQYGSVDSTNLPQERENR

SEQ ID NO: 33126 - protein, 28 aa, Artificial Sequence
  Description of Artificial Sequence: Synthetic peptide
DEEEIRTTNPVATEQYGSVETPDEEGNN

SEQ ID NO: 33127 - protein, 28 aa, Artificial Sequence
  Description of Artificial Sequence: Synthetic peptide
DETEIRCTNPVSTEQYGSASTALQRGNM

SEQ ID NO: 33128 - protein, 30 aa, Artificial Sequence
  Description of Artificial Sequence: Synthetic polypeptide
DEEEIKTTNPVATEQWGSYSTNLQFRAGMR

SEQ ID NO: 33129 - protein, 30 aa, Artificial Sequence
  Description of Artificial Sequence: Synthetic polypeptide
DEEEIRTTNPMATEQYGSVSTSNLDDIGNA

SEQ ID NO: 33130 - protein, 30 aa, Artificial Sequence
  Description of Artificial Sequence: Synthetic polypeptide
DEQEIATTNPVATEQYGSVSTNLERGENDI

SEQ ID NO: 33131 - protein, 28 aa, Artificial Sequence
  Description of Artificial Sequence: Synthetic peptide
QEEEIVCTNPVATEQYGSVSTNLQVGEM

SEQ ID NO: 33132 - protein, 28 aa, Artificial Sequence
  Description of Artificial Sequence: Synthetic peptide
DEEEICCTNPVCTEQYGSVSTGLQQGNH

SEQ ID NO: 33133 - protein, 28 aa, Artificial Sequence
  Description of Artificial Sequence: Synthetic peptide
DEEEIRSTNPVSTEQWGSVDTALQRGNI

SEQ ID NO: 33134 - protein, 30 aa, Artificial Sequence
  Description of Artificial Sequence: Synthetic polypeptide
DEEEIRTTNPVATELYGDVSTNEQRAGNDQ

SEQ ID NO: 33135 - protein, 31 aa, Artificial Sequence
  Description of Artificial Sequence: Synthetic polypeptide
DEEEIRTTNPVATEQYGSVSTNFTQPRGHTF

SEQ ID NO: 33136 - protein, 32 aa, Artificial Sequence
  Description of Artificial Sequence: Synthetic polypeptide
DEEEIRTTNPVATEQYGSVISTMNEQERGDNG

SEQ ID NO: 33137 - protein, 31 aa, Artificial Sequence
  Description of Artificial Sequence: Synthetic polypeptide
DEEEIRTTNPVATEQYGSVDCTMNLCRGNDC

SEQ ID NO: 33138 - protein, 29 aa, Artificial Sequence
  Description of Artificial Sequence: Synthetic peptide
DEEEIATTNPVATEQYGSVSENEQENENR

SEQ ID NO: 33139 - protein, 28 aa, Artificial Sequence
  Description of Artificial Sequence: Synthetic peptide
DEEEIRCTNPVATEQWGSVDDNDQQGNR

SEQ ID NO: 33140 - protein, 29 aa, Artificial Sequence
  Description of Artificial Sequence: Synthetic peptide
DEEEIRTTNPMATEQYGIVSDSNIQYGNR

SEQ ID NO: 33141 - protein, 31 aa, Artificial Sequence
  Description of Artificial Sequence: Synthetic polypeptide
DEEEIRTTNPEATEQYGSVSTENLVEHEGNR

SEQ ID NO: 33142 - protein, 29 aa, Artificial Sequence
  Description of Artificial Sequence: Synthetic peptide
DEEEIRTTNPVATECYGSVSEDLQERENA

SEQ ID NO: 33143 - protein, 31 aa, Artificial Sequence
  Description of Artificial Sequence: Synthetic polypeptide
DEEEIRTTNPTATEQYGSVSTNLQLIEGDNE

SEQ ID NO: 33144 - protein, 28 aa, Artificial Sequence
  Description of Artificial Sequence: Synthetic peptide
DEHEITTTNPVCTEQYGSVSTELQTGNA

SEQ ID NO: 33145 - protein, 28 aa, Artificial Sequence
  Description of Artificial Sequence: Synthetic peptide
DEQEIRTTNPVCTEQYGDVSTDLQHGNA

SEQ ID NO: 33146 - protein, 28 aa, Artificial Sequence
  Description of Artificial Sequence: Synthetic peptide
DEEEIRCTNPAATEQYGSVSTDWQQGNA

SEQ ID NO: 33147 - protein, 28 aa, Artificial Sequence
  Description of Artificial Sequence: Synthetic peptide
DEEEIRTTNPDATEQYGSVSTPDDDGNF

SEQ ID NO: 33148 - protein, 28 aa, Artificial Sequence
  Description of Artificial Sequence: Synthetic peptide
DTEEIRTTNPYATEQYGSVHTGLIPGNR

SEQ ID NO: 33149 - protein, 32 aa, Artificial Sequence
  Description of Artificial Sequence: Synthetic polypeptide
DEEEIRTTNPVATEQYGSVSDTDLERNGENDR

SEQ ID NO: 33150 - protein, 29 aa, Artificial Sequence
  Description of Artificial Sequence: Synthetic peptide
DEHEISTTNPVCSEMYGSVSTNLQRGNDR

SEQ ID NO: 33151 - protein, 31 aa, Artificial Sequence
  Description of Artificial Sequence: Synthetic polypeptide
DEEEIRTTNPVATEQYGSVDCEMNLQAGNDR

SEQ ID NO: 33152 - protein, 28 aa, Artificial Sequence
  Description of Artificial Sequence: Synthetic peptide
DEEEIVTTNPVATEQYGSVSTGDDFGER

SEQ ID NO: 33153 - protein, 30 aa, Artificial Sequence
  Description of Artificial Sequence: Synthetic polypeptide
DEEEIRTTNPVATEQYGSVSTDNDQTGVEM

SEQ ID NO: 33154 - protein, 29 aa, Artificial Sequence
  Description of Artificial Sequence: Synthetic peptide
DEVEIRTTNPVATEIYGEVSATVLQRGNT

SEQ ID NO: 33155 - protein, 28 aa, Artificial Sequence
  Description of Artificial Sequence: Synthetic peptide
DLEEIRTTNPVSTEQWGSMSTNLQRGTD

SEQ ID NO: 33156 - protein, 30 aa, Artificial Sequence
  Description of Artificial Sequence: Synthetic polypeptide
DEEEIRPTNPVATEQYGEVSMTGLPQTGNR

SEQ ID NO: 33157 - protein, 30 aa, Artificial Sequence
  Description of Artificial Sequence: Synthetic polypeptide
DEEEIRATNPVATEQYGSVISANLERGNDF

SEQ ID NO: 33158 - protein, 28 aa, Artificial Sequence
  Description of Artificial Sequence: Synthetic peptide
DEEEIRTTNPDATEQYGSVSTNDEAGED

SEQ ID NO: 33159 - protein, 28 aa, Artificial Sequence
  Description of Artificial Sequence: Synthetic peptide
DEEEIRGTNPCATEQYGAVSTELQHGNA

SEQ ID NO: 33160 - protein, 29 aa, Artificial Sequence
  Description of Artificial Sequence: Synthetic peptide
DEQEIRTTNPVATEQWGSVSENEQMRGNM

SEQ ID NO: 33161 - protein, 31 aa, Artificial Sequence
  Description of Artificial Sequence: Synthetic polypeptide
DEEEIRTTNPEATEQYGSVSTENDVQREGER

SEQ ID NO: 33162 - protein, 30 aa, Artificial Sequence
  Description of Artificial Sequence: Synthetic polypeptide
NEEEIRTTNPVATEQYGSVSAWNLDEFGNR

SEQ ID NO: 33163 - protein, 31 aa, Artificial Sequence
  Description of Artificial Sequence: Synthetic polypeptide
DEEEIRTTNPVATEQYGSVSTDLELRNGNDT

SEQ ID NO: 33164 - protein, 32 aa, Artificial Sequence
  Description of Artificial Sequence: Synthetic polypeptide
DEEEIRTTNPVATEQYGESVCDTNDQRNGNPR

SEQ ID NO: 33165 - protein, 29 aa, Artificial Sequence
  Description of Artificial Sequence: Synthetic peptide
DEEEIRTTNPVATEQYGDVSENLMGGDDR

SEQ ID NO: 33166 - protein, 30 aa, Artificial Sequence
  Description of Artificial Sequence: Synthetic polypeptide
DEEEIRTTNPDATEQYGSVSTLNEQSGNPI

SEQ ID NO: 33167 - protein, 28 aa, Artificial Sequence
  Description of Artificial Sequence: Synthetic peptide
KEEEIRTTNPVATECYGSVSEDLQIGNN

SEQ ID NO: 33168 - protein, 28 aa, Artificial Sequence
  Description of Artificial Sequence: Synthetic peptide
SEEEIRTTNPVATQCYGSVATGLDRGNR

SEQ ID NO: 33169 - protein, 31 aa, Artificial Sequence
  Description of Artificial Sequence: Synthetic polypeptide
MEEEIRTTNPVATEQYGSVSTNLQDNEGNDM

SEQ ID NO: 33170 - protein, 30 aa, Artificial Sequence
  Description of Artificial Sequence: Synthetic polypeptide
DEEEIATTNPVATEQYGSVSTNLQELEGED

SEQ ID NO: 33171 - protein, 29 aa, Artificial Sequence
  Description of Artificial Sequence: Synthetic peptide
DEEEIATTNPVATEQYGSVSTELQTGDDF

SEQ ID NO: 33172 - protein, 28 aa, Artificial Sequence
  Description of Artificial Sequence: Synthetic peptide
DEEEIRTTNPVATEQYGSVSDPDQNDNI

SEQ ID NO: 33173 - protein, 30 aa, Artificial Sequence
  Description of Artificial Sequence: Synthetic polypeptide
DEEEIATTNPVATEQYGSVDTDQQRGENDR

SEQ ID NO: 33174 - protein, 31 aa, Artificial Sequence
  Description of Artificial Sequence: Synthetic polypeptide
DEQEIRTTNPVATEQYGYVDSTGNLPQRGNV

SEQ ID NO: 33175 - protein, 31 aa, Artificial Sequence
  Description of Artificial Sequence: Synthetic polypeptide
DEEEIRTTNPVATEQYGSVDSTNDQRGDDDQ

SEQ ID NO: 33176 - protein, 31 aa, Artificial Sequence
  Description of Artificial Sequence: Synthetic polypeptide
DEEEIRTTNPVATEQYGSVSTMDPLQIREER

SEQ ID NO: 33177 - protein, 31 aa, Artificial Sequence
  Description of Artificial Sequence: Synthetic polypeptide
DEEEIRTTNPVATEQYGSVSDANLPQHGNQV

SEQ ID NO: 33178 - protein, 30 aa, Artificial Sequence
  Description of Artificial Sequence: Synthetic polypeptide
DEEEIRTTNPVATELYGSVSTGNEPQLGTR

SEQ ID NO: 33179 - protein, 28 aa, Artificial Sequence
  Description of Artificial Sequence: Synthetic peptide
IEQEIRTTNPVATEQYGTVSDNLEHGNR

SEQ ID NO: 33180 - protein, 28 aa, Artificial Sequence
  Description of Artificial Sequence: Synthetic peptide
SEDEIYTTNPTGTEQYGSVSTNLQHGNR

SEQ ID NO: 33181 - protein, 28 aa, Artificial Sequence
  Description of Artificial Sequence: Synthetic peptide
YEAEIITTNPVATEQYGEVANNLQRGNR

SEQ ID NO: 33182 - protein, 30 aa, Artificial Sequence
  Description of Artificial Sequence: Synthetic polypeptide
DEEEIRTTNPVAYEQFGMSVEETNLDRGNR

SEQ ID NO: 33183 - protein, 29 aa, Artificial Sequence
  Description of Artificial Sequence: Synthetic peptide
MEEEIITTNPVATEQYGYVSDNLQGAGNR

SEQ ID NO: 33184 - protein, 28 aa, Artificial Sequence
  Description of Artificial Sequence: Synthetic peptide
DEEEIRGTNPVATECYGSVSTELQDGEN

SEQ ID NO: 33185 - protein, 31 aa, Artificial Sequence
  Description of Artificial Sequence: Synthetic polypeptide
DENEIRQTNPVATEQYGSVDSTNLQRNGNDD

SEQ ID NO: 33186 - protein, 30 aa, Artificial Sequence
  Description of Artificial Sequence: Synthetic polypeptide
DEQEIRTTNPCATETYGSVSTNLEFREGNR

SEQ ID NO: 33187 - protein, 30 aa, Artificial Sequence
  Description of Artificial Sequence: Synthetic polypeptide
DEQEIVTTNPVATEQYGSVETNLVQRGNDD

SEQ ID NO: 33188 - protein, 31 aa, Artificial Sequence
  Description of Artificial Sequence: Synthetic polypeptide
DEEEIRTTNPVATEQYGSVSCTEDQERFGNA

SEQ ID NO: 33189 - protein, 28 aa, Artificial Sequence
  Description of Artificial Sequence: Synthetic peptide
DEEEICTTNPVATEHYGSVSEDLQDGNW

SEQ ID NO: 33190 - protein, 28 aa, Artificial Sequence
  Description of Artificial Sequence: Synthetic peptide
GEDEIRTTNPVATELYGSVSTNLQSGEV

SEQ ID NO: 33191 - protein, 31 aa, Artificial Sequence
  Description of Artificial Sequence: Synthetic polypeptide
DEQEIRTTNPVATEQYGSVDSTPPLQAKGNR

SEQ ID NO: 33192 - protein, 29 aa, Artificial Sequence
  Description of Artificial Sequence: Synthetic peptide
DEEEIRTTNPVATEQYGSASDDLQMGNDN

SEQ ID NO: 33193 - protein, 28 aa, Artificial Sequence
  Description of Artificial Sequence: Synthetic peptide
QEEEITATNPVATEQYGSVSTNLQLGED

SEQ ID NO: 33194 - protein, 28 aa, Artificial Sequence
  Description of Artificial Sequence: Synthetic peptide
DEEEIRCTNPVSTEQYGDTSTNLQLGNQ

SEQ ID NO: 33195 - protein, 28 aa, Artificial Sequence
  Description of Artificial Sequence: Synthetic peptide
DQAEIRTTNPVATEQYGCCSTVLQHGNR

SEQ ID NO: 33196 - protein, 30 aa, Artificial Sequence
  Description of Artificial Sequence: Synthetic polypeptide
SEEEIRTTNPVATETYGEVSTNLQREGDDR

SEQ ID NO: 33197 - protein, 31 aa, Artificial Sequence
  Description of Artificial Sequence: Synthetic polypeptide
DEEEISTTNPVATEQYGSIYSTNLQFHAGNR

SEQ ID NO: 33198 - protein, 28 aa, Artificial Sequence
  Description of Artificial Sequence: Synthetic peptide
QECEIRTTNPCATEQFGSVSTNLQPGND

SEQ ID NO: 33199 - protein, 31 aa, Artificial Sequence
  Description of Artificial Sequence: Synthetic polypeptide
DEEEIRTTNPVATEQYGSVDCTMELQEMGNR

SEQ ID NO: 33200 - protein, 31 aa, Artificial Sequence
  Description of Artificial Sequence: Synthetic polypeptide
DEEEIRTTNPVATEQYGSVSETNLEEDGNEE

SEQ ID NO: 33201 - protein, 28 aa, Artificial Sequence
  Description of Artificial Sequence: Synthetic peptide
DENEISTTNPVSTEQYGSVSTNCQHENR

SEQ ID NO: 33202 - protein, 28 aa, Artificial Sequence
  Description of Artificial Sequence: Synthetic peptide
DDQEIRTTNPVATECYGSVSTDLQLGNN

SEQ ID NO: 33203 - protein, 28 aa, Artificial Sequence
  Description of Artificial Sequence: Synthetic peptide
DENEIRCTNPVATEQYGIVSDNLQTGNW

SEQ ID NO: 33204 - protein, 30 aa, Artificial Sequence
  Description of Artificial Sequence: Synthetic polypeptide
DEEEIRTTNPVATEMFGSVSTNEQDREGNF

SEQ ID NO: 33205 - protein, 31 aa, Artificial Sequence
  Description of Artificial Sequence: Synthetic polypeptide
DEEEIRTTNPVATEQYGSVSTPNPLFIDGER

SEQ ID NO: 33206 - protein, 30 aa, Artificial Sequence
  Description of Artificial Sequence: Synthetic polypeptide
DEEEIRTTNPVATEQYGEMSTNLEDRGDDR

SEQ ID NO: 33207 - protein, 29 aa, Artificial Sequence
  Description of Artificial Sequence: Synthetic peptide
DEEEISTTNPVATEQYGDVSCTDDQRGNV

SEQ ID NO: 33208 - protein, 32 aa, Artificial Sequence
  Description of Artificial Sequence: Synthetic polypeptide
DEEEIRTTNPDATEQYGSVSTNPLVDREGDNR

SEQ ID NO: 33209 - protein, 29 aa, Artificial Sequence
  Description of Artificial Sequence: Synthetic peptide
DEEEIATTNPVATECYGSVSTDLQRNGEL

SEQ ID NO: 33210 - protein, 28 aa, Artificial Sequence
  Description of Artificial Sequence: Synthetic peptide
DEEEIRTTNPVATEQYGSVSTAEEVGDY

SEQ ID NO: 33211 - protein, 28 aa, Artificial Sequence
  Description of Artificial Sequence: Synthetic peptide
DEQEIRTTNPVSTEQYGSVSENEMRGNF

SEQ ID NO: 33212 - protein, 28 aa, Artificial Sequence
  Description of Artificial Sequence: Synthetic peptide
DEEEIRTTNPVATEQYGSVETNLDGEEP

SEQ ID NO: 33213 - protein, 31 aa, Artificial Sequence
  Description of Artificial Sequence: Synthetic polypeptide
SEEEIATTNPVATEQYGSVSTNLQERGDTTR

SEQ ID NO: 33214 - protein, 32 aa, Artificial Sequence
  Description of Artificial Sequence: Synthetic polypeptide
DEEEIRTTNPVATEQYGSVSTEAMLQDRENER

SEQ ID NO: 33215 - protein, 28 aa, Artificial Sequence
  Description of Artificial Sequence: Synthetic peptide
DEQEIRTTNPVATEQYGSVSTDDEGGER

SEQ ID NO: 33216 - protein, 29 aa, Artificial Sequence
  Description of Artificial Sequence: Synthetic peptide
DEEEIRTTNPVAYEQYGSVSEHLQIGDNS

SEQ ID NO: 33217 - protein, 29 aa, Artificial Sequence
  Description of Artificial Sequence: Synthetic peptide
DEEEIRTTNPFATEQYGDVSTNLQLVGED

SEQ ID NO: 33218 - protein, 28 aa, Artificial Sequence
  Description of Artificial Sequence: Synthetic peptide
DEEEIVTTNPMATETYGTVSTNLQNGNA

SEQ ID NO: 33219 - protein, 30 aa, Artificial Sequence
  Description of Artificial Sequence: Synthetic polypeptide
DENEIRTTNPVATEQYGSVSTNLEDAEGNI

SEQ ID NO: 33220 - protein, 32 aa, Artificial Sequence
  Description of Artificial Sequence: Synthetic polypeptide
DEEEIRTTNPVATEQYGSVSITNQVQNEGNDR

SEQ ID NO: 33221 - protein, 30 aa, Artificial Sequence
  Description of Artificial Sequence: Synthetic polypeptide
MEEEIRTTNPVATENYGSVSTMNLQDIGTR

SEQ ID NO: 33222 - protein, 31 aa, Artificial Sequence
  Description of Artificial Sequence: Synthetic polypeptide
DEEEIRTTNPVATEQYGSVESTDNLDMNGNN

SEQ ID NO: 33223 - protein, 30 aa, Artificial Sequence
  Description of Artificial Sequence: Synthetic polypeptide
DEQEIVTTNPVATEQYGSVSETNLQGEGNA

SEQ ID NO: 33224 - protein, 28 aa, Artificial Sequence
  Description of Artificial Sequence: Synthetic peptide
DEQEICCTNPVATEQYGSADTNLQMGNR

SEQ ID NO: 33225 - protein, 31 aa, Artificial Sequence
  Description of Artificial Sequence: Synthetic polypeptide
DEEEIRTTNPVATECYGSVSTDLEIRKGNDR

SEQ ID NO: 33226 - protein, 30 aa, Artificial Sequence
  Description of Artificial Sequence: Synthetic polypeptide
DEEEIRTTNPVSTELYGSVSTNLARNGDFR

SEQ ID NO: 33227 - protein, 28 aa, Artificial Sequence
  Description of Artificial Sequence: Synthetic peptide
DEEEIRATNPVATEQFGSVSTNEQQEDR

SEQ ID NO: 33228 - protein, 30 aa, Artificial Sequence
  Description of Artificial Sequence: Synthetic polypeptide
DEEEIRTTNPTATEQYGSVSTMNEQQGDNL

SEQ ID NO: 33229 - protein, 28 aa, Artificial Sequence
  Description of Artificial Sequence: Synthetic peptide
DEEEIRTTNPVATEQYGSVSEILMQGDA

SEQ ID NO: 33230 - protein, 28 aa, Artificial Sequence
  Description of Artificial Sequence: Synthetic peptide
DEEEIRATNPVATEQYGPVSTNLMSGLE

SEQ ID NO: 33231 - protein, 28 aa, Artificial Sequence
  Description of Artificial Sequence: Synthetic peptide
DEEEIRTTNPVATEQFGEVSNNPQFGNG

SEQ ID NO: 33232 - protein, 31 aa, Artificial Sequence
  Description of Artificial Sequence: Synthetic polypeptide
DEEEIRTTNPVATEQYGSYVSITIEQQHGNR

SEQ ID NO: 33233 - protein, 32 aa, Artificial Sequence
  Description of Artificial Sequence: Synthetic polypeptide
DEEEIRTTNPVATEQYGSVSETNLEEREGENE

SEQ ID NO: 33234 - protein, 29 aa, Artificial Sequence
  Description of Artificial Sequence: Synthetic peptide
DEAEIRQTNPVATEGYGSVSTTLQSRGGR

SEQ ID NO: 33235 - protein, 28 aa, Artificial Sequence
  Description of Artificial Sequence: Synthetic peptide
DEEEIKCTNPVSTEQYGSVPTNLQRLQR

SEQ ID NO: 33236 - protein, 28 aa, Artificial Sequence
  Description of Artificial Sequence: Synthetic peptide
QEEEIRATNPVATEMYGSVSTDLQSGDR

SEQ ID NO: 33237 - protein, 29 aa, Artificial Sequence
  Description of Artificial Sequence: Synthetic peptide
NEQEIRTTNPVATEQYGSVSMNLQLFGND

SEQ ID NO: 33238 - protein, 30 aa, Artificial Sequence
  Description of Artificial Sequence: Synthetic polypeptide
DEEEIRTTNPVATEQYGSVSTIGDQREGEA

SEQ ID NO: 33239 - protein, 29 aa, Artificial Sequence
  Description of Artificial Sequence: Synthetic peptide
DEEEIRTTNPVATECYGSVSTELEVGEDR

SEQ ID NO: 33240 - protein, 29 aa, Artificial Sequence
  Description of Artificial Sequence: Synthetic peptide
DEEEIMTTNPVATEQYGSVSANPQLGNDL

SEQ ID NO: 33241 - protein, 30 aa, Artificial Sequence
  Description of Artificial Sequence: Synthetic polypeptide
DEEEIRTVNPVATEQYGSVSENLQDYGNDL

SEQ ID NO: 33242 - protein, 28 aa, Artificial Sequence
  Description of Artificial Sequence: Synthetic peptide
DEEVIRTTNPVATATYGSVFTDLQHGNR

SEQ ID NO: 33243 - protein, 31 aa, Artificial Sequence
  Description of Artificial Sequence: Synthetic polypeptide
DEEEIRTTNPVATEQYGSVSTNLEEVEGEDR

SEQ ID NO: 33244 - protein, 28 aa, Artificial Sequence
  Description of Artificial Sequence: Synthetic peptide
DEQEIRTTNPVATEQYGSVAEDLQVGNM

SEQ ID NO: 33245 - protein, 31 aa, Artificial Sequence
  Description of Artificial Sequence: Synthetic polypeptide
DEEEIRTTNPVATEQYGSVETLPLQDLGDNR

SEQ ID NO: 33246 - protein, 30 aa, Artificial Sequence
  Description of Artificial Sequence: Synthetic polypeptide
DEQEITTTNPVATEQYGSVSEMDLQRGNDR

SEQ ID NO: 33247 - protein, 30 aa, Artificial Sequence
  Description of Artificial Sequence: Synthetic polypeptide
DEEEISATNPVATEQYGSVSTVLQRDMVNR

SEQ ID NO: 33248 - protein, 29 aa, Artificial Sequence
  Description of Artificial Sequence: Synthetic peptide
DEEEIRATNPVATEMYGSVSTNEPQQGNF

SEQ ID NO: 33249 - protein, 30 aa, Artificial Sequence
  Description of Artificial Sequence: Synthetic polypeptide
DEEEIRTTNPVATDQYGSCSTDPQRDGNDR

SEQ ID NO: 33250 - protein, 28 aa, Artificial Sequence
  Description of Artificial Sequence: Synthetic peptide
DEEEIRCTNPVATEWYGSVSTNLEIGDL

SEQ ID NO: 33251 - protein, 28 aa, Artificial Sequence
  Description of Artificial Sequence: Synthetic peptide
DEEEIRTTNPVATECWGSYDTNDERGNR

SEQ ID NO: 33252 - protein, 30 aa, Artificial Sequence
  Description of Artificial Sequence: Synthetic polypeptide
DEEEIRTTNPVATEIYGSVAAMNLQVEGNR

SEQ ID NO: 33253 - protein, 32 aa, Artificial Sequence
  Description of Artificial Sequence: Synthetic polypeptide
DEEEIRTTNPVATEQYGVTCSDTNLQRGENDR

SEQ ID NO: 33254 - protein, 28 aa, Artificial Sequence
  Description of Artificial Sequence: Synthetic peptide
SEEEIRTTNPAATEQFGSVSTNEQRGTG

SEQ ID NO: 33255 - protein, 28 aa, Artificial Sequence
  Description of Artificial Sequence: Synthetic peptide
DTEEIRTTNPVATEWWGSVHTNDQDGNR

SEQ ID NO: 33256 - protein, 30 aa, Artificial Sequence
  Description of Artificial Sequence: Synthetic polypeptide
DENEIATTNPVATEQYGSVSTENLEDHGNR

SEQ ID NO: 33257 - protein, 32 aa, Artificial Sequence
  Description of Artificial Sequence: Synthetic polypeptide
DEEEIRTTNPVATEQYGSVSTANEQEIEGNDR

SEQ ID NO: 33258 - protein, 29 aa, Artificial Sequence
  Description of Artificial Sequence: Synthetic peptide
NEEEIATTNPVSTEQFGSVSTNLQRGENF

SEQ ID NO: 33259 - protein, 28 aa, Artificial Sequence
  Description of Artificial Sequence: Synthetic peptide
DEEEIRTTNPVATEVYGVVSTDLQGGEA

SEQ ID NO: 33260 - protein, 32 aa, Artificial Sequence
  Description of Artificial Sequence: Synthetic polypeptide
DEEEIRTTNPVATEQYGSVSTEELQQAGENDR

SEQ ID NO: 33261 - protein, 31 aa, Artificial Sequence
  Description of Artificial Sequence: Synthetic polypeptide
DEEEIRTTNPVATEQYGSVSTVGLTDERGER

SEQ ID NO: 33262 - protein, 30 aa, Artificial Sequence
  Description of Artificial Sequence: Synthetic polypeptide
AEEEIRTTNPVATEQYGSVSENGQQRGEER

SEQ ID NO: 33263 - protein, 31 aa, Artificial Sequence
  Description of Artificial Sequence: Synthetic polypeptide
DEEEIRTTNPVATECYGSSYVSHNDVQRGNR

SEQ ID NO: 33264 - protein, 29 aa, Artificial Sequence
  Description of Artificial Sequence: Synthetic peptide
MEEEIRTTNPVATEQYGSVSYDLQDHGNF

SEQ ID NO: 33265 - protein, 30 aa, Artificial Sequence
  Description of Artificial Sequence: Synthetic polypeptide
DETEIRTTNPVATEQYGSVSCNLQDVEGNF

SEQ ID NO: 33266 - protein, 30 aa, Artificial Sequence
  Description of Artificial Sequence: Synthetic polypeptide
DEEEIRATNPVATEQYGSVCSTENDQRGDY

SEQ ID NO: 33267 - protein, 30 aa, Artificial Sequence
  Description of Artificial Sequence: Synthetic polypeptide
SEEEIRTTNPIATEQYGSVTSTNLQWGDNN

SEQ ID NO: 33268 - protein, 30 aa, Artificial Sequence
  Description of Artificial Sequence: Synthetic polypeptide
DCVEIRTTNPVATEQYGSVSATNLQHGNDA

SEQ ID NO: 33269 - protein, 31 aa, Artificial Sequence
  Description of Artificial Sequence: Synthetic polypeptide
HEEEIRTTNPVATEQYGSVSTLNLDQPGNYE

SEQ ID NO: 33270 - protein, 28 aa, Artificial Sequence
  Description of Artificial Sequence: Synthetic peptide
DEEEICTTNPVCTEQWGSTSTQLQRENR

SEQ ID NO: 33271 - protein, 28 aa, Artificial Sequence
  Description of Artificial Sequence: Synthetic peptide
QESEIRTTNPVSTEQYGSASTVLQRGGR

SEQ ID NO: 33272 - protein, 30 aa, Artificial Sequence
  Description of Artificial Sequence: Synthetic polypeptide
DEEEIRTTNPVATEQYGSVSTNDQDLKGEI

SEQ ID NO: 33273 - protein, 31 aa, Artificial Sequence
  Description of Artificial Sequence: Synthetic polypeptide
DEEEIRTTNPVATECYGSVSTNLQITEGEDR

SEQ ID NO: 33274 - protein, 28 aa, Artificial Sequence
  Description of Artificial Sequence: Synthetic peptide
DEEEIRTTNPFATEQYGSVSTGLWDGEN

SEQ ID NO: 33275 - protein, 28 aa, Artificial Sequence
  Description of Artificial Sequence: Synthetic peptide
DEEEIRTTNPVSTENYGSVSTAEQEGNM

SEQ ID NO: 33276 - protein, 28 aa, Artificial Sequence
  Description of Artificial Sequence: Synthetic peptide
SEEEIRTTNPVATEQYGSVATDDQFENR

SEQ ID NO: 33277 - protein, 31 aa, Artificial Sequence
  Description of Artificial Sequence: Synthetic polypeptide
DEEEIATTNPVATEQYGSVSTNLQIFNGVNN

SEQ ID NO: 33278 - protein, 28 aa, Artificial Sequence
  Description of Artificial Sequence: Synthetic peptide
MENEIRTTNPVATEVYGSVSTNLQHGEM

SEQ ID NO: 33279 - protein, 31 aa, Artificial Sequence
  Description of Artificial Sequence: Synthetic polypeptide
DEEEIRTTNPVATECYGSVSATNLQDVNGER

SEQ ID NO: 33280 - protein, 31 aa, Artificial Sequence
  Description of Artificial Sequence: Synthetic polypeptide
SEEEIRTTNPVATEQWGSVSTNLNMRGLNNR

SEQ ID NO: 33281 - protein, 29 aa, Artificial Sequence
  Description of Artificial Sequence: Synthetic peptide
CEEEIRTTNPVATEVYGSVSENLQELGNM

SEQ ID NO: 33282 - protein, 28 aa, Artificial Sequence
  Description of Artificial Sequence: Synthetic peptide
DEQEIRATNPVATEMYGSVAMNLERGNR

SEQ ID NO: 33283 - protein, 28 aa, Artificial Sequence
  Description of Artificial Sequence: Synthetic peptide
SEEEIRTTNPCATEMFGSVSTNLERGND

SEQ ID NO: 33284 - protein, 32 aa, Artificial Sequence
  Description of Artificial Sequence: Synthetic polypeptide
DEEEIRTTNPVATECYGISVESTNLVDERGNR

SEQ ID NO: 33285 - protein, 31 aa, Artificial Sequence
  Description of Artificial Sequence: Synthetic polypeptide
DEEEIRTTNPVATEQYGSVDSTPLQEEGNEV

SEQ ID NO: 33286 - protein, 29 aa, Artificial Sequence
  Description of Artificial Sequence: Synthetic peptide
DEEEIRATNPVASEQFGSVSTNEQRGDTR

SEQ ID NO: 33287 - protein, 32 aa, Artificial Sequence
  Description of Artificial Sequence: Synthetic polypeptide
SEEEIRTTNPVATEQFGSVISTNLQDRGVNDR

SEQ ID NO: 33288 - protein, 29 aa, Artificial Sequence
  Description of Artificial Sequence: Synthetic peptide
DENEIATTNPVATEIYGSVSATNLERGNT

SEQ ID NO: 33289 - protein, 29 aa, Artificial Sequence
  Description of Artificial Sequence: Synthetic peptide
DEQEVRTTNPIATEIYGSVATNLQRNGNR

SEQ ID NO: 33290 - protein, 28 aa, Artificial Sequence
  Description of Artificial Sequence: Synthetic peptide
DEEEIRTTNPEATEQYGSVSTDEQLGEN

SEQ ID NO: 33291 - protein, 32 aa, Artificial Sequence
  Description of Artificial Sequence: Synthetic polypeptide
DEEEIRTTNPVATEQYGSVSDTTNPDTERGNR

SEQ ID NO: 33292 - protein, 29 aa, Artificial Sequence
  Description of Artificial Sequence: Synthetic peptide
VEEEIRTVNPVATEQYGSVSENLQFSGPR

SEQ ID NO: 33293 - protein, 28 aa, Artificial Sequence
  Description of Artificial Sequence: Synthetic peptide
DENEIATTNPVATECYGSVSTNLQTGEE

SEQ ID NO: 33294 - protein, 28 aa, Artificial Sequence
  Description of Artificial Sequence: Synthetic peptide
DEEEIRQTNPVATEQYGVVSEDQQDGNR

SEQ ID NO: 33295 - protein, 28 aa, Artificial Sequence
  Description of Artificial Sequence: Synthetic peptide
DEEEIRCTNPVCTEQYGNVSTNLERGDM

SEQ ID NO: 33296 - protein, 28 aa, Artificial Sequence
  Description of Artificial Sequence: Synthetic peptide
DEEEIYTTNPVCTEHWGSVSSNLQRGNI

SEQ ID NO: 33297 - protein, 28 aa, Artificial Sequence
  Description of Artificial Sequence: Synthetic peptide
DEEEITATNPVATEQFGEVSTNPQRGNA

SEQ ID NO: 33298 - protein, 28 aa, Artificial Sequence
  Description of Artificial Sequence: Synthetic peptide
DEEQIRTTNPVAFEQYGSVSDNLHPGSR

SEQ ID NO: 33299 - protein, 28 aa, Artificial Sequence
  Description of Artificial Sequence: Synthetic peptide
DENEIRSTNPVATEQYGDVSDNLQIGDR

SEQ ID NO: 33300 - protein, 28 aa, Artificial Sequence
  Description of Artificial Sequence: Synthetic peptide
DEEEIRTTNPFATEQYGVVSTNQEVGND

SEQ ID NO: 33301 - protein, 28 aa, Artificial Sequence
  Description of Artificial Sequence: Synthetic peptide
DEEEIRTTNPVATEQYGSVDTDDERGED

SEQ ID NO: 33302 - protein, 31 aa, Artificial Sequence
  Description of Artificial Sequence: Synthetic polypeptide
DEEEIRTTNPVATEQYGSVSTDLERNGENDD

SEQ ID NO: 33303 - protein, 29 aa, Artificial Sequence
  Description of Artificial Sequence: Synthetic peptide
DEEEIRTTNPFATEQYGSVSTGNPEDGNP

SEQ ID NO: 33304 - protein, 31 aa, Artificial Sequence
  Description of Artificial Sequence: Synthetic polypeptide
DEEEIRTTNPVATEQYGSVSITNLEINGNDQ

SEQ ID NO: 33305 - protein, 28 aa, Artificial Sequence
  Description of Artificial Sequence: Synthetic peptide
DEEEIRTTNPCATEQYGSVSTDDEAGNM

SEQ ID NO: 33306 - protein, 28 aa, Artificial Sequence
  Description of Artificial Sequence: Synthetic peptide
DEEEIRTTNPVATEQYGSVETAEDEENR

SEQ ID NO: 33307 - protein, 28 aa, Artificial Sequence
  Description of Artificial Sequence: Synthetic peptide
NEDEIRTTNPFATEQYGSVSTNLQAGED

SEQ ID NO: 33308 - protein, 28 aa, Artificial Sequence
  Description of Artificial Sequence: Synthetic peptide
DEEEIATTNPVATEQYGSASEDLQHENR

SEQ ID NO: 33309 - protein, 31 aa, Artificial Sequence
  Description of Artificial Sequence: Synthetic polypeptide
DEEEIRTTNPVATEQYGSVSTDLQDRGDEET

SEQ ID NO: 33310 - protein, 32 aa, Artificial Sequence
  Description of Artificial Sequence: Synthetic polypeptide
DEEEIRTTNPDATEQYGSVSETINLQDPNGNR

SEQ ID NO: 33311 - protein, 30 aa, Artificial Sequence
  Description of Artificial Sequence: Synthetic polypeptide
DENEIRTTNPVATEQYGSVSTDQQLRGNDD

SEQ ID NO: 33312 - protein, 30 aa, Artificial Sequence
  Description of Artificial Sequence: Synthetic polypeptide
DEEEIRTTNPCATELYGSVSTNLQQYNGNL

SEQ ID NO: 33313 - protein, 30 aa, Artificial Sequence
  Description of Artificial Sequence: Synthetic polypeptide
DEQEIRCTNPVATEVYGAVSATNLQREGNR

SEQ ID NO: 33314 - protein, 28 aa, Artificial Sequence
  Description of Artificial Sequence: Synthetic peptide
SEEEIRTTNPVATEKWGSWSTNLMTGNR

SEQ ID NO: 33315 - protein, 28 aa, Artificial Sequence
  Description of Artificial Sequence: Synthetic peptide
DEEEITTTNPVATEQYGDVSTDDQHGNA

SEQ ID NO: 33316 - protein, 28 aa, Artificial Sequence
  Description of Artificial Sequence: Synthetic peptide
SEVEIRTTNPTATEQFGSVSTNEQQGNR

SEQ ID NO: 33317 - protein, 31 aa, Artificial Sequence
  Description of Artificial Sequence: Synthetic polypeptide
DEEEIRTTNPVATEQYGESVSATDDERGDNR

SEQ ID NO: 33318 - protein, 30 aa, Artificial Sequence
  Description of Artificial Sequence: Synthetic polypeptide
DEEEIATTNPVATEQYGSVDSTTDQQVGNR

SEQ ID NO: 33319 - protein, 30 aa, Artificial Sequence
  Description of Artificial Sequence: Synthetic polypeptide
DENEIRTTNPVATECYGSVSTNLEREGENW

SEQ ID NO: 33320 - protein, 31 aa, Artificial Sequence
  Description of Artificial Sequence: Synthetic polypeptide
DEEEIRTTNPVATEQYGSVHTTNNPLDRDNR

SEQ ID NO: 33321 - protein, 28 aa, Artificial Sequence
  Description of Artificial Sequence: Synthetic peptide
DEEEIRTTNPDATEQYGSVSTDLEDGDS

SEQ ID NO: 33322 - protein, 28 aa, Artificial Sequence
  Description of Artificial Sequence: Synthetic peptide
DEEEIATTNPVATEQYGSVSEDQEVGNR

SEQ ID NO: 33323 - protein, 28 aa, Artificial Sequence
  Description of Artificial Sequence: Synthetic peptide
DDEEIRTTNPVSTECFGCVSTNLQRGNY

SEQ ID NO: 33324 - protein, 28 aa, Artificial Sequence
  Description of Artificial Sequence: Synthetic peptide
DEHEIRTTNPVATEQYGDVSEDLQQGNM

SEQ ID NO: 33325 - protein, 31 aa, Artificial Sequence
  Description of Artificial Sequence: Synthetic polypeptide
DEEAIVTTNPVATEQYGSVESTNLDRNGDNR

SEQ ID NO: 33326 - protein, 30 aa, Artificial Sequence
  Description of Artificial Sequence: Synthetic polypeptide
DEVEIRTTNPVATEQYGEVSATVLQHGNYR

SEQ ID NO: 33327 - protein, 28 aa, Artificial Sequence
  Description of Artificial Sequence: Synthetic peptide
DEEEISCTNPVATEIYGSVSENLQMGNF

SEQ ID NO: 33328 - protein, 31 aa, Artificial Sequence
  Description of Artificial Sequence: Synthetic polypeptide
DEEEIRTTNPVATEQYGSVDDTDEQRGDNDR

SEQ ID NO: 33329 - protein, 28 aa, Artificial Sequence
  Description of Artificial Sequence: Synthetic peptide
DEEEISTTNPVATELYGEVATNLDAGNR

SEQ ID NO: 33330 - protein, 29 aa, Artificial Sequence
  Description of Artificial Sequence: Synthetic peptide
DEQEIRTTNPVATECYGSVSTDLQHEGNL

SEQ ID NO: 33331 - protein, 30 aa, Artificial Sequence
  Description of Artificial Sequence: Synthetic polypeptide
KEEEIRTTNPVATECYGSVSTNLQEIGEDR

SEQ ID NO: 33332 - protein, 28 aa, Artificial Sequence
  Description of Artificial Sequence: Synthetic peptide
DEEEIRCTNPVSTEQWGSVSTNLQIGTF

SEQ ID NO: 33333 - protein, 28 aa, Artificial Sequence
  Description of Artificial Sequence: Synthetic peptide
DDEEVRTTNPVAYELYGCVSTNLQPGNR

SEQ ID NO: 33334 - protein, 30 aa, Artificial Sequence
  Description of Artificial Sequence: Synthetic polypeptide
DEEEIRTTNPIATEQWGIVSTNFLQDGGNR

SEQ ID NO: 33335 - protein, 28 aa, Artificial Sequence
  Description of Artificial Sequence: Synthetic peptide
DEEEIRTTNPVATEQWGSVDTNDETGNM

SEQ ID NO: 33336 - protein, 28 aa, Artificial Sequence
  Description of Artificial Sequence: Synthetic peptide
DENEIATTNPVATECYGSVSTDLQHGND

SEQ ID NO: 33337 - protein, 28 aa, Artificial Sequence
  Description of Artificial Sequence: Synthetic peptide
DEQEVRCTNPVATEQYGCVSMNLERGNR

SEQ ID NO: 33338 - protein, 29 aa, Artificial Sequence
  Description of Artificial Sequence: Synthetic peptide
KEEEIRTTNPVATEQYGSVSTELQEQGDV

SEQ ID NO: 33339 - protein, 28 aa, Artificial Sequence
  Description of Artificial Sequence: Synthetic peptide
NEEELRTTNPVATEQYGTVGNNCQRGNR

SEQ ID NO: 33340 - protein, 28 aa, Artificial Sequence
  Description of Artificial Sequence: Synthetic peptide
DENEIRQTNPVATEQYGVVSTNQEVGNR

SEQ ID NO: 33341 - protein, 30 aa, Artificial Sequence
  Description of Artificial Sequence: Synthetic polypeptide
DEEEIRCTNPVATEQYGSVSTNLEEPNGNT

SEQ ID NO: 33342 - protein, 32 aa, Artificial Sequence
  Description of Artificial Sequence: Synthetic polypeptide
DEEEIRTTNPVATEQYGSVSTNLELRNGENDD

SEQ ID NO: 33343 - protein, 30 aa, Artificial Sequence
  Description of Artificial Sequence: Synthetic polypeptide
DEEEITSTNPVATEQYGNVSTLNLQRGNPT

SEQ ID NO: 33344 - protein, 30 aa, Artificial Sequence
  Description of Artificial Sequence: Synthetic polypeptide
DEEEIRTTNPVATEQYGSVSETPLDPNGNN

SEQ ID NO: 33345 - protein, 30 aa, Artificial Sequence
  Description of Artificial Sequence: Synthetic polypeptide
DEEEIRTTNPVATEQYGSVSTDGLEREENF

SEQ ID NO: 33346 - protein, 32 aa, Artificial Sequence
  Description of Artificial Sequence: Synthetic polypeptide
DEEEIRTTNPDATEQYGSVSTNPLVEREGENR

SEQ ID NO: 33347 - protein, 28 aa, Artificial Sequence
  Description of Artificial Sequence: Synthetic peptide
DEEEVRQTNPVSTEQYGSVSTNCQHGNK

SEQ ID NO: 33348 - protein, 28 aa, Artificial Sequence
  Description of Artificial Sequence: Synthetic peptide
DEEEIRTTNPFATEQYGSVSDNLLGENF

SEQ ID NO: 33349 - protein, 29 aa, Artificial Sequence
  Description of Artificial Sequence: Synthetic peptide
DEEEIRTTNPVATEQWGIVSTNLQWVGDS

SEQ ID NO: 33350 - protein, 28 aa, Artificial Sequence
  Description of Artificial Sequence: Synthetic peptide
GEEEIRTTNPVATEQYGSVSMDLQHGEE

SEQ ID NO: 33351 - protein, 28 aa, Artificial Sequence
  Description of Artificial Sequence: Synthetic peptide
DEEEIRTTNPTATEQFGTVSTNLQSGDV

SEQ ID NO: 33352 - protein, 31 aa, Artificial Sequence
  Description of Artificial Sequence: Synthetic polypeptide
QEDEIRTTNPVATEQYGSVDSATNLQERGNF

SEQ ID NO: 33353 - protein, 30 aa, Artificial Sequence
  Description of Artificial Sequence: Synthetic polypeptide
DEDEIRCTNPVATETYGSVSTNMLQRGDNF

SEQ ID NO: 33354 - protein, 29 aa, Artificial Sequence
  Description of Artificial Sequence: Synthetic peptide
DEEEIRTTNPVSTEQYGWVSTNEQQQGDR

SEQ ID NO: 33355 - protein, 33 aa, Artificial Sequence
  Description of Artificial Sequence: Synthetic polypeptide
DEEEIRTTNPDATEQYGSVSDTNLVQLREGNDR

SEQ ID NO: 33356 - protein, 29 aa, Artificial Sequence
  Description of Artificial Sequence: Synthetic peptide
DEEEIRTTNPVATECWGSVSTNLMMQGNM

SEQ ID NO: 33357 - protein, 32 aa, Artificial Sequence
  Description of Artificial Sequence: Synthetic polypeptide
DEEEIRTTNPVATEQYGSVSTMNLQELGDNDQ

SEQ ID NO: 33358 - protein, 29 aa, Artificial Sequence
  Description of Artificial Sequence: Synthetic peptide
DEEEIRTTNPVCTELYGSVSSNWQRNGNF

SEQ ID NO: 33359 - protein, 28 aa, Artificial Sequence
  Description of Artificial Sequence: Synthetic peptide
DESEIRSTNPVSTEQYGNVATNLQRGQR

SEQ ID NO: 33360 - protein, 29 aa, Artificial Sequence
  Description of Artificial Sequence: Synthetic peptide
DEEEIRTTNPVATEQYGSVSTADVDRGEI

SEQ ID NO: 33361 - protein, 31 aa, Artificial Sequence
  Description of Artificial Sequence: Synthetic polypeptide
DEEEIRTTNPVATEQYGSVSTEELQEINGNE

SEQ ID NO: 33362 - protein, 28 aa, Artificial Sequence
  Description of Artificial Sequence: Synthetic peptide
DEEEIKTTNPVSTEQYGSVWTNLDDGNA

SEQ ID NO: 33363 - protein, 28 aa, Artificial Sequence
  Description of Artificial Sequence: Synthetic peptide
DAEEIRPTNPVATEQYGSVSEGLQDMNR

SEQ ID NO: 33364 - protein, 30 aa, Artificial Sequence
  Description of Artificial Sequence: Synthetic polypeptide
YEEEIRTTNPVAYEQYGSVDCDNLQRGNDR

SEQ ID NO: 33365 - protein, 28 aa, Artificial Sequence
  Description of Artificial Sequence: Synthetic peptide
DEEEIRTTNPFATEQYGSVSTNPISGEP

SEQ ID NO: 33366 - protein, 31 aa, Artificial Sequence
  Description of Artificial Sequence: Synthetic polypeptide
DEEEIRTTNPVATEQYGSVSTNEQLNEGDNQ

SEQ ID NO: 33367 - protein, 31 aa, Artificial Sequence
  Description of Artificial Sequence: Synthetic polypeptide
DEEEIRTTNPVATEQYGSVETPDLQERGDER

SEQ ID NO: 33368 - protein, 28 aa, Artificial Sequence
  Description of Artificial Sequence: Synthetic peptide
DEEEIRTTNPVATEWYGSVDTNEMLGNM

SEQ ID NO: 33369 - protein, 28 aa, Artificial Sequence
  Description of Artificial Sequence: Synthetic peptide
DEEEIRTTNPFATEQYGSVSTELLDGES

SEQ ID NO: 33370 - protein, 28 aa, Artificial Sequence
  Description of Artificial Sequence: Synthetic peptide
DAEEIRTTNPVAYEQYGSVETGDQRGLR

SEQ ID NO: 33371 - protein, 32 aa, Artificial Sequence
  Description of Artificial Sequence: Synthetic polypeptide
DEQEIRTTNPVATEQYGSVSTENPLDERGENR

SEQ ID NO: 33372 - protein, 30 aa, Artificial Sequence
  Description of Artificial Sequence: Synthetic polypeptide
DEEEIRTTNPVATEQYGSVCSDNIQLGQDR

SEQ ID NO: 33373 - protein, 29 aa, Artificial Sequence
  Description of Artificial Sequence: Synthetic peptide
DEEEIATTNPVATECYGSVSTDLQHNGNQ

SEQ ID NO: 33374 - protein, 31 aa, Artificial Sequence
  Description of Artificial Sequence: Synthetic polypeptide
DEEEIRTTNPVATEQYGSVVDCTGLQCRGLR

SEQ ID NO: 33375 - protein, 31 aa, Artificial Sequence
  Description of Artificial Sequence: Synthetic polypeptide
DEEEIRTTNPVATECYGSVESTNIDQDPGNR

SEQ ID NO: 33376 - protein, 28 aa, Artificial Sequence
  Description of Artificial Sequence: Synthetic peptide
DENEIRTTNPVATMQYGSVSMNEQIGNM

SEQ ID NO: 33377 - protein, 28 aa, Artificial Sequence
  Description of Artificial Sequence: Synthetic peptide
SEEEIRTTNPVATEQYGSVSTDLEYENE

SEQ ID NO: 33378 - protein, 30 aa, Artificial Sequence
  Description of Artificial Sequence: Synthetic polypeptide
DEEEIRTVNPVATEQYGWVSTNLQIEGNDD

SEQ ID NO: 33379 - protein, 31 aa, Artificial Sequence
  Description of Artificial Sequence: Synthetic polypeptide
YEEEIRTTNPVATEIYGSVSTNLDIRGENPR

SEQ ID NO: 33380 - protein, 31 aa, Artificial Sequence
  Description of Artificial Sequence: Synthetic polypeptide
DEEEIATTNPVATEQFGSVSTMNLQRGDNDF

SEQ ID NO: 33381 - protein, 30 aa, Artificial Sequence
  Description of Artificial Sequence: Synthetic polypeptide
DEEEIRTTNPVATEQYGSAPATVLMRGPNR

SEQ ID NO: 33382 - protein, 29 aa, Artificial Sequence
  Description of Artificial Sequence: Synthetic peptide
DEEEIRTTNPVATELYGSVSENEQMTGNW

SEQ ID NO: 33383 - protein, 32 aa, Artificial Sequence
  Description of Artificial Sequence: Synthetic polypeptide
DEEEIRTTNPDATEQYGSVASITEDLQRNGNR

SEQ ID NO: 33384 - protein, 28 aa, Artificial Sequence
  Description of Artificial Sequence: Synthetic peptide
HEEEIRGTNPVATEQYGEVSTNEQRGTF

SEQ ID NO: 33385 - protein, 28 aa, Artificial Sequence
  Description of Artificial Sequence: Synthetic peptide
MEEEIRSTNPVATECYGSVSTNLQVGDA

SEQ ID NO: 33386 - protein, 28 aa, Artificial Sequence
  Description of Artificial Sequence: Synthetic peptide
DEGEIRQTNPVATEQYGEVSENLQHGMR

SEQ ID NO: 33387 - protein, 28 aa, Artificial Sequence
  Description of Artificial Sequence: Synthetic peptide
DEEEIRTTNPVATEQWGTSSDCLQRGMR

SEQ ID NO: 33388 - protein, 28 aa, Artificial Sequence
  Description of Artificial Sequence: Synthetic peptide
DEEEIRTTNPVATEQYGICSTNLEEGDD

SEQ ID NO: 33389 - protein, 31 aa, Artificial Sequence
  Description of Artificial Sequence: Synthetic polypeptide
DEEEIRTTNPVATEQYGSVDSTELERGDNEQ

SEQ ID NO: 33390 - protein, 28 aa, Artificial Sequence
  Description of Artificial Sequence: Synthetic peptide
DTEEIRTTNPYATEQWGSVHTGDQRGNR

SEQ ID NO: 33391 - protein, 28 aa, Artificial Sequence
  Description of Artificial Sequence: Synthetic peptide
DENEIRTTNPVATEQYGSVSECPQHGNL

SEQ ID NO: 33392 - protein, 30 aa, Artificial Sequence
  Description of Artificial Sequence: Synthetic polypeptide
EEEEIRTTNPVATEQYGIVISDNLQNGQNR

SEQ ID NO: 33393 - protein, 30 aa, Artificial Sequence
  Description of Artificial Sequence: Synthetic polypeptide
DENEIRTTNPVATEQYGVVDTMNLQQMGNR

SEQ ID NO: 33394 - protein, 29 aa, Artificial Sequence
  Description of Artificial Sequence: Synthetic peptide
DEEEIRTTNPVATEIYGSYSTNEMLRGTR

SEQ ID NO: 33395 - protein, 30 aa, Artificial Sequence
  Description of Artificial Sequence: Synthetic polypeptide
DEEEIRTTNPVGTEQWGSHVSDWNLQIGNR

SEQ ID NO: 33396 - protein, 31 aa, Artificial Sequence
  Description of Artificial Sequence: Synthetic polypeptide
DEEEIRTTNPVAWEQYGSVSTYFLTVRGDNR

SEQ ID NO: 33397 - protein, 28 aa, Artificial Sequence
  Description of Artificial Sequence: Synthetic peptide
DEEEIRTTNPVATEQYGWVSTWDFRPNP

SEQ ID NO: 33398 - protein, 30 aa, Artificial Sequence
  Description of Artificial Sequence: Synthetic polypeptide
DEEEIRTTNPVATEQYGSVSCTMDLCQGNT

SEQ ID NO: 33399 - protein, 30 aa, Artificial Sequence
  Description of Artificial Sequence: Synthetic polypeptide
DEVEIATTNPVATEQYGSVSTNEQLREGNE

SEQ ID NO: 33400 - protein, 32 aa, Artificial Sequence
  Description of Artificial Sequence: Synthetic polypeptide
DEEEIRTTNPVATEQYGSVSTINPLQERDGEG

SEQ ID NO: 33401 - protein, 30 aa, Artificial Sequence
  Description of Artificial Sequence: Synthetic polypeptide
NEMEIVTTNPVATEQYGSVSVTNIQRNGNR

SEQ ID NO: 33402 - protein, 28 aa, Artificial Sequence
  Description of Artificial Sequence: Synthetic peptide
GEEEIRSTNPVATEQYGSVSMPLQPGER

SEQ ID NO: 33403 - protein, 28 aa, Artificial Sequence
  Description of Artificial Sequence: Synthetic peptide
DEQEIRTTNPVATEQYGSCSTNLDSGED

SEQ ID NO: 33404 - protein, 33 aa, Artificial Sequence
  Description of Artificial Sequence: Synthetic polypeptide
DEEEIRTTNPTATEQYGSVSTANLQDREGDNDR

SEQ ID NO: 33405 - protein, 28 aa, Artificial Sequence
  Description of Artificial Sequence: Synthetic peptide
DESVIRQTNPVATEQYGSVSTNPQGGNH

SEQ ID NO: 33406 - protein, 29 aa, Artificial Sequence
  Description of Artificial Sequence: Synthetic peptide
DEEEIRTTNPVATECYGSVSTELEIHGNH

SEQ ID NO: 33407 - protein, 28 aa, Artificial Sequence
  Description of Artificial Sequence: Synthetic peptide
DEEEIRTTNPVATEQYGSVETNEQTEET

SEQ ID NO: 33408 - protein, 29 aa, Artificial Sequence
  Description of Artificial Sequence: Synthetic peptide
DEEEIRTTNPVATEIWGSVSTNEQMTGNF

SEQ ID NO: 33409 - protein, 30 aa, Artificial Sequence
  Description of Artificial Sequence: Synthetic polypeptide
DEEEIRTTNPVATEQYGESVSTNGDQLGEF

SEQ ID NO: 33410 - protein, 29 aa, Artificial Sequence
  Description of Artificial Sequence: Synthetic peptide
DEEEIRTTNPVSTEVYGSVSNVLQRAGMR

SEQ ID NO: 33411 - protein, 29 aa, Artificial Sequence
  Description of Artificial Sequence: Synthetic peptide
DEEEIATTNPVATECYGSVSTDLEDRGER

SEQ ID NO: 33412 - protein, 28 aa, Artificial Sequence
  Description of Artificial Sequence: Synthetic peptide
DEQEVRTVNPVAYEQYGSVCTDLQRGNR

SEQ ID NO: 33413 - protein, 28 aa, Artificial Sequence
  Description of Artificial Sequence: Synthetic peptide
DEEEISTTNPVATECYGSVSSDLQVGNN

SEQ ID NO: 33414 - protein, 28 aa, Artificial Sequence
  Description of Artificial Sequence: Synthetic peptide
QEEEIRTTNPVASEMYGEVSTNLQRMQR

SEQ ID NO: 33415 - protein, 30 aa, Artificial Sequence
  Description of Artificial Sequence: Synthetic polypeptide
DDEEIRTTNPVATEMYGSVSTNDQEHEGNR

SEQ ID NO: 33416 - protein, 28 aa, Artificial Sequence
  Description of Artificial Sequence: Synthetic peptide
DEEEIRTTNPVATEQYGDVSENLQHEEN

SEQ ID NO: 33417 - protein, 31 aa, Artificial Sequence
  Description of Artificial Sequence: Synthetic polypeptide
DEEEIRTTNPVATEQYGSVSLTNLQIQENNI

SEQ ID NO: 33418 - protein, 29 aa, Artificial Sequence
  Description of Artificial Sequence: Synthetic peptide
DENEIRTTNPVATEQYGSVSDELQRGDDW

SEQ ID NO: 33419 - protein, 32 aa, Artificial Sequence
  Description of Artificial Sequence: Synthetic polypeptide
DEEEIRTTNPVATEQYGSVSETNLQELGENDA

SEQ ID NO: 33420 - protein, 32 aa, Artificial Sequence
  Description of Artificial Sequence: Synthetic polypeptide
DENEIATTNPVATEQYGSVSATENLQRGENDR

SEQ ID NO: 33421 - protein, 33 aa, Artificial Sequence
  Description of Artificial Sequence: Synthetic polypeptide
DEEEIRTTNPVATELYGSVSTANGLPQRGPNDR

SEQ ID NO: 33422 - protein, 30 aa, Artificial Sequence
  Description of Artificial Sequence: Synthetic polypeptide
DEEEIRTTNPVATEQYGSVSTEPLQENGDV

SEQ ID NO: 33423 - protein, 31 aa, Artificial Sequence
  Description of Artificial Sequence: Synthetic polypeptide
DEEEIRTTNPVATEQYGSVSATTGLQNGENE

SEQ ID NO: 33424 - protein, 28 aa, Artificial Sequence
  Description of Artificial Sequence: Synthetic peptide
DENEIRTTNPVATEQYGDVSTCLQREEL

SEQ ID NO: 33425 - protein, 28 aa, Artificial Sequence
  Description of Artificial Sequence: Synthetic peptide
DEEEIATVNPVCTETYGSVSTNLQSGNQ

SEQ ID NO: 33426 - protein, 30 aa, Artificial Sequence
  Description of Artificial Sequence: Synthetic polypeptide
KEEEIRCTNPVATEQYGDVSVTNLQERGNM

SEQ ID NO: 33427 - protein, 31 aa, Artificial Sequence
  Description of Artificial Sequence: Synthetic polypeptide
DEEEIRTTNPVATECYGSVSTNLQDREGDDT

SEQ ID NO: 33428 - protein, 28 aa, Artificial Sequence
  Description of Artificial Sequence: Synthetic peptide
DEEEIRTTNPVATEQYGSVETNDDQGEM

SEQ ID NO: 33429 - protein, 28 aa, Artificial Sequence
  Description of Artificial Sequence: Synthetic peptide
DEIEINTTNPVATEVYGGVSTNIQRGNM

SEQ ID NO: 33430 - protein, 31 aa, Artificial Sequence
  Description of Artificial Sequence: Synthetic polypeptide
DEEEIRTTNPVATEQYGSVSATTDLVERGER

SEQ ID NO: 33431 - protein, 28 aa, Artificial Sequence
  Description of Artificial Sequence: Synthetic peptide
DEEEIRTTNPVATEVWGSVDTNEQQGNY

SEQ ID NO: 33432 - protein, 28 aa, Artificial Sequence
  Description of Artificial Sequence: Synthetic peptide
DEEEIRTTNPCATELYGSVSMELERGND

SEQ ID NO: 33433 - protein, 29 aa, Artificial Sequence
  Description of Artificial Sequence: Synthetic peptide
DEEEIRTTNPVATEQYGDVSEMDLQHGNS

SEQ ID NO: 33434 - protein, 30 aa, Artificial Sequence
  Description of Artificial Sequence: Synthetic polypeptide
SEEEIRSVNPVATEQYGSVSTELQERGNDR

SEQ ID NO: 33435 - protein, 28 aa, Artificial Sequence
  Description of Artificial Sequence: Synthetic peptide
QEVEIATTNPVSTEQYGDVSENLQRGNR

SEQ ID NO: 33436 - protein, 29 aa, Artificial Sequence
  Description of Artificial Sequence: Synthetic peptide
DEEEIRTTNPVATEQYGSMSTNEEELENR

SEQ ID NO: 33437 - protein, 28 aa, Artificial Sequence
  Description of Artificial Sequence: Synthetic peptide
DEEEIAQTNPVATEQYGSVSTDQEVGNR

SEQ ID NO: 33438 - protein, 31 aa, Artificial Sequence
  Description of Artificial Sequence: Synthetic polypeptide
DEECIRTTNPDAAEQYGSVSTNLQIRGDNPR

SEQ ID NO: 33439 - protein, 31 aa, Artificial Sequence
  Description of Artificial Sequence: Synthetic polypeptide
DEEEIRTTNPVATEQYGSVDVTNPDIDRGNR

SEQ ID NO: 33440 - protein, 29 aa, Artificial Sequence
  Description of Artificial Sequence: Synthetic peptide
DEEEIRTTNPVCTEQYGSVSCTELCTGNN

SEQ ID NO: 33441 - protein, 28 aa, Artificial Sequence
  Description of Artificial Sequence: Synthetic peptide
DEGEIRCTNPVATEQYGQVSTNLYWGND

SEQ ID NO: 33442 - protein, 30 aa, Artificial Sequence
  Description of Artificial Sequence: Synthetic polypeptide
DEEEITTTNPVATEQYGSVSTANWQLFGNI

SEQ ID NO: 33443 - protein, 32 aa, Artificial Sequence
  Description of Artificial Sequence: Synthetic polypeptide
DEEEIATTNPVATEQYGSVSTPNGVQRLGNDR

SEQ ID NO: 33444 - protein, 28 aa, Artificial Sequence
  Description of Artificial Sequence: Synthetic peptide
VDQEIACTNPVATEQYGVVSTNLQRGNR

SEQ ID NO: 33445 - protein, 28 aa, Artificial Sequence
  Description of Artificial Sequence: Synthetic peptide
DSEEIRTTNPDATEWYGSVSTNLTRGDQ

SEQ ID NO: 33446 - protein, 28 aa, Artificial Sequence
  Description of Artificial Sequence: Synthetic peptide
GEEEIRCTNPVSTEQYGSVSTNDQRGDY

SEQ ID NO: 33447 - protein, 28 aa, Artificial Sequence
  Description of Artificial Sequence: Synthetic peptide
DEEEIRTTNPAATEQYGSVSENEQHGTQ

SEQ ID NO: 33448 - protein, 29 aa, Artificial Sequence
  Description of Artificial Sequence: Synthetic peptide
DEDEIRTTNPIATEQYGSVAATNLQEGNN

SEQ ID NO: 33449 - protein, 32 aa, Artificial Sequence
  Description of Artificial Sequence: Synthetic polypeptide
DEEEIRTTNPVATEQYGSVSTENGLDYDGENR

SEQ ID NO: 33450 - protein, 31 aa, Artificial Sequence
  Description of Artificial Sequence: Synthetic polypeptide
DEEEIRTTNPVATEQYGSVSTTFNLQFEDPR

SEQ ID NO: 33451 - protein, 28 aa, Artificial Sequence
  Description of Artificial Sequence: Synthetic peptide
DEQEVRTTNPVASEQYGCVATNLERGNR

SEQ ID NO: 33452 - protein, 30 aa, Artificial Sequence
  Description of Artificial Sequence: Synthetic polypeptide
DEEEIATTNPTATEQYGGVSTNEQLRGNDR

SEQ ID NO: 33453 - protein, 31 aa, Artificial Sequence
  Description of Artificial Sequence: Synthetic polypeptide
DEEEIRTTNPVATEQYGSVDTNNLVQFGGND

SEQ ID NO: 33454 - protein, 28 aa, Artificial Sequence
  Description of Artificial Sequence: Synthetic peptide
DEEEIRTTNPVATQQYGSVWHNDDPGNR

SEQ ID NO: 33455 - protein, 31 aa, Artificial Sequence
  Description of Artificial Sequence: Synthetic polypeptide
DEEEIRTTNPVATEQYGSVSTEELQPQGENG

SEQ ID NO: 33456 - protein, 28 aa, Artificial Sequence
  Description of Artificial Sequence: Synthetic peptide
DEEEIAQTNPVATEQYGSVSTDLEVGNL

SEQ ID NO: 33457 - protein, 29 aa, Artificial Sequence
  Description of Artificial Sequence: Synthetic peptide
SEEEIRTTNPTATEQYGSVSENEQQEGNR

SEQ ID NO: 33458 - protein, 32 aa, Artificial Sequence
  Description of Artificial Sequence: Synthetic polypeptide
DEEEIRTTNPVATEQYGSSVSTNGEPQNEGNR

SEQ ID NO: 33459 - protein, 28 aa, Artificial Sequence
  Description of Artificial Sequence: Synthetic peptide
DLSEITATNPVATEQYGSVSTNLQAGNN

SEQ ID NO: 33460 - protein, 28 aa, Artificial Sequence
  Description of Artificial Sequence: Synthetic peptide
DEEEIRTTNPVATTQYGSVSHELDYGTR

SEQ ID NO: 33461 - protein, 28 aa, Artificial Sequence
  Description of Artificial Sequence: Synthetic peptide
DEEEIRTTNPEATEQYGSVSTEEQNGDL

SEQ ID NO: 33462 - protein, 28 aa, Artificial Sequence
  Description of Artificial Sequence: Synthetic peptide
DEEEIRTTNPEATEQYGVVSTNLWVGDQ

SEQ ID NO: 33463 - protein, 31 aa, Artificial Sequence
  Description of Artificial Sequence: Synthetic polypeptide
DEEEIRTTNPVATEQYGSVSTDLQEYKGEDR

SEQ ID NO: 33464 - protein, 30 aa, Artificial Sequence
  Description of Artificial Sequence: Synthetic polypeptide
DEEEIRTTNPVATEMYGSVSDNPQLGDNLR

SEQ ID NO: 33465 - protein, 31 aa, Artificial Sequence
  Description of Artificial Sequence: Synthetic polypeptide
DEEEIRTTNPVATECYGSVSECNLVQREGNN

SEQ ID NO: 33466 - protein, 30 aa, Artificial Sequence
  Description of Artificial Sequence: Synthetic polypeptide
DEEEIAQTNPVATEQYGSVSTGLVQRGNDF

SEQ ID NO: 33467 - protein, 28 aa, Artificial Sequence
  Description of Artificial Sequence: Synthetic peptide
DEEEIRTTNPDAWEQYGSVSTGGQRGLP

SEQ ID NO: 33468 - protein, 30 aa, Artificial Sequence
  Description of Artificial Sequence: Synthetic polypeptide
DEEEIRCTNPVATEQFGSVSTNEPQRGNDL

SEQ ID NO: 33469 - protein, 30 aa, Artificial Sequence
  Description of Artificial Sequence: Synthetic polypeptide
KEEEIRTTNPVATEQYGSVSTNLQDSGEDC

SEQ ID NO: 33470 - protein, 29 aa, Artificial Sequence
  Description of Artificial Sequence: Synthetic peptide
DEEEIRTTNPTATEQYGEVSENLQSGDNI

SEQ ID NO: 33471 - protein, 30 aa, Artificial Sequence
  Description of Artificial Sequence: Synthetic polypeptide
DEEEIRTTNPVATEQYGSVSDTNDERNGEF

SEQ ID NO: 33472 - protein, 30 aa, Artificial Sequence
  Description of Artificial Sequence: Synthetic polypeptide
DEEEIRTTNPVATEQYGSVSDTNGDNEGNE

SEQ ID NO: 33473 - protein, 28 aa, Artificial Sequence
  Description of Artificial Sequence: Synthetic peptide
DEEEIMTTNPTATEHYGSVSNNLQTGNQ

SEQ ID NO: 33474 - protein, 33 aa, Artificial Sequence
  Description of Artificial Sequence: Synthetic polypeptide
DEEEIRTTNPVATEQYGSVISTANLQDREGVNF

SEQ ID NO: 33475 - protein, 28 aa, Artificial Sequence
  Description of Artificial Sequence: Synthetic peptide
DEEEIATTNPCCTEQYGSVSTALQSGNI

SEQ ID NO: 33476 - protein, 30 aa, Artificial Sequence
  Description of Artificial Sequence: Synthetic polypeptide
DEEEIRTTNPVATEQYGSVSCTEDQQSGNG

SEQ ID NO: 33477 - protein, 29 aa, Artificial Sequence
  Description of Artificial Sequence: Synthetic peptide
DEQEIATTNPVATEQYGSVSTELQDSGNM

SEQ ID NO: 33478 - protein, 29 aa, Artificial Sequence
  Description of Artificial Sequence: Synthetic peptide
DEREIVATNPVSTEQYGSVSENLQRGNDR

SEQ ID NO: 33479 - protein, 30 aa, Artificial Sequence
  Description of Artificial Sequence: Synthetic polypeptide
KESEIRTTNPVATEIYGSVSTNLQEMEGNR

SEQ ID NO: 33480 - protein, 28 aa, Artificial Sequence
  Description of Artificial Sequence: Synthetic peptide
CEQEIRTTNPVATEGFGSISENLQRGNR

SEQ ID NO: 33481 - protein, 28 aa, Artificial Sequence
  Description of Artificial Sequence: Synthetic peptide
DEQEIRTTNPEATEQYGSVSTNEDRGET

SEQ ID NO: 33482 - protein, 28 aa, Artificial Sequence
  Description of Artificial Sequence: Synthetic peptide
DEDEIRTTNPVASELYGSASTNLQGGNN

SEQ ID NO: 33483 - protein, 28 aa, Artificial Sequence
  Description of Artificial Sequence: Synthetic peptide
DEEEIRTTNPCATEQYGCVSTNQDRGDM

SEQ ID NO: 33484 - protein, 28 aa, Artificial Sequence
  Description of Artificial Sequence: Synthetic peptide
AEEEIGTTNPVATEQYGIVSTCQQGGNR

SEQ ID NO: 33485 - protein, 31 aa, Artificial Sequence
  Description of Artificial Sequence: Synthetic polypeptide
DEEEIRTTNPVATEQYGSVSTGDLENNGNDR

SEQ ID NO: 33486 - protein, 28 aa, Artificial Sequence
  Description of Artificial Sequence: Synthetic peptide
KEEYIRTTNPVAYECYGSVSTNLQRGED

SEQ ID NO: 33487 - protein, 28 aa, Artificial Sequence
  Description of Artificial Sequence: Synthetic peptide
DEEEIRATNPVATEHYGSVAYNLMRGNI

SEQ ID NO: 33488 - protein, 32 aa, Artificial Sequence
  Description of Artificial Sequence: Synthetic polypeptide
DEEEIRTTNPVATEQYGSVSETNLQDPGENEE

SEQ ID NO: 33489 - protein, 28 aa, Artificial Sequence
  Description of Artificial Sequence: Synthetic peptide
DENEIATTNPFATEQYGSVSENLERGMR

SEQ ID NO: 33490 - protein, 30 aa, Artificial Sequence
  Description of Artificial Sequence: Synthetic polypeptide
GEQEIRTTNPVATEQYGSVSTNLQLEGNDD

SEQ ID NO: 33491 - protein, 30 aa, Artificial Sequence
  Description of Artificial Sequence: Synthetic polypeptide
DEEEIRTTNPVATEQYGSVTSIDNLQGGET

SEQ ID NO: 33492 - protein, 28 aa, Artificial Sequence
  Description of Artificial Sequence: Synthetic peptide
AEEEIRTTNPVATEQYGEVDTNPQNGND

SEQ ID NO: 33493 - protein, 30 aa, Artificial Sequence
  Description of Artificial Sequence: Synthetic polypeptide
DEEEIRTTNPVATEQYGSVETDPLQIGDER

SEQ ID NO: 33494 - protein, 28 aa, Artificial Sequence
  Description of Artificial Sequence: Synthetic peptide
KEEEIRTTNPVATEQYGDASTNLQREEA

SEQ ID NO: 33495 - protein, 31 aa, Artificial Sequence
  Description of Artificial Sequence: Synthetic polypeptide
DEEEIATTNPVATEQYGSASCENLQRAGVNR

SEQ ID NO: 33496 - protein, 28 aa, Artificial Sequence
  Description of Artificial Sequence: Synthetic peptide
DEEEIRTTNPTATEQYGEVSENLQNGDA

SEQ ID NO: 33497 - protein, 28 aa, Artificial Sequence
  Description of Artificial Sequence: Synthetic peptide
DEAEIAATNPVATENYGSVATNLQRGTR

SEQ ID NO: 33498 - protein, 28 aa, Artificial Sequence
  Description of Artificial Sequence: Synthetic peptide
DEEEIVTTNPVATEQYGVVSTEDQFGNM

SEQ ID NO: 33499 - protein, 30 aa, Artificial Sequence
  Description of Artificial Sequence: Synthetic polypeptide
DEEEIATTNPVATEQYGSVSTDLQIHKGER

SEQ ID NO: 33500 - protein, 30 aa, Artificial Sequence
  Description of Artificial Sequence: Synthetic polypeptide
DEQEIRTTNPVATEQYGSVDDTNEQRNGER

SEQ ID NO: 33501 - protein, 31 aa, Artificial Sequence
  Description of Artificial Sequence: Synthetic polypeptide
DEEEIRTTNPVATEQYGSVSCTDLQCYGNDV

SEQ ID NO: 33502 - protein, 31 aa, Artificial Sequence
  Description of Artificial Sequence: Synthetic polypeptide
DEEEIRTTNPVATEQWGSWHTNLQIRGLNNR

SEQ ID NO: 33503 - protein, 30 aa, Artificial Sequence
  Description of Artificial Sequence: Synthetic polypeptide
GEEEIRTTNPVATEQYGSVSTELQDQEGNM

SEQ ID NO: 33504 - protein, 31 aa, Artificial Sequence
  Description of Artificial Sequence: Synthetic polypeptide
DEEEIRTTNPVATEQYGSVSTDLQIRNGEDL

SEQ ID NO: 33505 - protein, 29 aa, Artificial Sequence
  Description of Artificial Sequence: Synthetic peptide
DEDEIRTTNPAATEMYGSVSTGNLQNGTR

SEQ ID NO: 33506 - protein, 31 aa, Artificial Sequence
  Description of Artificial Sequence: Synthetic polypeptide
DEEEIRTTNPVATEQYGSVSTDLEDVNGNDR

SEQ ID NO: 33507 - protein, 28 aa, Artificial Sequence
  Description of Artificial Sequence: Synthetic peptide
MENEIRTTNPVATECYGSVSTELQHGNF

SEQ ID NO: 33508 - protein, 29 aa, Artificial Sequence
  Description of Artificial Sequence: Synthetic peptide
GEEEIVTTNPVATEQYGVVSTNLQHGNDW

SEQ ID NO: 33509 - protein, 28 aa, Artificial Sequence
  Description of Artificial Sequence: Synthetic peptide
DEEEIRTTNPEATEQYGSVSTDDQTGEL

SEQ ID NO: 33510 - protein, 28 aa, Artificial Sequence
  Description of Artificial Sequence: Synthetic peptide
DEEEIRTVNPCCTEQYGSVSTDLDPGNR

SEQ ID NO: 33511 - protein, 31 aa, Artificial Sequence
  Description of Artificial Sequence: Synthetic polypeptide
DEEEIRTTNPVATEQYGESWDSTIPEQRGNR

SEQ ID NO: 33512 - protein, 31 aa, Artificial Sequence
  Description of Artificial Sequence: Synthetic polypeptide
SEEEIRTTNPVCTEQYGSVASTENLQRAGER

SEQ ID NO: 33513 - protein, 31 aa, Artificial Sequence
  Description of Artificial Sequence: Synthetic polypeptide
DEEEIRTTNPVATECYGSVSTNLQDHEGEDR

SEQ ID NO: 33514 - protein, 30 aa, Artificial Sequence
  Description of Artificial Sequence: Synthetic polypeptide
DEEEIRTTNPVCTEFYGSVSTNLQFREPND

SEQ ID NO: 33515 - protein, 30 aa, Artificial Sequence
  Description of Artificial Sequence: Synthetic polypeptide
DEVEITTTNPVATEQYGSVSTINQQQGANR

SEQ ID NO: 33516 - protein, 28 aa, Artificial Sequence
  Description of Artificial Sequence: Synthetic peptide
DENEIAQTNPVATEQYGSVSTNDENGNR

SEQ ID NO: 33517 - protein, 28 aa, Artificial Sequence
  Description of Artificial Sequence: Synthetic peptide
DEEEIRATNPVASECYGSVSTNLDMGNM

SEQ ID NO: 33518 - protein, 31 aa, Artificial Sequence
  Description of Artificial Sequence: Synthetic polypeptide
DEQEIATTNPVATEQYGSVSTNLQREGENDL

SEQ ID NO: 33519 - protein, 28 aa, Artificial Sequence
  Description of Artificial Sequence: Synthetic peptide
DEEEIRTTNPVATEQYGWVSTELQLDKD

SEQ ID NO: 33520 - protein, 30 aa, Artificial Sequence
  Description of Artificial Sequence: Synthetic polypeptide
DETEIVTTNPIATEQYGCVSTNLQSRGENR

SEQ ID NO: 33521 - protein, 29 aa, Artificial Sequence
  Description of Artificial Sequence: Synthetic peptide
DEQEIRTTNPVATEQYGMVSTQLQTGGMR

SEQ ID NO: 33522 - protein, 28 aa, Artificial Sequence
  Description of Artificial Sequence: Synthetic peptide
SEEEIRTTNPVAHEQYGSVSTNDQVGDI

SEQ ID NO: 33523 - protein, 29 aa, Artificial Sequence
  Description of Artificial Sequence: Synthetic peptide
DEEEIRTTNPVATEQYGEVDIENPQRGNW

SEQ ID NO: 33524 - protein, 28 aa, Artificial Sequence
  Description of Artificial Sequence: Synthetic peptide
DEEEIRPTNPVATEQYGSVDTNGDNGNF

SEQ ID NO: 33525 - protein, 29 aa, Artificial Sequence
  Description of Artificial Sequence: Synthetic peptide
DEEEIATTNPVATECYGVVSTNLQREGEL

SEQ ID NO: 33526 - protein, 31 aa, Artificial Sequence
  Description of Artificial Sequence: Synthetic polypeptide
DEEEIRTTNPVATEQWGSVDTNLMLRNGNDR

SEQ ID NO: 33527 - protein, 31 aa, Artificial Sequence
  Description of Artificial Sequence: Synthetic polypeptide
DEEEIRTTNPVATEQYGSVSVTNLIIMEGNI

SEQ ID NO: 33528 - protein, 28 aa, Artificial Sequence
  Description of Artificial Sequence: Synthetic peptide
DEEEIRCTNPVATEQYGVVSANLQLGDQ

SEQ ID NO: 33529 - protein, 32 aa, Artificial Sequence
  Description of Artificial Sequence: Synthetic polypeptide
DEEEIRTTNPVATEQYGDVSATTNLQLRGEND

SEQ ID NO: 33530 - protein, 30 aa, Artificial Sequence
  Description of Artificial Sequence: Synthetic polypeptide
DEQEIRCTNPVATEIYGAVSATNLQREGNR

SEQ ID NO: 33531 - protein, 28 aa, Artificial Sequence
  Description of Artificial Sequence: Synthetic peptide
DEEEISSTNPVATEQYGDVSTNEQGGNF

SEQ ID NO: 33532 - protein, 28 aa, Artificial Sequence
  Description of Artificial Sequence: Synthetic peptide
DEDEITTTNPVATEGYGSVPTNLQRGMK

SEQ ID NO: 33533 - protein, 29 aa, Artificial Sequence
  Description of Artificial Sequence: Synthetic peptide
EEEEIRTTNPVATEQYGSVSTCVQIAGND

SEQ ID NO: 33534 - protein, 28 aa, Artificial Sequence
  Description of Artificial Sequence: Synthetic peptide
GEEEIATVNPVATEMYGSVSTDLQAGNR

SEQ ID NO: 33535 - protein, 29 aa, Artificial Sequence
  Description of Artificial Sequence: Synthetic peptide
IEEEIHTTNPVATEQYGSVSATNWQNGND

SEQ ID NO: 33536 - protein, 30 aa, Artificial Sequence
  Description of Artificial Sequence: Synthetic polypeptide
DEEEIATTNPTATEQYGSVSTMNEQIGDNR

SEQ ID NO: 33537 - protein, 29 aa, Artificial Sequence
  Description of Artificial Sequence: Synthetic peptide
SENEIRTTNPVATEQYGIVSENLQVGNDR

SEQ ID NO: 33538 - protein, 28 aa, Artificial Sequence
  Description of Artificial Sequence: Synthetic peptide
EETEIRTTNPVATEQYGIVSENLQRGPQ

SEQ ID NO: 33539 - protein, 31 aa, Artificial Sequence
  Description of Artificial Sequence: Synthetic polypeptide
DEVEIATTNPVATEQYGSVSENLQREGENTR

SEQ ID NO: 33540 - protein, 28 aa, Artificial Sequence
  Description of Artificial Sequence: Synthetic peptide
NEEELRCTNPVAYEQYGSVSTNLQPPNR

SEQ ID NO: 33541 - protein, 28 aa, Artificial Sequence
  Description of Artificial Sequence: Synthetic peptide
SEEEIRTTNPVATELWGSVSTNEQQGNF

SEQ ID NO: 33542 - protein, 29 aa, Artificial Sequence
  Description of Artificial Sequence: Synthetic peptide
DEEEIRTTNPVATEQYGSVSTNEEWQGTQ

SEQ ID NO: 33543 - protein, 31 aa, Artificial Sequence
  Description of Artificial Sequence: Synthetic polypeptide
DEEEIRTTNPVATEQYGSVSTNLEDREGEDD

SEQ ID NO: 33544 - protein, 28 aa, Artificial Sequence
  Description of Artificial Sequence: Synthetic peptide
DEEEIRTTNPVATQQYGSVSTPDDRGEP

SEQ ID NO: 33545 - protein, 28 aa, Artificial Sequence
  Description of Artificial Sequence: Synthetic peptide
DEQEIRTTNPVATEQYGSVSTPDEAGER

SEQ ID NO: 33546 - protein, 31 aa, Artificial Sequence
  Description of Artificial Sequence: Synthetic polypeptide
DEEEIRTTNPVATEQYGSFVSTYNLQEIDNY

SEQ ID NO: 33547 - protein, 33 aa, Artificial Sequence
  Description of Artificial Sequence: Synthetic polypeptide
DEEEIRTTNPVATEQYGSVCSSTENGLVDRGNR

SEQ ID NO: 33548 - protein, 28 aa, Artificial Sequence
  Description of Artificial Sequence: Synthetic peptide
DEEEIRATNPVAWEQYGDVSTNLQQEDR

SEQ ID NO: 33549 - protein, 29 aa, Artificial Sequence
  Description of Artificial Sequence: Synthetic peptide
KEEEIRATNPVATEQYGSVSENLQLEGNQ

SEQ ID NO: 33550 - protein, 30 aa, Artificial Sequence
  Description of Artificial Sequence: Synthetic polypeptide
DEEEIRTTNPVATEQYGSVSTNLETLGEDS

SEQ ID NO: 33551 - protein, 34 aa, Artificial Sequence
  Description of Artificial Sequence: Synthetic polypeptide
DEEEIRTTNPVATEQYGSVDSCTNLVQRKGDNDR

SEQ ID NO: 33552 - protein, 32 aa, Artificial Sequence
  Description of Artificial Sequence: Synthetic polypeptide
DEEEIRTTNPVATEQYGSADCTCNLQTRGNDR

SEQ ID NO: 33553 - protein, 28 aa, Artificial Sequence
  Description of Artificial Sequence: Synthetic peptide
DEEEIRTTNPVATECYGSVSTDLEVGEI

SEQ ID NO: 33554 - protein, 29 aa, Artificial Sequence
  Description of Artificial Sequence: Synthetic peptide
DEEEIRCTNPVATECYGSVDTNEQTAGNR

SEQ ID NO: 33555 - protein, 30 aa, Artificial Sequence
  Description of Artificial Sequence: Synthetic polypeptide
DEEEIRTTNPVCTEQYGWVSTGNGLQTGNQ

SEQ ID NO: 33556 - protein, 30 aa, Artificial Sequence
  Description of Artificial Sequence: Synthetic polypeptide
DEEEIRTTNPVATEQYGSVSTNLQVTEEDV

SEQ ID NO: 33557 - protein, 28 aa, Artificial Sequence
  Description of Artificial Sequence: Synthetic peptide
DENEIRTTNPVATECWGSVSTNLMIGNS

SEQ ID NO: 33558 - protein, 30 aa, Artificial Sequence
  Description of Artificial Sequence: Synthetic polypeptide
DEEEIRTTNPVATEQYGSVSTDLQDTDGDE

SEQ ID NO: 33559 - protein, 28 aa, Artificial Sequence
  Description of Artificial Sequence: Synthetic peptide
DEQEIRTTNPVATEQYGSVSTELEVGEN

SEQ ID NO: 33560 - protein, 29 aa, Artificial Sequence
  Description of Artificial Sequence: Synthetic peptide
DEEEIKTTNPVATECYGLVATGLQRGENR

SEQ ID NO: 33561 - protein, 30 aa, Artificial Sequence
  Description of Artificial Sequence: Synthetic polypeptide
DEEEIRTTNPVATEQYGSVSTELQETEGEM

SEQ ID NO: 33562 - protein, 28 aa, Artificial Sequence
  Description of Artificial Sequence: Synthetic peptide
DEDEIRTTNPAAYEQYGSVSTNWQLGNI

SEQ ID NO: 33563 - protein, 28 aa, Artificial Sequence
  Description of Artificial Sequence: Synthetic peptide
DEFEIRTTNPVATECYGVVSTNLMIGNF

SEQ ID NO: 33564 - protein, 28 aa, Artificial Sequence
  Description of Artificial Sequence: Synthetic peptide
AENEIRTTNPEATEQYGSVSTNWQGGND

SEQ ID NO: 33565 - protein, 30 aa, Artificial Sequence
  Description of Artificial Sequence: Synthetic polypeptide
DENEIRTTNPVATEMYGSVSTNLQEIEGNH

SEQ ID NO: 33566 - protein, 32 aa, Artificial Sequence
  Description of Artificial Sequence: Synthetic polypeptide
DEEEIRTTNPVATEQYGSVASTCNPLQRKGED

SEQ ID NO: 33567 - protein, 31 aa, Artificial Sequence
  Description of Artificial Sequence: Synthetic polypeptide
DEEEIRTTNPVATEQYGCSVSETEPLERGNE

SEQ ID NO: 33568 - protein, 28 aa, Artificial Sequence
  Description of Artificial Sequence: Synthetic peptide
DEEPIRPTNPFATEQYGSVSTGLDRGND

SEQ ID NO: 33569 - protein, 31 aa, Artificial Sequence
  Description of Artificial Sequence: Synthetic polypeptide
DEEEIRTTNPVATEQYGSVSTNLQEIEGEEH

SEQ ID NO: 33570 - protein, 30 aa, Artificial Sequence
  Description of Artificial Sequence: Synthetic polypeptide
SEEEIRTTNPAATEQYGSVSTNPQREGNTV

SEQ ID NO: 33571 - protein, 29 aa, Artificial Sequence
  Description of Artificial Sequence: Synthetic peptide
DENEIVTTNPVATEQYGSVSTNLESVGNL

SEQ ID NO: 33572 - protein, 31 aa, Artificial Sequence
  Description of Artificial Sequence: Synthetic polypeptide
DEEEIRTTNPVATEQYGSVESDTPNLDPGNP

SEQ ID NO: 33573 - protein, 28 aa, Artificial Sequence
  Description of Artificial Sequence: Synthetic peptide
DEEEIRSTNPVATEIYGIVSTNLETGNT

SEQ ID NO: 33574 - protein, 28 aa, Artificial Sequence
  Description of Artificial Sequence: Synthetic peptide
DEGEIRTTNPCATEIYGSVSTDIQFGNR

SEQ ID NO: 33575 - protein, 29 aa, Artificial Sequence
  Description of Artificial Sequence: Synthetic peptide
DEEEIRTTNPVATEQYGSYSTNDETGNDA

SEQ ID NO: 33576 - protein, 28 aa, Artificial Sequence
  Description of Artificial Sequence: Synthetic peptide
DEEEVACTNPVASEQYGSVATNLQRGNQ

SEQ ID NO: 33577 - protein, 28 aa, Artificial Sequence
  Description of Artificial Sequence: Synthetic peptide
DEEEIRCTNPESTEMYGSVSANLQHGNR

SEQ ID NO: 33578 - protein, 28 aa, Artificial Sequence
  Description of Artificial Sequence: Synthetic peptide
DEEEIRTTNPVATESYGSAPENLQREQR

SEQ ID NO: 33579 - protein, 28 aa, Artificial Sequence
  Description of Artificial Sequence: Synthetic peptide
DEEEIRTTNPVACEIYGCVGNNLQVGNR

SEQ ID NO: 33580 - protein, 31 aa, Artificial Sequence
  Description of Artificial Sequence: Synthetic polypeptide
DEEEIRTTNPVATEQYGSVSDDPLIQRGNEM

SEQ ID NO: 33581 - protein, 31 aa, Artificial Sequence
  Description of Artificial Sequence: Synthetic polypeptide
SEEEIRTTNPVATEMYGGVSTMNLQRGDNTR

SEQ ID NO: 33582 - protein, 28 aa, Artificial Sequence
  Description of Artificial Sequence: Synthetic peptide
AEEEISTTNPVATEQYGSVDTNDQVGNN

SEQ ID NO: 33583 - protein, 28 aa, Artificial Sequence
  Description of Artificial Sequence: Synthetic peptide
DEEEIRTTNPHATEQYGSVHTGEMRGNA

SEQ ID NO: 33584 - protein, 28 aa, Artificial Sequence
  Description of Artificial Sequence: Synthetic peptide
GENDIRTTNPVATEWYGSVATNLQRGNL

SEQ ID NO: 33585 - protein, 32 aa, Artificial Sequence
  Description of Artificial Sequence: Synthetic polypeptide
DEEEIRTTNPVATEQYGSVSCTMNLCDYGNDR

SEQ ID NO: 33586 - protein, 29 aa, Artificial Sequence
  Description of Artificial Sequence: Synthetic peptide
QEEEIATTNPVATECYGSVSATNLQRGEL

SEQ ID NO: 33587 - protein, 28 aa, Artificial Sequence
  Description of Artificial Sequence: Synthetic peptide
DEEEIRTTNPVATEQYGDVSENLMQGDA

SEQ ID NO: 33588 - protein, 28 aa, Artificial Sequence
  Description of Artificial Sequence: Synthetic peptide
DEEEIRTTNPVATEQYGSVETPLDNGEV

SEQ ID NO: 33589 - protein, 29 aa, Artificial Sequence
  Description of Artificial Sequence: Synthetic peptide
AEEEIRSTNPTATEQYGEVSTNGLQNGNR

SEQ ID NO: 33590 - protein, 30 aa, Artificial Sequence
  Description of Artificial Sequence: Synthetic polypeptide
DEEEIRTTNPVATECYGSVSCTNEQRAENL

SEQ ID NO: 33591 - protein, 31 aa, Artificial Sequence
  Description of Artificial Sequence: Synthetic polypeptide
DEEEIRTTNPVATEIYGSVSETNLQDIEGNN

SEQ ID NO: 33592 - protein, 28 aa, Artificial Sequence
  Description of Artificial Sequence: Synthetic peptide
DETEIRTTNPVATEQYGSVSALLNQGNQ

SEQ ID NO: 33593 - protein, 28 aa, Artificial Sequence
  Description of Artificial Sequence: Synthetic peptide
DEEEIRTTNPCSTEPYGDVSTEDQRGNR

SEQ ID NO: 33594 - protein, 28 aa, Artificial Sequence
  Description of Artificial Sequence: Synthetic peptide
YEEGICTTNPVATEQYGSVSMNSQRGNS

SEQ ID NO: 33595 - protein, 31 aa, Artificial Sequence
  Description of Artificial Sequence: Synthetic polypeptide
DEEEIRQTNPVATEQYGSVSDENNLQDGNPR

SEQ ID NO: 33596 - protein, 31 aa, Artificial Sequence
  Description of Artificial Sequence: Synthetic polypeptide
DEEEIRTTNPVATEQYGSVSTCNPQEAGNDT

SEQ ID NO: 33597 - protein, 32 aa, Artificial Sequence
  Description of Artificial Sequence: Synthetic polypeptide
DEEEIRTTNPVATEQYGSVDCTCNLEERGENR

SEQ ID NO: 33598 - protein, 30 aa, Artificial Sequence
  Description of Artificial Sequence: Synthetic polypeptide
DEEEIRTTNPVATEQYGSVSTDLQDQGEDM

SEQ ID NO: 33599 - protein, 29 aa, Artificial Sequence
  Description of Artificial Sequence: Synthetic peptide
DEEEIRCTNPVATEQYGSASMDLQRGEND

SEQ ID NO: 33600 - protein, 28 aa, Artificial Sequence
  Description of Artificial Sequence: Synthetic peptide
DEQEIRTTNPVASECYGSVSTNLEHGER

SEQ ID NO: 33601 - protein, 29 aa, Artificial Sequence
  Description of Artificial Sequence: Synthetic peptide
DEEEIATTNPVATECYGSVSTNLETGDNI

SEQ ID NO: 33602 - protein, 30 aa, Artificial Sequence
  Description of Artificial Sequence: Synthetic polypeptide
DEGEIRTTNPVATEQYGSSVSTNLQQGDLF

SEQ ID NO: 33603 - protein, 28 aa, Artificial Sequence
  Description of Artificial Sequence: Synthetic peptide
DEQEIRTTNPVCTEVYGSVSDNLQTGNY

SEQ ID NO: 33604 - protein, 31 aa, Artificial Sequence
  Description of Artificial Sequence: Synthetic polypeptide
DEEEIRTTNPVATEQFGSVISTNLQEQGNTS

SEQ ID NO: 33605 - protein, 30 aa, Artificial Sequence
  Description of Artificial Sequence: Synthetic polypeptide
DEEEIRTTNPVATECYGSVSTNLQHEGEDL

SEQ ID NO: 33606 - protein, 30 aa, Artificial Sequence
  Description of Artificial Sequence: Synthetic polypeptide
SDEEIRTTNPVATEQYGSCSTNLQDRGNDH

SEQ ID NO: 33607 - protein, 28 aa, Artificial Sequence
  Description of Artificial Sequence: Synthetic peptide
DENEIRTTNPVATEVWGIVSTNLQRGTW

SEQ ID NO: 33608 - protein, 31 aa, Artificial Sequence
  Description of Artificial Sequence: Synthetic polypeptide
DEEEIRTTNPVATEQYGSVSDTDGLVEIGNR

SEQ ID NO: 33609 - protein, 31 aa, Artificial Sequence
  Description of Artificial Sequence: Synthetic polypeptide
AEEEIRTTNPFATEQYGSVASTNLVQLDGNR

SEQ ID NO: 33610 - protein, 30 aa, Artificial Sequence
  Description of Artificial Sequence: Synthetic polypeptide
DEEEIRTTNPVATEQYGSVSEMNPQNGDNV

SEQ ID NO: 33611 - protein, 31 aa, Artificial Sequence
  Description of Artificial Sequence: Synthetic polypeptide
DEEEIRTTNPVATEQYGSFSDTDNLGQHGND

SEQ ID NO: 33612 - protein, 31 aa, Artificial Sequence
  Description of Artificial Sequence: Synthetic polypeptide
DEEEIRTTNPVATEQYGSVSTDLQDNEGNDD

SEQ ID NO: 33613 - protein, 29 aa, Artificial Sequence
  Description of Artificial Sequence: Synthetic peptide
MEEEIRTTNPVATECYGSVSTDLQEHGNW

SEQ ID NO: 33614 - protein, 31 aa, Artificial Sequence
  Description of Artificial Sequence: Synthetic polypeptide
DEEEIRTTNPVATEQYGDVISEGNLQREGNQ

SEQ ID NO: 33615 - protein, 28 aa, Artificial Sequence
  Description of Artificial Sequence: Synthetic peptide
DEEEIRTTNPVATEQYGSVSWCDQSGEI

SEQ ID NO: 33616 - protein, 32 aa, Artificial Sequence
  Description of Artificial Sequence: Synthetic polypeptide
DEEEIRTTNPTATEQYGSVISTNLQDIGVNTR

SEQ ID NO: 33617 - protein, 28 aa, Artificial Sequence
  Description of Artificial Sequence: Synthetic peptide
DEEEIRTTNPDATEQYGVVATNIQPGND

SEQ ID NO: 33618 - protein, 28 aa, Artificial Sequence
  Description of Artificial Sequence: Synthetic peptide
DEEEIRQTNPVATEQYGSVSTTCQREEM

SEQ ID NO: 33619 - protein, 29 aa, Artificial Sequence
  Description of Artificial Sequence: Synthetic peptide
DEEEIRTTNPVASEQYGSVYSVNEQRGTI

SEQ ID NO: 33620 - protein, 28 aa, Artificial Sequence
  Description of Artificial Sequence: Synthetic peptide
DENEICQTNPVGTEQYGSVSTGEQRGNR

SEQ ID NO: 33621 - protein, 28 aa, Artificial Sequence
  Description of Artificial Sequence: Synthetic peptide
DEEEIRTTNPTATEQFGGVSENWQQGNR

SEQ ID NO: 33622 - protein, 28 aa, Artificial Sequence
  Description of Artificial Sequence: Synthetic peptide
QEEEIATTNPVATEQYGVVSTNWQPGND

SEQ ID NO: 33623 - protein, 30 aa, Artificial Sequence
  Description of Artificial Sequence: Synthetic polypeptide
DEEEIRTTNPVCTEQYGSVNEANLQRGALR

SEQ ID NO: 33624 - protein, 28 aa, Artificial Sequence
  Description of Artificial Sequence: Synthetic peptide
DEEPIRTTNPFATEMYGSVSTDEERGNR

SEQ ID NO: 33625 - protein, 32 aa, Artificial Sequence
  Description of Artificial Sequence: Synthetic polypeptide
DEEEIRTTNPVATEQYGSVSTDNDQRDGDNEE

SEQ ID NO: 33626 - protein, 30 aa, Artificial Sequence
  Description of Artificial Sequence: Synthetic polypeptide
DEEEIRTTNPVATECYGSVSTDLQIQKGNW

SEQ ID NO: 33627 - protein, 30 aa, Artificial Sequence
  Description of Artificial Sequence: Synthetic polypeptide
DEEEIRTTNPVATEQYGSVSTDLQEVGEDM

SEQ ID NO: 33628 - protein, 30 aa, Artificial Sequence
  Description of Artificial Sequence: Synthetic polypeptide
AEEEIRTTNPDATEQYGSVCSTNNLQHENR

SEQ ID NO: 33629 - protein, 31 aa, Artificial Sequence
  Description of Artificial Sequence: Synthetic polypeptide
SEEEIRTTNPTATEQFGSVSTNGLQDRGDNR

SEQ ID NO: 33630 - protein, 28 aa, Artificial Sequence
  Description of Artificial Sequence: Synthetic peptide
DEEEIRTTNPVATEQYGSVDTEEERGEI

SEQ ID NO: 33631 - protein, 28 aa, Artificial Sequence
  Description of Artificial Sequence: Synthetic peptide
DEEEIRTTNPEATEQYGSVPTWLARGKE

SEQ ID NO: 33632 - protein, 28 aa, Artificial Sequence
  Description of Artificial Sequence: Synthetic peptide
DEEPIATTNPVATEQYGMVDTNLLRGNF

SEQ ID NO: 33633 - protein, 30 aa, Artificial Sequence
  Description of Artificial Sequence: Synthetic polypeptide
DEEEIRQTNPVATEQFGSVWSTNNGQRGER

SEQ ID NO: 33634 - protein, 28 aa, Artificial Sequence
  Description of Artificial Sequence: Synthetic peptide
DEEEIRATNPFATEQYGSVSTNQQSGEG

SEQ ID NO: 33635 - protein, 28 aa, Artificial Sequence
  Description of Artificial Sequence: Synthetic peptide
DEEEIRTTNPTCTEQFGSVSTNPQRGLG

SEQ ID NO: 33636 - protein, 28 aa, Artificial Sequence
  Description of Artificial Sequence: Synthetic peptide
DENEIRTTNPVATEQYGDVSENLERGED

SEQ ID NO: 33637 - protein, 29 aa, Artificial Sequence
  Description of Artificial Sequence: Synthetic peptide
DEEEIRTTNPVATEQYGDASTDLQEREER

SEQ ID NO: 33638 - protein, 30 aa, Artificial Sequence
  Description of Artificial Sequence: Synthetic polypeptide
DEEEIRTTNPVATEQYGDVSCTMELQVGNV

SEQ ID NO: 33639 - protein, 32 aa, Artificial Sequence
  Description of Artificial Sequence: Synthetic polypeptide
DEEEIRTTNPVATEQYGSVDSTDLQHDGDNER

SEQ ID NO: 33640 - protein, 30 aa, Artificial Sequence
  Description of Artificial Sequence: Synthetic polypeptide
DENEIRTTNPVATEQYGSVSTNLQENEGEM

SEQ ID NO: 33641 - protein, 28 aa, Artificial Sequence
  Description of Artificial Sequence: Synthetic peptide
DEEEIRATNPVATEVYGSVSTNLEFGEV

SEQ ID NO: 33642 - protein, 30 aa, Artificial Sequence
  Description of Artificial Sequence: Synthetic polypeptide
SEEEIATTNPVATEQYGGVYSLTNLQRGNF

SEQ ID NO: 33643 - protein, 30 aa, Artificial Sequence
  Description of Artificial Sequence: Synthetic polypeptide
DEEEIRTTNPVATEQYGSVSTEPLQIDGDH

SEQ ID NO: 33644 - protein, 29 aa, Artificial Sequence
  Description of Artificial Sequence: Synthetic peptide
KEEEIRTTNPVATECYGSVSTNLQGEGDT

SEQ ID NO: 33645 - protein, 28 aa, Artificial Sequence
  Description of Artificial Sequence: Synthetic peptide
QEEEIATTNPVATEQYGEVPTNLMRGNK

SEQ ID NO: 33646 - protein, 31 aa, Artificial Sequence
  Description of Artificial Sequence: Synthetic polypeptide
DEHEIRTTNPVATEQYGSVSCENLQDTGNDR

SEQ ID NO: 33647 - protein, 28 aa, Artificial Sequence
  Description of Artificial Sequence: Synthetic peptide
DEEEVRTTNPVATEQYGCTSANLEIGNR

SEQ ID NO: 33648 - protein, 32 aa, Artificial Sequence
  Description of Artificial Sequence: Synthetic polypeptide
DEEEIRTTNPEATEQYGSVSTENPLVQRGENF

SEQ ID NO: 33649 - protein, 30 aa, Artificial Sequence
  Description of Artificial Sequence: Synthetic polypeptide
DEEEIVTTNPVATEQYGSVSTWLQHDGNDD

SEQ ID NO: 33650 - protein, 31 aa, Artificial Sequence
  Description of Artificial Sequence: Synthetic polypeptide
MEEEIRTTNPVATEQYGSVSTNLQEHEGNDW

SEQ ID NO: 33651 - protein, 28 aa, Artificial Sequence
  Description of Artificial Sequence: Synthetic peptide
DEEEICSTNPVATEQYGSYSLNLQQPNR

SEQ ID NO: 33652 - protein, 28 aa, Artificial Sequence
  Description of Artificial Sequence: Synthetic peptide
DEVEIRTTNPVATEQYGWVSTNDQLGPL

SEQ ID NO: 33653 - protein, 28 aa, Artificial Sequence
  Description of Artificial Sequence: Synthetic peptide
DEEEIAQTNPVATEQYGSVSTPLEVGNI

SEQ ID NO: 33654 - protein, 28 aa, Artificial Sequence
  Description of Artificial Sequence: Synthetic peptide
DEQEIRTTNPVATECYGDVSTNLERGEM

SEQ ID NO: 33655 - protein, 30 aa, Artificial Sequence
  Description of Artificial Sequence: Synthetic polypeptide
DEEEIRTVNPVATEQYGSYSSNTNLQRGEW

SEQ ID NO: 33656 - protein, 32 aa, Artificial Sequence
  Description of Artificial Sequence: Synthetic polypeptide
DEEEIRTTNPVATEQYGSVDSTTNQQRNGEDR

SEQ ID NO: 33657 - protein, 30 aa, Artificial Sequence
  Description of Artificial Sequence: Synthetic polypeptide
DEEEIRTTNPEATDQYGCVAATNGLQRGNR

SEQ ID NO: 33658 - protein, 28 aa, Artificial Sequence
  Description of Artificial Sequence: Synthetic peptide
DEEEIRTTNPVSTEQYGCVSVALQLGPR

SEQ ID NO: 33659 - protein, 29 aa, Artificial Sequence
  Description of Artificial Sequence: Synthetic peptide
DEEEIRTTNPVATEQYGDVSEDLQRGEDA

SEQ ID NO: 33660 - protein, 28 aa, Artificial Sequence
  Description of Artificial Sequence: Synthetic peptide
DEEEIRTTNPVATEQYGDVSENLQTEEN

SEQ ID NO: 33661 - protein, 28 aa, Artificial Sequence
  Description of Artificial Sequence: Synthetic peptide
KEEEIRTTNPVATECYGVVSTNLQIGDE

SEQ ID NO: 33662 - protein, 30 aa, Artificial Sequence
  Description of Artificial Sequence: Synthetic polypeptide
DDDEIRTTNPVATEQYGSVSTEDFQREGNR

SEQ ID NO: 33663 - protein, 31 aa, Artificial Sequence
  Description of Artificial Sequence: Synthetic polypeptide
DEEEIRTTNPVATEQYGSVSCEMDLQRGNDM

SEQ ID NO: 33664 - protein, 31 aa, Artificial Sequence
  Description of Artificial Sequence: Synthetic polypeptide
DEEEIRTTNPVATEQYGSVSTDLQEQEGNDQ

SEQ ID NO: 33665 - protein, 28 aa, Artificial Sequence
  Description of Artificial Sequence: Synthetic peptide
DETEISTTNPVASEVYGNVATNLQRGNR

SEQ ID NO: 33666 - protein, 30 aa, Artificial Sequence
  Description of Artificial Sequence: Synthetic polypeptide
DEEEIRTTNPVSTEQYGSVSCDLQDYGNDR

SEQ ID NO: 33667 - protein, 28 aa, Artificial Sequence
  Description of Artificial Sequence: Synthetic peptide
CESEIRTTNPVATEQYGSVATNLDAGDR

SEQ ID NO: 33668 - protein, 31 aa, Artificial Sequence
  Description of Artificial Sequence: Synthetic polypeptide
DEEEIRTTNPVATEQYGSVSCTMELCRGNDH

SEQ ID NO: 33669 - protein, 28 aa, Artificial Sequence
  Description of Artificial Sequence: Synthetic peptide
DEEEIRTTNPVATECYGVVSTDLETGNI

SEQ ID NO: 33670 - protein, 31 aa, Artificial Sequence
  Description of Artificial Sequence: Synthetic polypeptide
DENEIATTNPVATEQYGSVSTNGLQLRGEDR

SEQ ID NO: 33671 - protein, 31 aa, Artificial Sequence
  Description of Artificial Sequence: Synthetic polypeptide
DEEEIRTTNPVATEIYGVVSDTNLQVREGNV

SEQ ID NO: 33672 - protein, 30 aa, Artificial Sequence
  Description of Artificial Sequence: Synthetic polypeptide
DEEEIRTTNPVATEQYGSVSDTDLQTDGEE

SEQ ID NO: 33673 - protein, 28 aa, Artificial Sequence
  Description of Artificial Sequence: Synthetic peptide
DEQEIRTTNPVATEQYGSVSENEQQGDM

SEQ ID NO: 33674 - protein, 28 aa, Artificial Sequence
  Description of Artificial Sequence: Synthetic peptide
DEQEIATTNPVATECYGSVSTNLERGEL

SEQ ID NO: 33675 - protein, 30 aa, Artificial Sequence
  Description of Artificial Sequence: Synthetic polypeptide
DEEEIRTTNPVATEQYGVVSCENLQQGNDL

SEQ ID NO: 33676 - protein, 31 aa, Artificial Sequence
  Description of Artificial Sequence: Synthetic polypeptide
DEEEIRTTNPVATEQYGSVSTDNDVEGDGNR

SEQ ID NO: 33677 - protein, 29 aa, Artificial Sequence
  Description of Artificial Sequence: Synthetic peptide
DEEEIATTNPVATECYGSVSENLQGGNDQ

SEQ ID NO: 33678 - protein, 29 aa, Artificial Sequence
  Description of Artificial Sequence: Synthetic peptide
MENEIRTTNPVATEQYGSVSTDLQNGNDM

SEQ ID NO: 33679 - protein, 33 aa, Artificial Sequence
  Description of Artificial Sequence: Synthetic polypeptide
DEEEIRTTNPVATEQYGSVESDTNDQERGENER

SEQ ID NO: 33680 - protein, 28 aa, Artificial Sequence
  Description of Artificial Sequence: Synthetic peptide
DEEEIRPTNPDATEQYGSVSTNLEVGED

SEQ ID NO: 33681 - protein, 28 aa, Artificial Sequence
  Description of Artificial Sequence: Synthetic peptide
DEQEIMTTNPVATEQYGEVSENLQQGNA

SEQ ID NO: 33682 - protein, 28 aa, Artificial Sequence
  Description of Artificial Sequence: Synthetic peptide
DEESIRTTNPVATEQYGAVPVNLTRGNL

SEQ ID NO: 33683 - protein, 30 aa, Artificial Sequence
  Description of Artificial Sequence: Synthetic polypeptide
DENEIRTTNPVATEQYGSVSDTNLQHGEEV

SEQ ID NO: 33684 - protein, 30 aa, Artificial Sequence
  Description of Artificial Sequence: Synthetic polypeptide
DEEEIRTTNPVASEQWGSVCNNLQLRGANR

SEQ ID NO: 33685 - protein, 31 aa, Artificial Sequence
  Description of Artificial Sequence: Synthetic polypeptide
DEEEIRTTNPVATEQYGSVSTDLQEVEGNDD

SEQ ID NO: 33686 - protein, 30 aa, Artificial Sequence
  Description of Artificial Sequence: Synthetic polypeptide
DEEEIRATNPVATEQYGSVSENLQDQGDDR

SEQ ID NO: 33687 - protein, 32 aa, Artificial Sequence
  Description of Artificial Sequence: Synthetic polypeptide
NEEMIRTTNPVATEQYGSVSSCTNLQCREGNR

SEQ ID NO: 33688 - protein, 29 aa, Artificial Sequence
  Description of Artificial Sequence: Synthetic peptide
DEEEIAATNPVASECYGSVSTNLQLEGNR

SEQ ID NO: 33689 - protein, 28 aa, Artificial Sequence
  Description of Artificial Sequence: Synthetic peptide
DEEEIRTTNPLATEQYGDASTNLQYGDN

SEQ ID NO: 33690 - protein, 31 aa, Artificial Sequence
  Description of Artificial Sequence: Synthetic polypeptide
DEEEIRTTNPVATEQYGSVDVTNLTDNGNDR

SEQ ID NO: 33691 - protein, 28 aa, Artificial Sequence
  Description of Artificial Sequence: Synthetic peptide
AENEIRTTNPVATEQYGNVSENLQRGEA

SEQ ID NO: 33692 - protein, 28 aa, Artificial Sequence
  Description of Artificial Sequence: Synthetic peptide
DHEEIRTTNPVATEQYGSVWHGDQPGNR

SEQ ID NO: 33693 - protein, 28 aa, Artificial Sequence
  Description of Artificial Sequence: Synthetic peptide
QECEIVTTNPVATEIYGSVSTNLQLGNS

SEQ ID NO: 33694 - protein, 30 aa, Artificial Sequence
  Description of Artificial Sequence: Synthetic polypeptide
DEEEIRTTNPVATEQYGSVSTDLEDLNGNA

SEQ ID NO: 33695 - protein, 32 aa, Artificial Sequence
  Description of Artificial Sequence: Synthetic polypeptide
DEEEIRTTNPVATEQYGSVDSTNLEDRGDNEN

SEQ ID NO: 33696 - protein, 31 aa, Artificial Sequence
  Description of Artificial Sequence: Synthetic polypeptide
DEEEIRTTNPVATEQYGSVSETNLEENEGNW

SEQ ID NO: 33697 - protein, 29 aa, Artificial Sequence
  Description of Artificial Sequence: Synthetic peptide
DEEEVRCTNPVATEQWGESVSTDLQRGNP

SEQ ID NO: 33698 - protein, 29 aa, Artificial Sequence
  Description of Artificial Sequence: Synthetic peptide
DEEEIRTTNPVCTEQYGSVSEDEQAEGNR

SEQ ID NO: 33699 - protein, 28 aa, Artificial Sequence
  Description of Artificial Sequence: Synthetic peptide
DHEEIRTTNPVATEQYGSVWTNDDPGNP

SEQ ID NO: 33700 - protein, 29 aa, Artificial Sequence
  Description of Artificial Sequence: Synthetic peptide
DEEEIRTTNPVATEQYGEVSDNLIEHENR

SEQ ID NO: 33701 - protein, 31 aa, Artificial Sequence
  Description of Artificial Sequence: Synthetic polypeptide
DEHEIRTTNPVATEQYGDVSCTNLQCNGNDR

SEQ ID NO: 33702 - protein, 28 aa, Artificial Sequence
  Description of Artificial Sequence: Synthetic peptide
DEEEIRTTNPVATEQYGDVSEIEQRGDA

SEQ ID NO: 33703 - protein, 32 aa, Artificial Sequence
  Description of Artificial Sequence: Synthetic polypeptide
DEEEIRSTNPVATEQYGSVDGTNLVQARGTNR

SEQ ID NO: 33704 - protein, 31 aa, Artificial Sequence
  Description of Artificial Sequence: Synthetic polypeptide
DEEEIRTTNPVATEQYGSVSETNLVQHGEDF

SEQ ID NO: 33705 - protein, 31 aa, Artificial Sequence
  Description of Artificial Sequence: Synthetic polypeptide
MENEIRTTNPVATEQYGSVSTNLQDREGNDA

SEQ ID NO: 33706 - protein, 31 aa, Artificial Sequence
  Description of Artificial Sequence: Synthetic polypeptide
DEEEIRTTNPVATECYGSVSTNLQDREGEDD

SEQ ID NO: 33707 - protein, 31 aa, Artificial Sequence
  Description of Artificial Sequence: Synthetic polypeptide
DEEEIRTTNPVATEQYGSVISTNLPQHGPDA

SEQ ID NO: 33708 - protein, 32 aa, Artificial Sequence
  Description of Artificial Sequence: Synthetic polypeptide
DEEEIRTTNPVATEQYGSVSTENGDVQVGNDR

SEQ ID NO: 33709 - protein, 28 aa, Artificial Sequence
  Description of Artificial Sequence: Synthetic peptide
DEECIRPTNPVATQQYGSVSTNDFRGER

SEQ ID NO: 33710 - protein, 28 aa, Artificial Sequence
  Description of Artificial Sequence: Synthetic peptide
QEAEIRTTNPFATECYGSVSTNQQDGNR

SEQ ID NO: 33711 - protein, 32 aa, Artificial Sequence
  Description of Artificial Sequence: Synthetic polypeptide
DEEEIRTTNPVATEQYGSVSTANLQEIGDNTL

SEQ ID NO: 33712 - protein, 28 aa, Artificial Sequence
  Description of Artificial Sequence: Synthetic peptide
DENEIRQTNPVATEQYGVVSTDLQRGED

SEQ ID NO: 33713 - protein, 30 aa, Artificial Sequence
  Description of Artificial Sequence: Synthetic polypeptide
DEEEIRTTNPVATEMYGSVSAGNEPQRGNH

SEQ ID NO: 33714 - protein, 28 aa, Artificial Sequence
  Description of Artificial Sequence: Synthetic peptide
DEQEIRTTNPDATEQYGSVSTDDQIGER

SEQ ID NO: 33715 - protein, 29 aa, Artificial Sequence
  Description of Artificial Sequence: Synthetic peptide
DEEELRTTNPVATEQYGVCSADNLQRGNM

SEQ ID NO: 33716 - protein, 32 aa, Artificial Sequence
  Description of Artificial Sequence: Synthetic polypeptide
DEEEIRTTNPVATEQYGMSVHQTNLQIRGDNP

SEQ ID NO: 33717 - protein, 31 aa, Artificial Sequence
  Description of Artificial Sequence: Synthetic polypeptide
DEEEIRTTNPVATEQYGSVASTTNLIYHGNP

SEQ ID NO: 33718 - protein, 30 aa, Artificial Sequence
  Description of Artificial Sequence: Synthetic polypeptide
DEEDIRTTNPVATEQYGMVSTNLQMAHGND

SEQ ID NO: 33719 - protein, 28 aa, Artificial Sequence
  Description of Artificial Sequence: Synthetic peptide
AEEEIAQTNPVATEQYGVVSTNLQRGED

SEQ ID NO: 33720 - protein, 28 aa, Artificial Sequence
  Description of Artificial Sequence: Synthetic peptide
GEDEIRTTNPVGTEQYGEVPVNLQRGNR

SEQ ID NO: 33721 - protein, 30 aa, Artificial Sequence
  Description of Artificial Sequence: Synthetic polypeptide
DEEEIRTTNPVATEQYGSVSTEDDDVEGNR

SEQ ID NO: 33722 - protein, 28 aa, Artificial Sequence
  Description of Artificial Sequence: Synthetic peptide
DEGEITTTNPVATEHYGSVSTNWQIGNY

SEQ ID NO: 33723 - protein, 31 aa, Artificial Sequence
  Description of Artificial Sequence: Synthetic polypeptide
SEEEIRCTNPVATEVYGSVISATNLQRGVNR

SEQ ID NO: 33724 - protein, 29 aa, Artificial Sequence
  Description of Artificial Sequence: Synthetic peptide
DEEEIRTTNPVAFEQYGSVDTNLQAPGEM

SEQ ID NO: 33725 - protein, 28 aa, Artificial Sequence
  Description of Artificial Sequence: Synthetic peptide
DEEEIRTTNPVATEQYGDVSTEPQIGEY

SEQ ID NO: 33726 - protein, 29 aa, Artificial Sequence
  Description of Artificial Sequence: Synthetic peptide
DEEEIRTTNPVSTECYGSVSTNDQRGTDY

SEQ ID NO: 33727 - protein, 28 aa, Artificial Sequence
  Description of Artificial Sequence: Synthetic peptide
DENEIRTTNPVATECWGSVSENLERGNA

SEQ ID NO: 33728 - protein, 29 aa, Artificial Sequence
  Description of Artificial Sequence: Synthetic peptide
DEEEIRTTNPVATECYGSVSTDLQHGEDA

SEQ ID NO: 33729 - protein, 30 aa, Artificial Sequence
  Description of Artificial Sequence: Synthetic polypeptide
SEEEIRTTNPTATECYGSVSTMNEQRGPNR

SEQ ID NO: 33730 - protein, 31 aa, Artificial Sequence
  Description of Artificial Sequence: Synthetic polypeptide
DEEEIRTTNPVATEQYGNVSETDWQFRGNDR

SEQ ID NO: 33731 - protein, 33 aa, Artificial Sequence
  Description of Artificial Sequence: Synthetic polypeptide
DEEEIRTTNPVATEQYGSVSETDLVQERGENDR

SEQ ID NO: 33732 - protein, 31 aa, Artificial Sequence
  Description of Artificial Sequence: Synthetic polypeptide
DEEEIRTTNPVATEQYGSVSTMDLQQQAGNT

SEQ ID NO: 33733 - protein, 29 aa, Artificial Sequence
  Description of Artificial Sequence: Synthetic peptide
DEEEIRCTNPVAYEIYGSVGNNLQREGNR

SEQ ID NO: 33734 - protein, 29 aa, Artificial Sequence
  Description of Artificial Sequence: Synthetic peptide
DEEEIRTTNPVATECYGSVDTNLMMRGTS

SEQ ID NO: 33735 - protein, 32 aa, Artificial Sequence
  Description of Artificial Sequence: Synthetic polypeptide
DEEEIRTTNPTATEQYGSVDSTNDQNREGNFR

SEQ ID NO: 33736 - protein, 28 aa, Artificial Sequence
  Description of Artificial Sequence: Synthetic peptide
DEGEVMTTNPVATECYGSVSSNLQRGNE

SEQ ID NO: 33737 - protein, 28 aa, Artificial Sequence
  Description of Artificial Sequence: Synthetic peptide
NENEIVTTNPVATEQYGVASDNLQRGNR

SEQ ID NO: 33738 - protein, 29 aa, Artificial Sequence
  Description of Artificial Sequence: Synthetic peptide
DEEEIRTTNPVATEQWGSVDTNEQMIGNF

SEQ ID NO: 33739 - protein, 29 aa, Artificial Sequence
  Description of Artificial Sequence: Synthetic peptide
DEEEIRTTNPVATEMYGEVSMNDVQRGND

SEQ ID NO: 33740 - protein, 28 aa, Artificial Sequence
  Description of Artificial Sequence: Synthetic peptide
DEEEIRTTNPFATEQYGSVSTDQQQGEY

SEQ ID NO: 33741 - protein, 31 aa, Artificial Sequence
  Description of Artificial Sequence: Synthetic polypeptide
DEMEIRCTNPVATEQYGSVSTNSIQFRGNDR

SEQ ID NO: 33742 - protein, 30 aa, Artificial Sequence
  Description of Artificial Sequence: Synthetic polypeptide
DEEEIRTTNPVATEIYGSVSTELQEDGEDR

SEQ ID NO: 33743 - protein, 31 aa, Artificial Sequence
  Description of Artificial Sequence: Synthetic polypeptide
DEEEIRTTNPCATEQYGSVDTMNLQQRGNDM

SEQ ID NO: 33744 - protein, 31 aa, Artificial Sequence
  Description of Artificial Sequence: Synthetic polypeptide
DEEEIRTTNPVATEQYGSVDTNDQQVEGNDR

SEQ ID NO: 33745 - protein, 29 aa, Artificial Sequence
  Description of Artificial Sequence: Synthetic peptide
DEQEIRTTNPVATEQYGAVSENLQEGGNF

SEQ ID NO: 33746 - protein, 28 aa, Artificial Sequence
  Description of Artificial Sequence: Synthetic peptide
AESEIASTNPVATELYGSVATNLQRGNR

SEQ ID NO: 33747 - protein, 31 aa, Artificial Sequence
  Description of Artificial Sequence: Synthetic polypeptide
DEEEIRTTNPFATEQYGSVASTDNLQDGIER

SEQ ID NO: 33748 - protein, 28 aa, Artificial Sequence
  Description of Artificial Sequence: Synthetic peptide
KEEEIRTTNPVATEQYGSVSEDLQREDQ

SEQ ID NO: 33749 - protein, 29 aa, Artificial Sequence
  Description of Artificial Sequence: Synthetic peptide
DENEIRTTNPVATECYGSVSTDLQDSGNM

SEQ ID NO: 33750 - protein, 30 aa, Artificial Sequence
  Description of Artificial Sequence: Synthetic polypeptide
DEEEIRTTNPVATEQYGDASCTNEQRGDDR

SEQ ID NO: 33751 - protein, 32 aa, Artificial Sequence
  Description of Artificial Sequence: Synthetic polypeptide
DEEEIRTTNPEATEQYGSVSTPLQIREGDNDR

SEQ ID NO: 33752 - protein, 28 aa, Artificial Sequence
  Description of Artificial Sequence: Synthetic peptide
SEGEITTTNPVATEIYGSVSENLQHGNR

SEQ ID NO: 33753 - protein, 28 aa, Artificial Sequence
  Description of Artificial Sequence: Synthetic peptide
DEEEIVTTNPVATEQYGSVSTDLESGEL

SEQ ID NO: 33754 - protein, 28 aa, Artificial Sequence
  Description of Artificial Sequence: Synthetic peptide
EEEEICTTNPVATETYGSVSEALQRGNS

SEQ ID NO: 33755 - protein, 31 aa, Artificial Sequence
  Description of Artificial Sequence: Synthetic polypeptide
DEEEIRTTNPVATEQYGSVSETNLEDNGENW

SEQ ID NO: 33756 - protein, 33 aa, Artificial Sequence
  Description of Artificial Sequence: Synthetic polypeptide
DEEEIRTTNPVATEQYGSVESDTNPLERDGDNR

SEQ ID NO: 33757 - protein, 32 aa, Artificial Sequence
  Description of Artificial Sequence: Synthetic polypeptide
DEEEIRTTNPVATEQYGSVSETNLQDDDGNEE

SEQ ID NO: 33758 - protein, 28 aa, Artificial Sequence
  Description of Artificial Sequence: Synthetic peptide
DEGEIRTTNPVATELYGSVSTNLQQEPQ

SEQ ID NO: 33759 - protein, 31 aa, Artificial Sequence
  Description of Artificial Sequence: Synthetic polypeptide
DEEEIRTTNPVATEQYGSVSDTDLQIKGNDH

SEQ ID NO: 33760 - protein, 29 aa, Artificial Sequence
  Description of Artificial Sequence: Synthetic peptide
DENEIATTNPVATEQYGSVSTNLEEVGNA

SEQ ID NO: 33761 - protein, 28 aa, Artificial Sequence
  Description of Artificial Sequence: Synthetic peptide
VEEEIRTTNPVATEQYGSVGYNLMRGPI

SEQ ID NO: 33762 - protein, 28 aa, Artificial Sequence
  Description of Artificial Sequence: Synthetic peptide
DENEIRTTNPVATEQYGDVSEDPQRGNA

SEQ ID NO: 33763 - protein, 31 aa, Artificial Sequence
  Description of Artificial Sequence: Synthetic polypeptide
DEEEIRTTNPVATEQYGSVSSTNWPQQGNFQ

SEQ ID NO: 33764 - protein, 30 aa, Artificial Sequence
  Description of Artificial Sequence: Synthetic polypeptide
DEEEIRTTNPVATEQYGDVSCTDLCRGNDV

SEQ ID NO: 33765 - protein, 28 aa, Artificial Sequence
  Description of Artificial Sequence: Synthetic peptide
DEEEIRTTNPVATEQYGDVWTTDQSGNA

SEQ ID NO: 33766 - protein, 32 aa, Artificial Sequence
  Description of Artificial Sequence: Synthetic polypeptide
DEEEIRTTNPVATEQYGSVSATNLQLVNGNDA

SEQ ID NO: 33767 - protein, 29 aa, Artificial Sequence
  Description of Artificial Sequence: Synthetic peptide
DEEEIATTNPVATEQYGSVSTDLQINGEL

SEQ ID NO: 33768 - protein, 30 aa, Artificial Sequence
  Description of Artificial Sequence: Synthetic polypeptide
DEEEIRTTNPVATEQYGSVSTDLQEQNGEQ

SEQ ID NO: 33769 - protein, 30 aa, Artificial Sequence
  Description of Artificial Sequence: Synthetic polypeptide
SEEEIRTTNPVATEQFGSVSTANLQLGDNN

SEQ ID NO: 33770 - protein, 28 aa, Artificial Sequence
  Description of Artificial Sequence: Synthetic peptide
SEEEIRTTNPTATEQFGSVSTNLQQGTF

SEQ ID NO: 33771 - protein, 29 aa, Artificial Sequence
  Description of Artificial Sequence: Synthetic peptide
DEEEIRTTNPVATECYGVTSTNEQRGPNG

SEQ ID NO: 33772 - protein, 30 aa, Artificial Sequence
  Description of Artificial Sequence: Synthetic polypeptide
DEEEIRTTNPSATEQYGSVSTNLDAQENDR

SEQ ID NO: 33773 - protein, 31 aa, Artificial Sequence
  Description of Artificial Sequence: Synthetic polypeptide
DEEEIRTTNPVATEQYGSVMSTDNLVYDGNT

SEQ ID NO: 33774 - protein, 28 aa, Artificial Sequence
  Description of Artificial Sequence: Synthetic peptide
HEEELATTNPVSTEMYGAVSTNLQRGNR

SEQ ID NO: 33775 - protein, 30 aa, Artificial Sequence
  Description of Artificial Sequence: Synthetic polypeptide
DEEEIRTTNPVATECYGHVSTGNLQRKENL

SEQ ID NO: 33776 - protein, 29 aa, Artificial Sequence
  Description of Artificial Sequence: Synthetic peptide
SEEEIRTTNPAATEQYGSVSTNLQQGVDV

SEQ ID NO: 33777 - protein, 30 aa, Artificial Sequence
  Description of Artificial Sequence: Synthetic polypeptide
NEHEIRTTNPCATEVYGSVSTMNLQRGNDR

SEQ ID NO: 33778 - protein, 30 aa, Artificial Sequence
  Description of Artificial Sequence: Synthetic polypeptide
DEEEIRTTNPVATECYGSVSTNLQHNGEDD

SEQ ID NO: 33779 - protein, 28 aa, Artificial Sequence
  Description of Artificial Sequence: Synthetic peptide
DENEIATTNPVATECYGSVSTDLQDGNA

SEQ ID NO: 33780 - protein, 28 aa, Artificial Sequence
  Description of Artificial Sequence: Synthetic peptide
GEEEIAGTNPVATEMYGNVSTNLQRGNI

SEQ ID NO: 33781 - protein, 28 aa, Artificial Sequence
  Description of Artificial Sequence: Synthetic peptide
DENEIRTTNPAATEQYGTVSTNLQIGPH

SEQ ID NO: 33782 - protein, 28 aa, Artificial Sequence
  Description of Artificial Sequence: Synthetic peptide
CEEEIRSTNPVATEVYGSVSTNGELGNR

SEQ ID NO: 33783 - protein, 31 aa, Artificial Sequence
  Description of Artificial Sequence: Synthetic polypeptide
NEEEIRTTNPVATELYGSVSTMNLQENGNFR

SEQ ID NO: 33784 - protein, 31 aa, Artificial Sequence
  Description of Artificial Sequence: Synthetic polypeptide
MEEEIRTTNPVATEQYGSVSTNLQETEGNDM

SEQ ID NO: 33785 - protein, 28 aa, Artificial Sequence
  Description of Artificial Sequence: Synthetic peptide
DEQEIRTTNPVATEIYGSVSTQEQQGNF

SEQ ID NO: 33786 - protein, 28 aa, Artificial Sequence
  Description of Artificial Sequence: Synthetic peptide
DEEEIRSTNPVGTEQYGEVSTNDEVGNR

SEQ ID NO: 33787 - protein, 28 aa, Artificial Sequence
  Description of Artificial Sequence: Synthetic peptide
DEEEIMTTNPTATEQYGVVSTGLQGGLR

SEQ ID NO: 33788 - protein, 28 aa, Artificial Sequence
  Description of Artificial Sequence: Synthetic peptide
DEQEIRTTNPVATEQYGSVETPLQIGEI

SEQ ID NO: 33789 - protein, 30 aa, Artificial Sequence
  Description of Artificial Sequence: Synthetic polypeptide
DEEEIRTTNPVATEQYGSVSQEALMLNGNR

SEQ ID NO: 33790 - protein, 28 aa, Artificial Sequence
  Description of Artificial Sequence: Synthetic peptide
DEQEIRCTNPVASEIYGCVSTNLERGNR

SEQ ID NO: 33791 - protein, 29 aa, Artificial Sequence
  Description of Artificial Sequence: Synthetic peptide
DEEEIRATNPVATEQYGSVSENEQRSENF

SEQ ID NO: 33792 - protein, 32 aa, Artificial Sequence
  Description of Artificial Sequence: Synthetic polypeptide
DEEEIRTTNPVATEQYGSVSTMNLQLIEGDNF

SEQ ID NO: 33793 - protein, 30 aa, Artificial Sequence
  Description of Artificial Sequence: Synthetic polypeptide
DEQEIATTNPVATEQYGSVSCTDLQQHGNR

SEQ ID NO: 33794 - protein, 28 aa, Artificial Sequence
  Description of Artificial Sequence: Synthetic peptide
DAEEIRPTNPVAYENYGSVDTNDQRGNR

SEQ ID NO: 33795 - protein, 29 aa, Artificial Sequence
  Description of Artificial Sequence: Synthetic peptide
DEQEIRTTNPVASEIYGCVSATNLERGNR

SEQ ID NO: 33796 - protein, 28 aa, Artificial Sequence
  Description of Artificial Sequence: Synthetic peptide
DEEPIRTTNPVATQQYGAVSTELDRGND

SEQ ID NO: 33797 - protein, 31 aa, Artificial Sequence
  Description of Artificial Sequence: Synthetic polypeptide
DEEEIRTTNPVATEQYGSVSTDPLEDDGNDR

SEQ ID NO: 33798 - protein, 28 aa, Artificial Sequence
  Description of Artificial Sequence: Synthetic peptide
SEGEIYATNPVATEQYGGVSTNLQRGNQ

SEQ ID NO: 33799 - protein, 28 aa, Artificial Sequence
  Description of Artificial Sequence: Synthetic peptide
DEGEITSTNPVATENYGAVSNNLQRGNR

SEQ ID NO: 33800 - protein, 30 aa, Artificial Sequence
  Description of Artificial Sequence: Synthetic polypeptide
DEEEIATTNPVATEMYGVVSTGNLQRGVNF

SEQ ID NO: 33801 - protein, 32 aa, Artificial Sequence
  Description of Artificial Sequence: Synthetic polypeptide
DEEEIRTTNPVATEQYGSVSTDNLQESDGNDF

SEQ ID NO: 33802 - protein, 32 aa, Artificial Sequence
  Description of Artificial Sequence: Synthetic polypeptide
DEEEIRTTNPVATEQYGSVSETNLEERDGNED

SEQ ID NO: 33803 - protein, 32 aa, Artificial Sequence
  Description of Artificial Sequence: Synthetic polypeptide
DEEEIRTTNPVATEQYGSYVEETLPLQIRGNR

SEQ ID NO: 33804 - protein, 29 aa, Artificial Sequence
  Description of Artificial Sequence: Synthetic peptide
DEEEIRTTNPVATEQYGSVSCTDDCAGNF

SEQ ID NO: 33805 - protein, 31 aa, Artificial Sequence
  Description of Artificial Sequence: Synthetic polypeptide
DEEEIATTNPTATEQYGSVSTNLQDNEGDNR

SEQ ID NO: 33806 - protein, 31 aa, Artificial Sequence
  Description of Artificial Sequence: Synthetic polypeptide
DEEEIRTTNPVATEQYGWVCSATNLQREGEN

SEQ ID NO: 33807 - protein, 31 aa, Artificial Sequence
  Description of Artificial Sequence: Synthetic polypeptide
DEEEIRTTNPVATEQYGSVSTTGLVERGDNE

SEQ ID NO: 33808 - protein, 28 aa, Artificial Sequence
  Description of Artificial Sequence: Synthetic peptide
DEEEIRTTNPFATEQYGSVSTGDDDGNP

SEQ ID NO: 33809 - protein, 29 aa, Artificial Sequence
  Description of Artificial Sequence: Synthetic peptide
NEEEIRTTNPVATEQYGSVSNNLQTHLNT

SEQ ID NO: 33810 - protein, 29 aa, Artificial Sequence
  Description of Artificial Sequence: Synthetic peptide
DEEEIRTTNPVATEQYGSVSCEDDCHGNR

SEQ ID NO: 33811 - protein, 28 aa, Artificial Sequence
  Description of Artificial Sequence: Synthetic peptide
GEEEIRTTNPVATEMYGSVSTELQHGEW

SEQ ID NO: 33812 - protein, 28 aa, Artificial Sequence
  Description of Artificial Sequence: Synthetic peptide
HEEEIRCTNPVATEQYGTAGTNLQRGNS

SEQ ID NO: 33813 - protein, 29 aa, Artificial Sequence
  Description of Artificial Sequence: Synthetic peptide
MENEIRTTNPVATEQYGSVSTNLQNGDDF

SEQ ID NO: 33814 - protein, 29 aa, Artificial Sequence
  Description of Artificial Sequence: Synthetic peptide
DEEEIRTTNPVATEQYGSVSENEMNQGNW

SEQ ID NO: 33815 - protein, 28 aa, Artificial Sequence
  Description of Artificial Sequence: Synthetic peptide
DEEEIRTTNPVATELWGSVSTNEERGDS

SEQ ID NO: 33816 - protein, 32 aa, Artificial Sequence
  Description of Artificial Sequence: Synthetic polypeptide
DEEEIRTTNPVATEQYGSVDETNLVQDRKGDR

SEQ ID NO: 33817 - protein, 29 aa, Artificial Sequence
  Description of Artificial Sequence: Synthetic peptide
DEQEIATTNPVATECYGSVSTDLQDIGNR

SEQ ID NO: 33818 - protein, 33 aa, Artificial Sequence
  Description of Artificial Sequence: Synthetic polypeptide
DEEEIRTTNPVATEQYGSVTSTLNLVQINGNDR

SEQ ID NO: 33819 - protein, 29 aa, Artificial Sequence
  Description of Artificial Sequence: Synthetic peptide
DEEEIRATNPVATEQYGVVSTDLQREGET

SEQ ID NO: 33820 - protein, 28 aa, Artificial Sequence
  Description of Artificial Sequence: Synthetic peptide
DEEEIVCTNPVATEQYGSVSMELQMGNQ

SEQ ID NO: 33821 - protein, 28 aa, Artificial Sequence
  Description of Artificial Sequence: Synthetic peptide
SEEEIRCTNPVSTEQYGIVSTNDQLGNR

SEQ ID NO: 33822 - protein, 30 aa, Artificial Sequence
  Description of Artificial Sequence: Synthetic polypeptide
DEEEIRTTNPVATEQYGSVPTCNPCRENDR

SEQ ID NO: 33823 - protein, 30 aa, Artificial Sequence
  Description of Artificial Sequence: Synthetic polypeptide
DEEEIRTTNPDATEQYGSVSETNEQRKEDR

SEQ ID NO: 33824 - protein, 30 aa, Artificial Sequence
  Description of Artificial Sequence: Synthetic polypeptide
DEEEIRTTNPVATEQYGSCAENLQERGDDR

SEQ ID NO: 33825 - protein, 31 aa, Artificial Sequence
  Description of Artificial Sequence: Synthetic polypeptide
DEEEIATTNPVATEQYGSVSATDLQEHEGNR

SEQ ID NO: 33826 - protein, 33 aa, Artificial Sequence
  Description of Artificial Sequence: Synthetic polypeptide
DEEEIRTTNPVATEQYGSVSTNLPQLREGENTN

SEQ ID NO: 33827 - protein, 30 aa, Artificial Sequence
  Description of Artificial Sequence: Synthetic polypeptide
DENEIRTTNPVATECYGSVSATNLQQGEDR

SEQ ID NO: 33828 - protein, 33 aa, Artificial Sequence
  Description of Artificial Sequence: Synthetic polypeptide
DEEEIRTTNPEATEQYGSVCSTNLQQRDGVNPR

SEQ ID NO: 33829 - protein, 28 aa, Artificial Sequence
  Description of Artificial Sequence: Synthetic peptide
DEEEIRTTNPASTELYGVVSANLQRGNE

SEQ ID NO: 33830 - protein, 29 aa, Artificial Sequence
  Description of Artificial Sequence: Synthetic peptide
DEEEIRTTNPVATEQYGVVSNCILQLGER

SEQ ID NO: 33831 - protein, 31 aa, Artificial Sequence
  Description of Artificial Sequence: Synthetic polypeptide
DEEEIRQTNPVATEQYGSVSTLNLQRKGDEN

SEQ ID NO: 33832 - protein, 30 aa, Artificial Sequence
  Description of Artificial Sequence: Synthetic polypeptide
GEEEIATTNPVATEQYGSVSTDLQEREGNF

SEQ ID NO: 33833 - protein, 28 aa, Artificial Sequence
  Description of Artificial Sequence: Synthetic peptide
DEEEIRTTNPFATEQYGSVSTNGIGGEL

SEQ ID NO: 33834 - protein, 28 aa, Artificial Sequence
  Description of Artificial Sequence: Synthetic peptide
DEEEIRPTNPVAAEQYGSVSTNLQDEEP

SEQ ID NO: 33835 - protein, 28 aa, Artificial Sequence
  Description of Artificial Sequence: Synthetic peptide
DEEEIRTTNPCATEPYGDVSTEDQAGNR

SEQ ID NO: 33836 - protein, 33 aa, Artificial Sequence
  Description of Artificial Sequence: Synthetic polypeptide
DEEEIRTTNPVATEQYGSVDSETNLPLPREGNR

SEQ ID NO: 33837 - protein, 29 aa, Artificial Sequence
  Description of Artificial Sequence: Synthetic peptide
DEEEIRATNPVATEQYGVVSTELQDWGNT

SEQ ID NO: 33838 - protein, 31 aa, Artificial Sequence
  Description of Artificial Sequence: Synthetic polypeptide
DEEEIRTTNPVATEQYGHSVFENCLQTKGNR

SEQ ID NO: 33839 - protein, 30 aa, Artificial Sequence
  Description of Artificial Sequence: Synthetic polypeptide
DEEEIRTTNPVATEQYGSVSTEPLQVEGEQ

SEQ ID NO: 33840 - protein, 28 aa, Artificial Sequence
  Description of Artificial Sequence: Synthetic peptide
MEQEIRTTNPVATEQYGSVSENLQNGDV

SEQ ID NO: 33841 - protein, 28 aa, Artificial Sequence
  Description of Artificial Sequence: Synthetic peptide
DEEEIRTTNPVATEQYGSVSECLQHEEQ

SEQ ID NO: 33842 - protein, 29 aa, Artificial Sequence
  Description of Artificial Sequence: Synthetic peptide
DEEELRTTNPVATEQYGSVSTDLQEHGDM

SEQ ID NO: 33843 - protein, 31 aa, Artificial Sequence
  Description of Artificial Sequence: Synthetic polypeptide
DEEEIRTTNPVATECYGSVSATNLERNGDNA

SEQ ID NO: 33844 - protein, 31 aa, Artificial Sequence
  Description of Artificial Sequence: Synthetic polypeptide
DEEEIATTNPVATEQYGDVSCTNLQRAGEDR

SEQ ID NO: 33845 - protein, 31 aa, Artificial Sequence
  Description of Artificial Sequence: Synthetic polypeptide
DEEEIRTTNPVATEQYGDVDCTNLQQCHGNR

SEQ ID NO: 33846 - protein, 28 aa, Artificial Sequence
  Description of Artificial Sequence: Synthetic peptide
DEEEIATTNPVATECYGSVSTDLERGED

SEQ ID NO: 33847 - protein, 31 aa, Artificial Sequence
  Description of Artificial Sequence: Synthetic polypeptide
SEEEIRTTNPVATEQYGSVSTPNPGQRDGNL

SEQ ID NO: 33848 - protein, 28 aa, Artificial Sequence
  Description of Artificial Sequence: Synthetic peptide
DEEEIRTTNPVATEQYGSAPTCPQHGER

SEQ ID NO: 33849 - protein, 28 aa, Artificial Sequence
  Description of Artificial Sequence: Synthetic peptide
DEQEIRTTNPVATEQWGSVDTNEQQGNM

SEQ ID NO: 33850 - protein, 28 aa, Artificial Sequence
  Description of Artificial Sequence: Synthetic peptide
DTEEIRTTNPVATETYGSVQGNLQGGNP

SEQ ID NO: 33851 - protein, 28 aa, Artificial Sequence
  Description of Artificial Sequence: Synthetic peptide
DEEEIRTTNPVATEQYGSVEDPDQDENR

SEQ ID NO: 33852 - protein, 30 aa, Artificial Sequence
  Description of Artificial Sequence: Synthetic polypeptide
DEEEIRTTNPVATEQYGSVDTVNNPQYGNE

SEQ ID NO: 33853 - protein, 31 aa, Artificial Sequence
  Description of Artificial Sequence: Synthetic polypeptide
DEEEIRTTNPVATEQYGSVSTDLDQREGTDW

SEQ ID NO: 33854 - protein, 31 aa, Artificial Sequence
  Description of Artificial Sequence: Synthetic polypeptide
GEEEIRATNPVATEQYGSVSTGNLQIGENDR

SEQ ID NO: 33855 - protein, 30 aa, Artificial Sequence
  Description of Artificial Sequence: Synthetic polypeptide
DEQEIRCTNPVATEIYGCVSATNLQRNGNR

SEQ ID NO: 33856 - protein, 32 aa, Artificial Sequence
  Description of Artificial Sequence: Synthetic polypeptide
DEEEIRTTNPVATEQYGSVETLNPLQRGDEPR

SEQ ID NO: 33857 - protein, 28 aa, Artificial Sequence
  Description of Artificial Sequence: Synthetic peptide
QEAEIVSTNPVATEQYGSVSTDLERGNR

SEQ ID NO: 33858 - protein, 28 aa, Artificial Sequence
  Description of Artificial Sequence: Synthetic peptide
SEVEIATTNPVATEMFGGVSTNLQRGNR

SEQ ID NO: 33859 - protein, 28 aa, Artificial Sequence
  Description of Artificial Sequence: Synthetic peptide
QEEEISTTNPVATEQYGSADTALQAGNR

SEQ ID NO: 33860 - protein, 28 aa, Artificial Sequence
  Description of Artificial Sequence: Synthetic peptide
SEEEIRTTNPVATEVYGSYSTNLETGNQ

SEQ ID NO: 33861 - protein, 28 aa, Artificial Sequence
  Description of Artificial Sequence: Synthetic peptide
DEEEIRTTNPVATEQYGSVETPEQDGES

SEQ ID NO: 33862 - protein, 31 aa, Artificial Sequence
  Description of Artificial Sequence: Synthetic polypeptide
DEEEIRTTNPVATEQYGSHYSTNLQNRVENH

SEQ ID NO: 33863 - protein, 28 aa, Artificial Sequence
  Description of Artificial Sequence: Synthetic peptide
DEEEIRTTNPVATELYGGVSANPQSENR

SEQ ID NO: 33864 - protein, 28 aa, Artificial Sequence
  Description of Artificial Sequence: Synthetic peptide
DEIEITSTNPVATEQYGSVSTNLIPGER

SEQ ID NO: 33865 - protein, 29 aa, Artificial Sequence
  Description of Artificial Sequence: Synthetic peptide
DEEEITTTNPVATEQYGSVSTNQDPGEPR

SEQ ID NO: 33866 - protein, 28 aa, Artificial Sequence
  Description of Artificial Sequence: Synthetic peptide
DEQEITTTNPVCTEQYGSVSEDLQHGNR

SEQ ID NO: 33867 - protein, 28 aa, Artificial Sequence
  Description of Artificial Sequence: Synthetic peptide
DEEEIRTTNPVAYEIYGSVWTNDQPGNP

SEQ ID NO: 33868 - protein, 28 aa, Artificial Sequence
  Description of Artificial Sequence: Synthetic peptide
DEEEIRATNPVATEQYGTMATNLQEGER

SEQ ID NO: 33869 - protein, 29 aa, Artificial Sequence
  Description of Artificial Sequence: Synthetic peptide
SEEEIRCTNPVATELYGSVSTNDQNRGTR

SEQ ID NO: 33870 - protein, 32 aa, Artificial Sequence
  Description of Artificial Sequence: Synthetic polypeptide
DEEEITTTNPVATEQYGSVSATNLQEHNGDNR

SEQ ID NO: 33871 - protein, 28 aa, Artificial Sequence
  Description of Artificial Sequence: Synthetic peptide
DEEEIRTTNPVATECYGSVSTDLEYGED

SEQ ID NO: 33872 - protein, 28 aa, Artificial Sequence
  Description of Artificial Sequence: Synthetic peptide
DEQEIRTTNPEATEQYGSVSTELQKDNL

SEQ ID NO: 33873 - protein, 32 aa, Artificial Sequence
  Description of Artificial Sequence: Synthetic polypeptide
DEEEIRTTNPVATEQYGSVSTNDVEERGENDR

SEQ ID NO: 33874 - protein, 28 aa, Artificial Sequence
  Description of Artificial Sequence: Synthetic peptide
DEVEIRTTNPVATECFGGVSTDLQGGNR

SEQ ID NO: 33875 - protein, 28 aa, Artificial Sequence
  Description of Artificial Sequence: Synthetic peptide
NEEELRTTNPVATEIYGSVSNNLQRPTR

SEQ ID NO: 33876 - protein, 28 aa, Artificial Sequence
  Description of Artificial Sequence: Synthetic peptide
SEEEIATVNPVATEQWGSVSTNLQRGEA

SEQ ID NO: 33877 - protein, 29 aa, Artificial Sequence
  Description of Artificial Sequence: Synthetic peptide
DDNEIRTTNPVATEQYGSVSENLQEHGNM

SEQ ID NO: 33878 - protein, 33 aa, Artificial Sequence
  Description of Artificial Sequence: Synthetic polypeptide
DEEEIRTTNPVATEQYGSYVSTTNLTQEDGENR

SEQ ID NO: 33879 - protein, 28 aa, Artificial Sequence
  Description of Artificial Sequence: Synthetic peptide
YEEEIRTTNPCATELYGVVSTNDQRGNM

SEQ ID NO: 33880 - protein, 28 aa, Artificial Sequence
  Description of Artificial Sequence: Synthetic peptide
MEQEIRTTNPVATECYGSVSTNLQNGDM

SEQ ID NO: 33881 - protein, 28 aa, Artificial Sequence
  Description of Artificial Sequence: Synthetic peptide
SEEEIRTTNPAATEQFGSVSTNEQRGTH

SEQ ID NO: 33882 - protein, 28 aa, Artificial Sequence
  Description of Artificial Sequence: Synthetic peptide
DEEEIRTTNPVATEIYGVVDMDLQRGNQ

SEQ ID NO: 33883 - protein, 29 aa, Artificial Sequence
  Description of Artificial Sequence: Synthetic peptide
DEEEIRTVNPVGTEQWGSVSTENLQRGDQ

SEQ ID NO: 33884 - protein, 28 aa, Artificial Sequence
  Description of Artificial Sequence: Synthetic peptide
DEEEIRTTNPVATEQYGSFSEFEQRGQN

SEQ ID NO: 33885 - protein, 30 aa, Artificial Sequence
  Description of Artificial Sequence: Synthetic polypeptide
DEEEIRTTNPVSTEQYGSVSCSEEQRFGNR

SEQ ID NO: 33886 - protein, 29 aa, Artificial Sequence
  Description of Artificial Sequence: Synthetic peptide
NETEIRTTNPVATEQYGSVSTPPQARGNS

SEQ ID NO: 33887 - protein, 28 aa, Artificial Sequence
  Description of Artificial Sequence: Synthetic peptide
AENEIATTNPVATEQYGDASTNLMRGNR

SEQ ID NO: 33888 - protein, 28 aa, Artificial Sequence
  Description of Artificial Sequence: Synthetic peptide
SEEEIRTTNPVATEQYGIVDTNDQRGDY

SEQ ID NO: 33889 - protein, 31 aa, Artificial Sequence
  Description of Artificial Sequence: Synthetic polypeptide
DEEEIRTTNPVATEQWGSVSTNEPQDRGENG

SEQ ID NO: 33890 - protein, 31 aa, Artificial Sequence
  Description of Artificial Sequence: Synthetic polypeptide
DEEEIRTTNPVATECYGSVSTDLQDHNGNDR

SEQ ID NO: 33891 - protein, 31 aa, Artificial Sequence
  Description of Artificial Sequence: Synthetic polypeptide
DEQEIRTTNPVATEQYGSVDSETNLEDRGNL

SEQ ID NO: 33892 - protein, 28 aa, Artificial Sequence
  Description of Artificial Sequence: Synthetic peptide
DEEEIRTTNPFATEQYGSVSTADQVGED

SEQ ID NO: 33893 - protein, 28 aa, Artificial Sequence
  Description of Artificial Sequence: Synthetic peptide
DENEIASVNPVATEHYGTVSTNLQRGNR

SEQ ID NO: 33894 - protein, 31 aa, Artificial Sequence
  Description of Artificial Sequence: Synthetic polypeptide
DENEIATTNPVATEQYGSVDSTDLVQRGENR

SEQ ID NO: 33895 - protein, 28 aa, Artificial Sequence
  Description of Artificial Sequence: Synthetic peptide
DEEEIRTTNPEATEQYGSVSTEDQVGEF

SEQ ID NO: 33896 - protein, 28 aa, Artificial Sequence
  Description of Artificial Sequence: Synthetic peptide
SEEEIRTTNPEATEQFGSVSTNLQLGTI

SEQ ID NO: 33897 - protein, 28 aa, Artificial Sequence
  Description of Artificial Sequence: Synthetic peptide
DEEEIAQTNPVATEQYGSVSTGLENGNL

SEQ ID NO: 33898 - protein, 32 aa, Artificial Sequence
  Description of Artificial Sequence: Synthetic polypeptide
DEEEIRTTNPVATEQYGSVSATNLQEVNGNDE

SEQ ID NO: 33899 - protein, 30 aa, Artificial Sequence
  Description of Artificial Sequence: Synthetic polypeptide
MEEEIRTTNPVATEQYGSVSTDLQNEGNDM

SEQ ID NO: 33900 - protein, 28 aa, Artificial Sequence
  Description of Artificial Sequence: Synthetic peptide
DEEEVRTTNPCATEQYGSISCNLQRGTS

SEQ ID NO: 33901 - protein, 28 aa, Artificial Sequence
  Description of Artificial Sequence: Synthetic peptide
DEEEIRATNPVATEIYGSVSTDLETGNT

SEQ ID NO: 33902 - protein, 28 aa, Artificial Sequence
  Description of Artificial Sequence: Synthetic peptide
DEEEIRTTNPVATEQYGIASTALQVGDL

SEQ ID NO: 33903 - protein, 28 aa, Artificial Sequence
  Description of Artificial Sequence: Synthetic peptide
KEEEIRTTNPTATELYGSVSTGLQIGNS

SEQ ID NO: 33904 - protein, 28 aa, Artificial Sequence
  Description of Artificial Sequence: Synthetic peptide
QEEEIRTTNPVATECYGSVPECEQRGNR

SEQ ID NO: 33905 - protein, 29 aa, Artificial Sequence
  Description of Artificial Sequence: Synthetic peptide
QEEEIVTTNPVATEQYGSVATNLQHEGER

SEQ ID NO: 33906 - protein, 29 aa, Artificial Sequence
  Description of Artificial Sequence: Synthetic peptide
AETEIRTTNPVATEQYGCVSETNLQRLIR

SEQ ID NO: 33907 - protein, 30 aa, Artificial Sequence
  Description of Artificial Sequence: Synthetic polypeptide
MEEEIATTNPVATEQYGSVSTDLQREGNDA

SEQ ID NO: 33908 - protein, 30 aa, Artificial Sequence
  Description of Artificial Sequence: Synthetic polypeptide
DEEEIRTTNPVATEQYGSVSTNLEEIGEDN

SEQ ID NO: 33909 - protein, 28 aa, Artificial Sequence
  Description of Artificial Sequence: Synthetic peptide
RESEISTTNPVCTEQYGWVSTNLQRLNR

SEQ ID NO: 33910 - protein, 29 aa, Artificial Sequence
  Description of Artificial Sequence: Synthetic peptide
DEEEIRTTNPVATEQYGDYSTNEQRAGDM

SEQ ID NO: 33911 - protein, 28 aa, Artificial Sequence
  Description of Artificial Sequence: Synthetic peptide
GEEEIATTNPIATEQYGAVSTELQPGNR

SEQ ID NO: 33912 - protein, 31 aa, Artificial Sequence
  Description of Artificial Sequence: Synthetic polypeptide
DEEEIRTTNPEATEQYGSVSTNGDQIEGENR

SEQ ID NO: 33913 - protein, 31 aa, Artificial Sequence
  Description of Artificial Sequence: Synthetic polypeptide
DEEEIRTTNPVATEQYGSVDSTNLEEPDGER

SEQ ID NO: 33914 - protein, 30 aa, Artificial Sequence
  Description of Artificial Sequence: Synthetic polypeptide
DEVEIRTTNPVATEQYGGVSTMNLQQGTTR

SEQ ID NO: 33915 - protein, 28 aa, Artificial Sequence
  Description of Artificial Sequence: Synthetic peptide
DDQEIATTNPVATEQYGSVSTNLQRQDM

SEQ ID NO: 33916 - protein, 32 aa, Artificial Sequence
  Description of Artificial Sequence: Synthetic polypeptide
DEEEIRTTNPVATEQYGSVSETNLERDGENEE

SEQ ID NO: 33917 - protein, 29 aa, Artificial Sequence
  Description of Artificial Sequence: Synthetic peptide
DDEEIRTTNPVAVEQYGSVSTDLQLEGDR

SEQ ID NO: 33918 - protein, 28 aa, Artificial Sequence
  Description of Artificial Sequence: Synthetic peptide
DEEEIATTNPVATEAYGCVSTDLQAGNT

SEQ ID NO: 33919 - protein, 32 aa, Artificial Sequence
  Description of Artificial Sequence: Synthetic polypeptide
DEEEIRTTNPVATEQYGSVSTVNLQDIDGEER

SEQ ID NO: 33920 - protein, 28 aa, Artificial Sequence
  Description of Artificial Sequence: Synthetic peptide
AEEEIRTTNPVATEQYGSVSENLMHFNQ

SEQ ID NO: 33921 - protein, 31 aa, Artificial Sequence
  Description of Artificial Sequence: Synthetic polypeptide
MEEEIRTTNPVATEQYGSVSTNLQENEGNDM

SEQ ID NO: 33922 - protein, 29 aa, Artificial Sequence
  Description of Artificial Sequence: Synthetic peptide
DEQEIRTTNPVATEQYGSVSTDEQDNGNF

SEQ ID NO: 33923 - protein, 30 aa, Artificial Sequence
  Description of Artificial Sequence: Synthetic polypeptide
DEEEIRTTNPVATECYGCVSATNLERNGER

SEQ ID NO: 33924 - protein, 28 aa, Artificial Sequence
  Description of Artificial Sequence: Synthetic peptide
DEEAIRTTNPVATEQYGFVSNTVYRGNR

SEQ ID NO: 33925 - protein, 29 aa, Artificial Sequence
  Description of Artificial Sequence: Synthetic peptide
DDEEIRTTNPVSTECYGVVSTNLERNGNR

SEQ ID NO: 33926 - protein, 32 aa, Artificial Sequence
  Description of Artificial Sequence: Synthetic polypeptide
DEEEIRTTNPVATELYGSVSTNGLPQERGPTR

SEQ ID NO: 33927 - protein, 28 aa, Artificial Sequence
  Description of Artificial Sequence: Synthetic peptide
QETEIRATNPVSTEQYGVVSTNLQRGGR

SEQ ID NO: 33928 - protein, 28 aa, Artificial Sequence
  Description of Artificial Sequence: Synthetic peptide
DEEEIRTTNPDATEQYGSVSTPDDDGND

SEQ ID NO: 33929 - protein, 30 aa, Artificial Sequence
  Description of Artificial Sequence: Synthetic polypeptide
DEEEIRTTNPVATEQFGSVSEMNEQDRGDR

SEQ ID NO: 33930 - protein, 28 aa, Artificial Sequence
  Description of Artificial Sequence: Synthetic peptide
MENEIRTTNPVATEQYGSVSTNEQHGEQ

SEQ ID NO: 33931 - protein, 28 aa, Artificial Sequence
  Description of Artificial Sequence: Synthetic peptide
DELPIGATNPVATEQYGSVSTNLQQGNF

SEQ ID NO: 33932 - protein, 28 aa, Artificial Sequence
  Description of Artificial Sequence: Synthetic peptide
DEEEIRTTNPFATEQYGSVSTPLIQGEQ

SEQ ID NO: 33933 - protein, 33 aa, Artificial Sequence
  Description of Artificial Sequence: Synthetic polypeptide
DEEEIRTTNPVATEQYGSVSITNPLPQDRDGER

SEQ ID NO: 33934 - protein, 31 aa, Artificial Sequence
  Description of Artificial Sequence: Synthetic polypeptide
DEEEIRTTNPVATEQYGSVESTPAGIRGMNR

SEQ ID NO: 33935 - protein, 28 aa, Artificial Sequence
  Description of Artificial Sequence: Synthetic peptide
DEQEIRTTNPVATEQYGSVSTDLEMGEG

SEQ ID NO: 33936 - protein, 30 aa, Artificial Sequence
  Description of Artificial Sequence: Synthetic polypeptide
DENEIRTTNPVATEQFGSVYSTNLQQGVNM

SEQ ID NO: 33937 - protein, 31 aa, Artificial Sequence
  Description of Artificial Sequence: Synthetic polypeptide
DEEQIRTTNPVATEQYGSSVSDTNLQREGEP

SEQ ID NO: 33938 - protein, 31 aa, Artificial Sequence
  Description of Artificial Sequence: Synthetic polypeptide
DEEEIRTTNPVATEQYGSVSDTDLERDGNEW

SEQ ID NO: 33939 - protein, 31 aa, Artificial Sequence
  Description of Artificial Sequence: Synthetic polypeptide
DEEEIRTVNPVATEQYGSVSTLNVQSQGVNR

SEQ ID NO: 33940 - protein, 33 aa, Artificial Sequence
  Description of Artificial Sequence: Synthetic polypeptide
DEEEIRTTNPVATEQYGSVDSTNGPVQMREGNR

SEQ ID NO: 33941 - protein, 32 aa, Artificial Sequence
  Description of Artificial Sequence: Synthetic polypeptide
DEEEIATTNPVATEQYGSVISTMNLQRGDTTR

SEQ ID NO: 33942 - protein, 30 aa, Artificial Sequence
  Description of Artificial Sequence: Synthetic polypeptide
DEEEIRTTNPVATELYGSVSTNLEMRGTDA

SEQ ID NO: 33943 - protein, 29 aa, Artificial Sequence
  Description of Artificial Sequence: Synthetic peptide
DENEIRATNPVATEQYGVVGSTALQRGMR

SEQ ID NO: 33944 - protein, 28 aa, Artificial Sequence
  Description of Artificial Sequence: Synthetic peptide
QEEEIATTNPVADEQYGSVSTVLQHGER

SEQ ID NO: 33945 - protein, 28 aa, Artificial Sequence
  Description of Artificial Sequence: Synthetic peptide
DDEEIRTTNPVATEVYGSVSTDLEDGNE

SEQ ID NO: 33946 - protein, 30 aa, Artificial Sequence
  Description of Artificial Sequence: Synthetic polypeptide
DENEIRTTNPVATEQYGSVSTDLQENEGNM

SEQ ID NO: 33947 - protein, 31 aa, Artificial Sequence
  Description of Artificial Sequence: Synthetic polypeptide
DEEEIRTTNPVATEQYGSVSTNPLQDFDGEN

SEQ ID NO: 33948 - protein, 30 aa, Artificial Sequence
  Description of Artificial Sequence: Synthetic polypeptide
DEEEIRTTNPCATEVYGSVDCTNLQQVGNR

SEQ ID NO: 33949 - protein, 28 aa, Artificial Sequence
  Description of Artificial Sequence: Synthetic peptide
QEGEIRQTNPVATEQYGTVPTNLQRGDR

SEQ ID NO: 33950 - protein, 30 aa, Artificial Sequence
  Description of Artificial Sequence: Synthetic polypeptide
DEHEIVTTNPVATEQYGDVCITNLQIRGNR

SEQ ID NO: 33951 - protein, 30 aa, Artificial Sequence
  Description of Artificial Sequence: Synthetic polypeptide
DEEEIATTNPVATEQYGDVSENLQEHGNDR

SEQ ID NO: 33952 - protein, 31 aa, Artificial Sequence
  Description of Artificial Sequence: Synthetic polypeptide
DEEEIRTTNPVATEQYGSVSTIELQEDKGER

SEQ ID NO: 33953 - protein, 28 aa, Artificial Sequence
  Description of Artificial Sequence: Synthetic peptide
DEECVRTTNPVATMSYGSVSTNLLRGDR

SEQ ID NO: 33954 - protein, 28 aa, Artificial Sequence
  Description of Artificial Sequence: Synthetic peptide
DEEEIRTTNPVATQQYGMVSHPLDDGNR

SEQ ID NO: 33955 - protein, 28 aa, Artificial Sequence
  Description of Artificial Sequence: Synthetic peptide
QEFEIRTTNPCCTETYGSVSTNLQHGNR

SEQ ID NO: 33956 - protein, 28 aa, Artificial Sequence
  Description of Artificial Sequence: Synthetic peptide
DEEEIRTTNPVATEQYGSVETDEQNGEM

SEQ ID NO: 33957 - protein, 28 aa, Artificial Sequence
  Description of Artificial Sequence: Synthetic peptide
DENEIVQTNPVATEQYGSVSTNPQNGNI

SEQ ID NO: 33958 - protein, 28 aa, Artificial Sequence
  Description of Artificial Sequence: Synthetic peptide
DEEEIRTTNPVATEQYGSVETELDHEDR

SEQ ID NO: 33959 - protein, 31 aa, Artificial Sequence
  Description of Artificial Sequence: Synthetic polypeptide
MEEEIRTTNPVATEQYGEVDTGNNLQQRGNR

SEQ ID NO: 33960 - protein, 30 aa, Artificial Sequence
  Description of Artificial Sequence: Synthetic polypeptide
DEEEIRATNPVATEQFGSVDAATNLQRGND

SEQ ID NO: 33961 - protein, 28 aa, Artificial Sequence
  Description of Artificial Sequence: Synthetic peptide
DEECIRTTNPVATEQYGSWSTNDQDEER

SEQ ID NO: 33962 - protein, 32 aa, Artificial Sequence
  Description of Artificial Sequence: Synthetic polypeptide
DEEEIRTTNPVATEQYGSVESTNPLDEREGND

SEQ ID NO: 33963 - protein, 28 aa, Artificial Sequence
  Description of Artificial Sequence: Synthetic peptide
DEVEIRTTNPVATEIYGTVSENLERGNI

SEQ ID NO: 33964 - protein, 28 aa, Artificial Sequence
  Description of Artificial Sequence: Synthetic peptide
DEEEIATCNPVATETYGSVSTNLQTGTF

SEQ ID NO: 33965 - protein, 28 aa, Artificial Sequence
  Description of Artificial Sequence: Synthetic peptide
DEQEIRTTNPVATEQYGSVETDLQLGDN

SEQ ID NO: 33966 - protein, 29 aa, Artificial Sequence
  Description of Artificial Sequence: Synthetic peptide
DENEIRTTNPVATEQWGSVSENLMMRGNA

SEQ ID NO: 33967 - protein, 29 aa, Artificial Sequence
  Description of Artificial Sequence: Synthetic peptide
DEEEIRTTNPVATEWYGSVDTNLMIGGNS

SEQ ID NO: 33968 - protein, 32 aa, Artificial Sequence
  Description of Artificial Sequence: Synthetic polypeptide
DEEEIRTTNPVATEQYGISVSTPNLDRGDNAS

SEQ ID NO: 33969 - protein, 28 aa, Artificial Sequence
  Description of Artificial Sequence: Synthetic peptide
DEEEIRPTNPVATEQYGCVSTNLEEGED

SEQ ID NO: 33970 - protein, 28 aa, Artificial Sequence
  Description of Artificial Sequence: Synthetic peptide
DEDEICTTNPTATEQYGSVSTNLNRGTE

SEQ ID NO: 33971 - protein, 28 aa, Artificial Sequence
  Description of Artificial Sequence: Synthetic peptide
YEEEIRCTNPCATEQYGSVSMNLESGNR

SEQ ID NO: 33972 - protein, 32 aa, Artificial Sequence
  Description of Artificial Sequence: Synthetic polypeptide
DEEEIRTTNPVATEQYGSVSDTGLQINGENDR

SEQ ID NO: 33973 - protein, 32 aa, Artificial Sequence
  Description of Artificial Sequence: Synthetic polypeptide
DEEEIRTTNPVATEQYGSVDETNPLQDRGNEY

SEQ ID NO: 33974 - protein, 28 aa, Artificial Sequence
  Description of Artificial Sequence: Synthetic peptide
DEQEIRTTNPVATEQYGSVSTNDEAGEN

SEQ ID NO: 33975 - protein, 34 aa, Artificial Sequence
  Description of Artificial Sequence: Synthetic polypeptide
DEEEIRTTNPVATEQYGSVSETNGLQVREGENDR

SEQ ID NO: 33976 - protein, 28 aa, Artificial Sequence
  Description of Artificial Sequence: Synthetic peptide
CEEEIRTTNPVATEQYGVVSTDLQAGEQ

SEQ ID NO: 33977 - protein, 29 aa, Artificial Sequence
  Description of Artificial Sequence: Synthetic peptide
QEQEIRTTNPVATECYGSVSTNLERKGNY

SEQ ID NO: 33978 - protein, 31 aa, Artificial Sequence
  Description of Artificial Sequence: Synthetic polypeptide
DEEEIATTNPVATEQYGSVSTINLQDREGDF

SEQ ID NO: 33979 - protein, 30 aa, Artificial Sequence
  Description of Artificial Sequence: Synthetic polypeptide
DEEEIRTTNPFATEQYGSVSTNPGISRGNF

SEQ ID NO: 33980 - protein, 28 aa, Artificial Sequence
  Description of Artificial Sequence: Synthetic peptide
DEEEIRTTNPVATEQYGSVSTPDDPGED

SEQ ID NO: 33981 - protein, 28 aa, Artificial Sequence
  Description of Artificial Sequence: Synthetic peptide
DEEEIVTTNPVATEQYGDVSTGDQRGEY

SEQ ID NO: 33982 - protein, 28 aa, Artificial Sequence
  Description of Artificial Sequence: Synthetic peptide
DEEEIRTTNPVATEQYGSVDTPDEPGNS

SEQ ID NO: 33983 - protein, 29 aa, Artificial Sequence
  Description of Artificial Sequence: Synthetic peptide
DEGEIRMTNPVATEQYGCVSTNLQQGLNN

SEQ ID NO: 33984 - protein, 30 aa, Artificial Sequence
  Description of Artificial Sequence: Synthetic polypeptide
DEQEIRTTNPVATEQYGSVSTDLQDQGNDS

SEQ ID NO: 33985 - protein, 28 aa, Artificial Sequence
  Description of Artificial Sequence: Synthetic peptide
DEEEIRTTNPCATEQYGSVNDQLQRGQT

SEQ ID NO: 33986 - protein, 32 aa, Artificial Sequence
  Description of Artificial Sequence: Synthetic polypeptide
DEEEIRTTNPVATEQYGSVSTNLEDREGENED

SEQ ID NO: 33987 - protein, 31 aa, Artificial Sequence
  Description of Artificial Sequence: Synthetic polypeptide
DEEEIRTTNPVATEQYGIVSENNLQQRGNYY

SEQ ID NO: 33988 - protein, 29 aa, Artificial Sequence
  Description of Artificial Sequence: Synthetic peptide
DEEEIRTTNPVATECYGSVSTDLQIHGEN

SEQ ID NO: 33989 - protein, 31 aa, Artificial Sequence
  Description of Artificial Sequence: Synthetic polypeptide
AEEEIRTTNPVATEQYGSVSTNLERNGEEDR

SEQ ID NO: 33990 - protein, 31 aa, Artificial Sequence
  Description of Artificial Sequence: Synthetic polypeptide
DEQEIRTTNPVATEQYGSVSTNLQENEGNDM

SEQ ID NO: 33991 - protein, 28 aa, Artificial Sequence
  Description of Artificial Sequence: Synthetic peptide
DEEEICTTNPVASEQYGSVNTNEQFGNF

SEQ ID NO: 33992 - protein, 30 aa, Artificial Sequence
  Description of Artificial Sequence: Synthetic polypeptide
DEEEIMTTNPVATEQYGSVNTGNLQMQGNE

SEQ ID NO: 33993 - protein, 30 aa, Artificial Sequence
  Description of Artificial Sequence: Synthetic polypeptide
DEEEIRTTNPVATEQYGSVSDDLQVHENER

SEQ ID NO: 33994 - protein, 30 aa, Artificial Sequence
  Description of Artificial Sequence: Synthetic polypeptide
GEEEIRTTNPVATEMYGTVSTDLQDRGNDR

SEQ ID NO: 33995 - protein, 28 aa, Artificial Sequence
  Description of Artificial Sequence: Synthetic peptide
DEDEIRTTNPTATEQFGNVSTNLQRGDF

SEQ ID NO: 33996 - protein, 28 aa, Artificial Sequence
  Description of Artificial Sequence: Synthetic peptide
DEEEIRTTNPCATEVYGSVSTEEQAGNE

SEQ ID NO: 33997 - protein, 29 aa, Artificial Sequence
  Description of Artificial Sequence: Synthetic peptide
DDEEIRTTNPVATEQYGCVSLNEALRGNR

SEQ ID NO: 33998 - protein, 28 aa, Artificial Sequence
  Description of Artificial Sequence: Synthetic peptide
DEEEIRTTNPCATEQYGSVDTADQSGNL

SEQ ID NO: 33999 - protein, 31 aa, Artificial Sequence
  Description of Artificial Sequence: Synthetic polypeptide
DEEEIRTTNPVATSQYGSVNSTNGQPRGDNY

SEQ ID NO: 34000 - protein, 30 aa, Artificial Sequence
  Description of Artificial Sequence: Synthetic polypeptide
DEEEIRTTNPCATEPYGSVSCTEDLQMGNR

SEQ ID NO: 34001 - protein, 32 aa, Artificial Sequence
  Description of Artificial Sequence: Synthetic polypeptide
DEEEIRTTNPVATEQYGSVFITMNLEPRGNDR

SEQ ID NO: 34002 - protein, 28 aa, Artificial Sequence
  Description of Artificial Sequence: Synthetic peptide
AEEEIRTTNPVATEQYGDVATDLERGER

SEQ ID NO: 34003 - protein, 28 aa, Artificial Sequence
  Description of Artificial Sequence: Synthetic peptide
AENEIRQTNPVATEQYGSVSEPQQRGNR

SEQ ID NO: 34004 - protein, 31 aa, Artificial Sequence
  Description of Artificial Sequence: Synthetic polypeptide
DEEEIRTTNPVATECYGSVSTNLQDTKGEDR

SEQ ID NO: 34005 - protein, 30 aa, Artificial Sequence
  Description of Artificial Sequence: Synthetic polypeptide
DEEEIRTTNPCCTEQYGSVSCTDLQRENDR

SEQ ID NO: 34006 - protein, 29 aa, Artificial Sequence
  Description of Artificial Sequence: Synthetic peptide
DEEEIRTTNPVATEQYGSAAANLQEGNDS

SEQ ID NO: 34007 - protein, 28 aa, Artificial Sequence
  Description of Artificial Sequence: Synthetic peptide
DEEEIRTTNPVSTEWYGSVSTNDQQGDM

SEQ ID NO: 34008 - protein, 28 aa, Artificial Sequence
  Description of Artificial Sequence: Synthetic peptide
DEEEIRTTNPEATEHYGSVSTELQLGDF

SEQ ID NO: 34009 - protein, 31 aa, Artificial Sequence
  Description of Artificial Sequence: Synthetic polypeptide
DEEEIRTTNPVATEQYGESVDTGDGLDRGNR

SEQ ID NO: 34010 - protein, 31 aa, Artificial Sequence
  Description of Artificial Sequence: Synthetic polypeptide
DEEEIRTTNPVATEQYGSVSCTDLQCNGNDN

SEQ ID NO: 34011 - protein, 28 aa, Artificial Sequence
  Description of Artificial Sequence: Synthetic peptide
SEEEIRTTNPAATEQFGSVSTNPQQGNE

SEQ ID NO: 34012 - protein, 30 aa, Artificial Sequence
  Description of Artificial Sequence: Synthetic polypeptide
DEEEIRTTNPVATEQYGSVSETNDQGDGET

SEQ ID NO: 34013 - protein, 28 aa, Artificial Sequence
  Description of Artificial Sequence: Synthetic peptide
DEEEIAATNPVATEMFGSVSTNEQIGNR

SEQ ID NO: 34014 - protein, 28 aa, Artificial Sequence
  Description of Artificial Sequence: Synthetic peptide
DEYEIRTTNPVSTEIYGSVSDNLQGENR

SEQ ID NO: 34015 - protein, 28 aa, Artificial Sequence
  Description of Artificial Sequence: Synthetic peptide
DEEEIRTTNPVATEQYGSCQTNKQCGEC

SEQ ID NO: 34016 - protein, 29 aa, Artificial Sequence
  Description of Artificial Sequence: Synthetic peptide
DEEEIRTTNPVATEIYGSVSTDLEAGNDS

SEQ ID NO: 34017 - protein, 28 aa, Artificial Sequence
  Description of Artificial Sequence: Synthetic peptide
DEEEIRTTNPFATEQYGSVSTEDIAGER

SEQ ID NO: 34018 - protein, 28 aa, Artificial Sequence
  Description of Artificial Sequence: Synthetic peptide
DEEEIRTTNPTATETYGSVSANPQIGDR

SEQ ID NO: 34019 - protein, 28 aa, Artificial Sequence
  Description of Artificial Sequence: Synthetic peptide
DEEEIRTTNPVSTEVFGSVSTNPQRGPY

SEQ ID NO: 34020 - protein, 30 aa, Artificial Sequence
  Description of Artificial Sequence: Synthetic polypeptide
DENEIRTTNPVATEQWGSVSTNLQMQGENF

SEQ ID NO: 34021 - protein, 30 aa, Artificial Sequence
  Description of Artificial Sequence: Synthetic polypeptide
DEEEIRTTNPVATEQYGSVSTEPLQVIGDT

SEQ ID NO: 34022 - protein, 28 aa, Artificial Sequence
  Description of Artificial Sequence: Synthetic peptide
DEEEISTVNPVATEIYGSVSTVLQRGGL

SEQ ID NO: 34023 - protein, 28 aa, Artificial Sequence
  Description of Artificial Sequence: Synthetic peptide
AEEEIAQTNPVATEQYGSVSTALQRGEQ

SEQ ID NO: 34024 - protein, 31 aa, Artificial Sequence
  Description of Artificial Sequence: Synthetic polypeptide
DEQEIRTTNPVATEQYGESVSTDDPQRGENR

SEQ ID NO: 34025 - protein, 30 aa, Artificial Sequence
  Description of Artificial Sequence: Synthetic polypeptide
DEEEIRTTNPVATECYGSVSTDLQDSGEDR

SEQ ID NO: 34026 - protein, 32 aa, Artificial Sequence
  Description of Artificial Sequence: Synthetic polypeptide
DEEEIRTTNPVATEQYGSVSCTMELQCRGNDC

SEQ ID NO: 34027 - protein, 31 aa, Artificial Sequence
  Description of Artificial Sequence: Synthetic polypeptide
DEQEIRTTNPVATEQYGSVSETEDDQRGENR

SEQ ID NO: 34028 - protein, 30 aa, Artificial Sequence
  Description of Artificial Sequence: Synthetic polypeptide
DEEEIRTTNPVATEQYGSVSTDLQDKGEDD

SEQ ID NO: 34029 - protein, 28 aa, Artificial Sequence
  Description of Artificial Sequence: Synthetic peptide
DEEEIATTNPVATECYGSVSTNLELGEI

SEQ ID NO: 34030 - protein, 30 aa, Artificial Sequence
  Description of Artificial Sequence: Synthetic polypeptide
DEEEIRTTNPVATEQYGSVSDNLQEHGEDN

SEQ ID NO: 34031 - protein, 31 aa, Artificial Sequence
  Description of Artificial Sequence: Synthetic polypeptide
DEEEIRTTNPVATEQYGSVSCTDLQCVGNDN

SEQ ID NO: 34032 - protein, 31 aa, Artificial Sequence
  Description of Artificial Sequence: Synthetic polypeptide
DEEEIRTTNPVATEQYGSVSATDLQDHEGER

SEQ ID NO: 34033 - protein, 31 aa, Artificial Sequence
  Description of Artificial Sequence: Synthetic polypeptide
DEEEIRSTNPVATELYGSVSTVNLPQQEGNR

SEQ ID NO: 34034 - protein, 30 aa, Artificial Sequence
  Description of Artificial Sequence: Synthetic polypeptide
DEEEIRPTNPVATAQYGSVSTPNDQRPDNR

SEQ ID NO: 34035 - protein, 28 aa, Artificial Sequence
  Description of Artificial Sequence: Synthetic peptide
DEEEIRGTNPVATEQYGEVSDDLQLGNA

SEQ ID NO: 34036 - protein, 33 aa, Artificial Sequence
  Description of Artificial Sequence: Synthetic polypeptide
DEEEIRTTNPVATEQYGSVSTCNEQDREGDNTR

SEQ ID NO: 34037 - protein, 28 aa, Artificial Sequence
  Description of Artificial Sequence: Synthetic peptide
SEEEIRTTNPTATEQFGSVSTNPQFGNE

SEQ ID NO: 34038 - protein, 28 aa, Artificial Sequence
  Description of Artificial Sequence: Synthetic peptide
KEEEIRTTNPVAMEQYGSVSTGLEEGNM

SEQ ID NO: 34039 - protein, 28 aa, Artificial Sequence
  Description of Artificial Sequence: Synthetic peptide
DAEEIRTTNPVACQQYGSVSTNPQDGER

SEQ ID NO: 34040 - protein, 30 aa, Artificial Sequence
  Description of Artificial Sequence: Synthetic polypeptide
DENEIRTTNPVATECYGSVSTNLQERGEDL

SEQ ID NO: 34041 - protein, 30 aa, Artificial Sequence
  Description of Artificial Sequence: Synthetic polypeptide
DEEEIRATNPTATEQYGSVSTIGLQRGNSI

SEQ ID NO: 34042 - protein, 29 aa, Artificial Sequence
  Description of Artificial Sequence: Synthetic peptide
SEEEIRTTNPTATEQYGEVSEMNLQRGDR

SEQ ID NO: 34043 - protein, 28 aa, Artificial Sequence
  Description of Artificial Sequence: Synthetic peptide
NEEEIRTVNPVASEQYGTVSTNLQRGTQ

SEQ ID NO: 34044 - protein, 30 aa, Artificial Sequence
  Description of Artificial Sequence: Synthetic polypeptide
DEEEIRTTNPVATEQYGSASTNLQEHENDN

SEQ ID NO: 34045 - protein, 28 aa, Artificial Sequence
  Description of Artificial Sequence: Synthetic peptide
DENEIAQTNPVATEQYGSVDTNLEVGNR

SEQ ID NO: 34046 - protein, 28 aa, Artificial Sequence
  Description of Artificial Sequence: Synthetic peptide
DEHEIRTTNPVATEQCGDVSTNLQAENQ

SEQ ID NO: 34047 - protein, 30 aa, Artificial Sequence
  Description of Artificial Sequence: Synthetic polypeptide
DEEEIRTTNPVATECYGSVSTDLQDTGNDW

SEQ ID NO: 34048 - protein, 29 aa, Artificial Sequence
  Description of Artificial Sequence: Synthetic peptide
QEEEIRTTNPVATECYGSVSANNLERGER

SEQ ID NO: 34049 - protein, 29 aa, Artificial Sequence
  Description of Artificial Sequence: Synthetic peptide
DESEIRTTNPVATEMYGSCSTELQEGNDR

SEQ ID NO: 34050 - protein, 29 aa, Artificial Sequence
  Description of Artificial Sequence: Synthetic peptide
DEEEICTTNPVATEQYGSVSDVLQHAGNM

SEQ ID NO: 34051 - protein, 29 aa, Artificial Sequence
  Description of Artificial Sequence: Synthetic peptide
DEEEIRTTNPFATEQYGSVSTDQQVGNLA

SEQ ID NO: 34052 - protein, 28 aa, Artificial Sequence
  Description of Artificial Sequence: Synthetic peptide
GESEIRTTNPVATEQYGSVSENIQMGNH

SEQ ID NO: 34053 - protein, 29 aa, Artificial Sequence
  Description of Artificial Sequence: Synthetic peptide
DEHEIRTTNPVATEQYGTVDTMNLQTGNA

SEQ ID NO: 34054 - protein, 28 aa, Artificial Sequence
  Description of Artificial Sequence: Synthetic peptide
MEQEIRTTNPVATECYGSVSTNLQNGEM

SEQ ID NO: 34055 - protein, 28 aa, Artificial Sequence
  Description of Artificial Sequence: Synthetic peptide
DEEEIATTNPVATEQYGSVATDLQVGEF

SEQ ID NO: 34056 - protein, 28 aa, Artificial Sequence
  Description of Artificial Sequence: Synthetic peptide
DEQEIRSTNPVATEIYGSVSMDLERGNR

SEQ ID NO: 34057 - protein, 33 aa, Artificial Sequence
  Description of Artificial Sequence: Synthetic polypeptide
DEEEIRTTNPVATEQYGSVDSDTNLEDRDGENR

SEQ ID NO: 34058 - protein, 29 aa, Artificial Sequence
  Description of Artificial Sequence: Synthetic peptide
HEEEIRTTNPVATEQYGSVSDMNDQKGNF

SEQ ID NO: 34059 - protein, 28 aa, Artificial Sequence
  Description of Artificial Sequence: Synthetic peptide
DEEEIRTTNPVATEQYGSVSTEDDPGES

SEQ ID NO: 34060 - protein, 30 aa, Artificial Sequence
  Description of Artificial Sequence: Synthetic polypeptide
DEEEIRCTNPVCTEQYGSVSCENLQNGNDR

SEQ ID NO: 34061 - protein, 30 aa, Artificial Sequence
  Description of Artificial Sequence: Synthetic polypeptide
DEEEIRTTNPVATEQYGSVDTNDQQQSGNA

SEQ ID NO: 34062 - protein, 28 aa, Artificial Sequence
  Description of Artificial Sequence: Synthetic peptide
DECEIRGTNPVAYEQYGSMSTNVQRPNR

SEQ ID NO: 34063 - protein, 30 aa, Artificial Sequence
  Description of Artificial Sequence: Synthetic polypeptide
DEEEIRCTNPVASEIYGCVSATNLQRNGNR

SEQ ID NO: 34064 - protein, 31 aa, Artificial Sequence
  Description of Artificial Sequence: Synthetic polypeptide
DEEEITTTNPVATEQYGSVSTMNDQQTGNDR

SEQ ID NO: 34065 - protein, 29 aa, Artificial Sequence
  Description of Artificial Sequence: Synthetic peptide
SEEEIRTTNPVATEMYGCVSTLNLQLGNT

SEQ ID NO: 34066 - protein, 28 aa, Artificial Sequence
  Description of Artificial Sequence: Synthetic peptide
DEMEIRTVNPVSTEQYGVVSTNSQRGNQ

SEQ ID NO: 34067 - protein, 28 aa, Artificial Sequence
  Description of Artificial Sequence: Synthetic peptide
DEEEISTTNPVATEQYGAASTELDRGND

SEQ ID NO: 34068 - protein, 29 aa, Artificial Sequence
  Description of Artificial Sequence: Synthetic peptide
DEEEIRTTNPVATEQYGDVSCENLCHGNS

SEQ ID NO: 34069 - protein, 30 aa, Artificial Sequence
  Description of Artificial Sequence: Synthetic polypeptide
DEEEIRTTNPVATEQYGDVSCENLQCTGNV

SEQ ID NO: 34070 - protein, 28 aa, Artificial Sequence
  Description of Artificial Sequence: Synthetic peptide
DEDEINATNPVATEQYGSVSANLQLGNF

SEQ ID NO: 34071 - protein, 29 aa, Artificial Sequence
  Description of Artificial Sequence: Synthetic peptide
DENEIRTTNPVATEQYGVVSTDLQVGDNV

SEQ ID NO: 34072 - protein, 28 aa, Artificial Sequence
  Description of Artificial Sequence: Synthetic peptide
DEEEIRTTNPDATEQYGSVSTEDQNGED

SEQ ID NO: 34073 - protein, 31 aa, Artificial Sequence
  Description of Artificial Sequence: Synthetic polypeptide
DEEEIRTTNPEATEQYGSVSTVNPLQRGDDY

SEQ ID NO: 34074 - protein, 31 aa, Artificial Sequence
  Description of Artificial Sequence: Synthetic polypeptide
DEVEIRTTNPVATEQYGSTYSTNEQREGNFR

SEQ ID NO: 34075 - protein, 31 aa, Artificial Sequence
  Description of Artificial Sequence: Synthetic polypeptide
DEEEIRATNPVATEQYGSTSVTMNLQLQGNR

SEQ ID NO: 34076 - protein, 30 aa, Artificial Sequence
  Description of Artificial Sequence: Synthetic polypeptide
DEEEIRTTNPVATEQYGESVDSTDDQRGEF

SEQ ID NO: 34077 - protein, 28 aa, Artificial Sequence
  Description of Artificial Sequence: Synthetic peptide
QEEEIRSTNPVATEMYGEVATLLQRGNR

SEQ ID NO: 34078 - protein, 28 aa, Artificial Sequence
  Description of Artificial Sequence: Synthetic peptide
DEEEIRTTNPDATQQYGSVFTNPQRGEN

SEQ ID NO: 34079 - protein, 28 aa, Artificial Sequence
  Description of Artificial Sequence: Synthetic peptide
QEEEIVTTNPVATEQYGEASENLQRGGR

SEQ ID NO: 34080 - protein, 29 aa, Artificial Sequence
  Description of Artificial Sequence: Synthetic peptide
DEEEIRTTNPVATECYGSVSTELQDAGES

SEQ ID NO: 34081 - protein, 28 aa, Artificial Sequence
  Description of Artificial Sequence: Synthetic peptide
DENEIRTTNPVCTEQYGSVDTALQAGNA

SEQ ID NO: 34082 - protein, 31 aa, Artificial Sequence
  Description of Artificial Sequence: Synthetic polypeptide
DEEEIMTTNPVATEQYGSVCSTNLQLNGEHR

SEQ ID NO: 34083 - protein, 31 aa, Artificial Sequence
  Description of Artificial Sequence: Synthetic polypeptide
KEEEIRTTNPVATEQYGSVSTNLQEAEGNDE

SEQ ID NO: 34084 - protein, 28 aa, Artificial Sequence
  Description of Artificial Sequence: Synthetic peptide
VEEEIRTTNPVASEQYGCVSMNLQRGTQ

SEQ ID NO: 34085 - protein, 30 aa, Artificial Sequence
  Description of Artificial Sequence: Synthetic polypeptide
DEDEIRTTNPVATELYGSVSENLQERGNDI

SEQ ID NO: 34086 - protein, 28 aa, Artificial Sequence
  Description of Artificial Sequence: Synthetic peptide
DEEEIRTTNPEATETYGDVSTNLQSGDE

SEQ ID NO: 34087 - protein, 32 aa, Artificial Sequence
  Description of Artificial Sequence: Synthetic polypeptide
DEEEIRTTNPVATEQYGSVSTANEQDQGDNDR

SEQ ID NO: 34088 - protein, 28 aa, Artificial Sequence
  Description of Artificial Sequence: Synthetic peptide
DEEEIRTTNPFATEQYGSVSTDPIIGNS

SEQ ID NO: 34089 - protein, 30 aa, Artificial Sequence
  Description of Artificial Sequence: Synthetic polypeptide
REEEIRTTNPVAHEQYGSVSTNLQLRNPND

SEQ ID NO: 34090 - protein, 29 aa, Artificial Sequence
  Description of Artificial Sequence: Synthetic peptide
DDEEIRTTNPVATEQYGLVSTNLQTAGTA

SEQ ID NO: 34091 - protein, 28 aa, Artificial Sequence
  Description of Artificial Sequence: Synthetic peptide
DTEEIRTTNPVATEKYGDVSENLQEGDR

SEQ ID NO: 34092 - protein, 29 aa, Artificial Sequence
  Description of Artificial Sequence: Synthetic peptide
DEEEIRTTNPVATEGYGSVSTDDQRNEDR

SEQ ID NO: 34093 - protein, 28 aa, Artificial Sequence
  Description of Artificial Sequence: Synthetic peptide
DEEEIRTTNPEATEQYGSVSTDEQFGDG

SEQ ID NO: 34094 - protein, 31 aa, Artificial Sequence
  Description of Artificial Sequence: Synthetic polypeptide
QEEEIRTTNPVATEQYGSVSTNLQIDEGEND

SEQ ID NO: 34095 - protein, 28 aa, Artificial Sequence
  Description of Artificial Sequence: Synthetic peptide
DENEIRTTNPVATEQYGDVHTILMRENR

SEQ ID NO: 34096 - protein, 30 aa, Artificial Sequence
  Description of Artificial Sequence: Synthetic polypeptide
DEEEIRTTNPVATEQFGSVYSTNLQHGDTL

SEQ ID NO: 34097 - protein, 29 aa, Artificial Sequence
  Description of Artificial Sequence: Synthetic peptide
DEQEIRTTNPVATEQYGSVSTDLQHGEDL

SEQ ID NO: 34098 - protein, 28 aa, Artificial Sequence
  Description of Artificial Sequence: Synthetic peptide
SEEEIRTTNPVATELYGSVSTDLQSGDG

SEQ ID NO: 34099 - protein, 28 aa, Artificial Sequence
  Description of Artificial Sequence: Synthetic peptide
DPEEIRPTNPVATEQYGVVSTGDQPGNR

SEQ ID NO: 34100 - protein, 29 aa, Artificial Sequence
  Description of Artificial Sequence: Synthetic peptide
DENEIRTTNPVATELYGSVSENEQNRGNA

SEQ ID NO: 34101 - protein, 31 aa, Artificial Sequence
  Description of Artificial Sequence: Synthetic polypeptide
DEEEIATTNPVATEQYGSVISTVNLQSGNDN

SEQ ID NO: 34102 - protein, 31 aa, Artificial Sequence
  Description of Artificial Sequence: Synthetic polypeptide
DEEEIATTNPVATEQYGSVSTTPLERGENDR

SEQ ID NO: 34103 - protein, 32 aa, Artificial Sequence
  Description of Artificial Sequence: Synthetic polypeptide
DEEEIRTTNPVATEQYGSVSTDNLVDLRGVNA

SEQ ID NO: 34104 - protein, 32 aa, Artificial Sequence
  Description of Artificial Sequence: Synthetic polypeptide
DEEEIRTTNPVATEQYGSVSATGLQLRGENDL

SEQ ID NO: 34105 - protein, 28 aa, Artificial Sequence
  Description of Artificial Sequence: Synthetic peptide
DEEEIRTTNPVATEQYGDVSTDEQAENM

SEQ ID NO: 34106 - protein, 28 aa, Artificial Sequence
  Description of Artificial Sequence: Synthetic peptide
MEEEIRQTNPVATEQYGSASTNLENGNM

SEQ ID NO: 34107 - protein, 30 aa, Artificial Sequence
  Description of Artificial Sequence: Synthetic polypeptide
DEEEIRATNPVATEQYGSVYSENPQREGNN

SEQ ID NO: 34108 - protein, 28 aa, Artificial Sequence
  Description of Artificial Sequence: Synthetic peptide
DEEEIVCTNPEATEQYGSVSTELQRGEF

SEQ ID NO: 34109 - protein, 31 aa, Artificial Sequence
  Description of Artificial Sequence: Synthetic polypeptide
MEEEIRTTNPVATEQYGSVSTNLQENEGNDW

SEQ ID NO: 34110 - protein, 29 aa, Artificial Sequence
  Description of Artificial Sequence: Synthetic peptide
DEEEIVTTNPVATECYGSVSATNLQVGEG

SEQ ID NO: 34111 - protein, 30 aa, Artificial Sequence
  Description of Artificial Sequence: Synthetic polypeptide
DEQEIATTNPVATECYGSVSATNLQHEGNR

SEQ ID NO: 34112 - protein, 28 aa, Artificial Sequence
  Description of Artificial Sequence: Synthetic peptide
DENEIRTTNPVATEQYGDVSTIEMRENR

SEQ ID NO: 34113 - protein, 28 aa, Artificial Sequence
  Description of Artificial Sequence: Synthetic peptide
DEEEICTTNPVATELYGSVSVNEQSGNT

SEQ ID NO: 34114 - protein, 29 aa, Artificial Sequence
  Description of Artificial Sequence: Synthetic peptide
DEEEISTTNPVATLQYGSVATNLQTEGNF

SEQ ID NO: 34115 - protein, 28 aa, Artificial Sequence
  Description of Artificial Sequence: Synthetic peptide
DEQEIRTTNPCATEQYGSVSDNLIQGNE

SEQ ID NO: 34116 - protein, 30 aa, Artificial Sequence
  Description of Artificial Sequence: Synthetic polypeptide
DENEIRTTNPVAVEQYGSVSSTPLQDRGDR

SEQ ID NO: 34117 - protein, 31 aa, Artificial Sequence
  Description of Artificial Sequence: Synthetic polypeptide
DEEEIRTTNPVATEQYGSVSVTNLIAAGEER

SEQ ID NO: 34118 - protein, 31 aa, Artificial Sequence
  Description of Artificial Sequence: Synthetic polypeptide
DEEEIRTTNPVATEQYGSVSTPEQDKGDNPR

SEQ ID NO: 34119 - protein, 31 aa, Artificial Sequence
  Description of Artificial Sequence: Synthetic polypeptide
DEEEIRCTNPVATEQYGSVSTNDQQRAGNDQ

SEQ ID NO: 34120 - protein, 28 aa, Artificial Sequence
  Description of Artificial Sequence: Synthetic peptide
DEEEIAATNPVATECYGSVSTELQIGNI

SEQ ID NO: 34121 - protein, 28 aa, Artificial Sequence
  Description of Artificial Sequence: Synthetic peptide
DENEIRTTNPVATEQYGSAAENPQRGND

SEQ ID NO: 34122 - protein, 28 aa, Artificial Sequence
  Description of Artificial Sequence: Synthetic peptide
DEIEIVGTNPVATEPYGSVSTNIQQGNR

SEQ ID NO: 34123 - protein, 28 aa, Artificial Sequence
  Description of Artificial Sequence: Synthetic peptide
DEEEITTTNPVATEQYGSVSENEQQGTQ

SEQ ID NO: 34124 - protein, 28 aa, Artificial Sequence
  Description of Artificial Sequence: Synthetic peptide
DEECIETVNPVATEWYGSVSDNLERGNR

SEQ ID NO: 34125 - protein, 29 aa, Artificial Sequence
  Description of Artificial Sequence: Synthetic peptide
DEEEIRCTNPVSTEWYGSVSTNLQIIGNQ

SEQ ID NO: 34126 - protein, 28 aa, Artificial Sequence
  Description of Artificial Sequence: Synthetic peptide
DETEIRTTNPVATELYGSVSNELQTGNF

SEQ ID NO: 34127 - protein, 30 aa, Artificial Sequence
  Description of Artificial Sequence: Synthetic polypeptide
DEEEIRTTNPVATECYGSVSTDLQNEGNDM

SEQ ID NO: 34128 - protein, 31 aa, Artificial Sequence
  Description of Artificial Sequence: Synthetic polypeptide
DTEEIRTTNPVATEQWGSVSQTNPLIRNGNR

SEQ ID NO: 34129 - protein, 30 aa, Artificial Sequence
  Description of Artificial Sequence: Synthetic polypeptide
DEEEIRTTNPVATEQYGSVDITELQMIGER

SEQ ID NO: 34130 - protein, 28 aa, Artificial Sequence
  Description of Artificial Sequence: Synthetic peptide
SEEEIRCTNPEATETYGSVSVNLQRGNN

SEQ ID NO: 34131 - protein, 30 aa, Artificial Sequence
  Description of Artificial Sequence: Synthetic polypeptide
DEEEIATTNPVATEQYGSVSTDLVQEGEDR

SEQ ID NO: 34132 - protein, 30 aa, Artificial Sequence
  Description of Artificial Sequence: Synthetic polypeptide
DEEEIRTTNPVATEQYGDVSTANEQNLENR

SEQ ID NO: 34133 - protein, 28 aa, Artificial Sequence
  Description of Artificial Sequence: Synthetic peptide
DEEEISTTNPDATEQYGGVSTNLETGNQ

SEQ ID NO: 34134 - protein, 28 aa, Artificial Sequence
  Description of Artificial Sequence: Synthetic peptide
DEEEIRTTNPVATEMYGSVSLELDRGEE

SEQ ID NO: 34135 - protein, 31 aa, Artificial Sequence
  Description of Artificial Sequence: Synthetic polypeptide
DEEEIRTTNPVATEQYGSVSETNLEDHGDNI

SEQ ID NO: 34136 - protein, 28 aa, Artificial Sequence
  Description of Artificial Sequence: Synthetic peptide
DEEEIRTTNPEATEQYGSVSTDLDQGEP

SEQ ID NO: 34137 - protein, 33 aa, Artificial Sequence
  Description of Artificial Sequence: Synthetic polypeptide
DEEEIRTTNPVATEQFGSVYSTMNGLQRKGNDR

SEQ ID NO: 34138 - protein, 31 aa, Artificial Sequence
  Description of Artificial Sequence: Synthetic polypeptide
DEEEIRTTNPVATEQYGSVSTNEQDVEGNTI

SEQ ID NO: 34139 - protein, 31 aa, Artificial Sequence
  Description of Artificial Sequence: Synthetic polypeptide
DEEEIRTTNPVATEQYGSVSCTMDLQCHGNA

SEQ ID NO: 34140 - protein, 32 aa, Artificial Sequence
  Description of Artificial Sequence: Synthetic polypeptide
DEEEIRTTNPVATEQYGSVSATNGLQLVGEND

SEQ ID NO: 34141 - protein, 30 aa, Artificial Sequence
  Description of Artificial Sequence: Synthetic polypeptide
DEEEIRCTNPVATEVYGSVSTMNEQREGNN

SEQ ID NO: 34142 - protein, 28 aa, Artificial Sequence
  Description of Artificial Sequence: Synthetic peptide
DEEEIHTVNPVATEQYGSVWTDLQPGND

SEQ ID NO: 34143 - protein, 28 aa, Artificial Sequence
  Description of Artificial Sequence: Synthetic peptide
DENEIVTTNPVATEQYGSVSDCLQSGNQ

SEQ ID NO: 34144 - protein, 28 aa, Artificial Sequence
  Description of Artificial Sequence: Synthetic peptide
KEEEIRTTNPVATEQYGSVFTDPQRENN

SEQ ID NO: 34145 - protein, 29 aa, Artificial Sequence
  Description of Artificial Sequence: Synthetic peptide
DEEEIRAVNPVATECYGVVSTNLQRGDDR

SEQ ID NO: 34146 - protein, 31 aa, Artificial Sequence
  Description of Artificial Sequence: Synthetic polypeptide
DEEEIRTTNPVATEQYGSVSTMNEQLQGNDL

SEQ ID NO: 34147 - protein, 28 aa, Artificial Sequence
  Description of Artificial Sequence: Synthetic peptide
DEEEIRQTNPVATEQYGVVSTDQERGER

SEQ ID NO: 34148 - protein, 31 aa, Artificial Sequence
  Description of Artificial Sequence: Synthetic polypeptide
DEEEIRTTNPVATEQYGSVSETNPDDRNGDR

SEQ ID NO: 34149 - protein, 30 aa, Artificial Sequence
  Description of Artificial Sequence: Synthetic polypeptide
DEEEIRTTNPEATEQYGVVCSTGNLTSGNR

SEQ ID NO: 34150 - protein, 32 aa, Artificial Sequence
  Description of Artificial Sequence: Synthetic polypeptide
DPEEIRTTNPVAYEQYGVSVSTPNLQERGENR

SEQ ID NO: 34151 - protein, 28 aa, Artificial Sequence
  Description of Artificial Sequence: Synthetic peptide
DEEEIRTTNPVATEQYGVVDTWAQTGNF

SEQ ID NO: 34152 - protein, 28 aa, Artificial Sequence
  Description of Artificial Sequence: Synthetic peptide
DEQEIATTNPVATECYGSVSTDLERGER

SEQ ID NO: 34153 - protein, 31 aa, Artificial Sequence
  Description of Artificial Sequence: Synthetic polypeptide
DEEEIRTTNPVATEQYGSVSTNPEQADGEER

SEQ ID NO: 34154 - protein, 28 aa, Artificial Sequence
  Description of Artificial Sequence: Synthetic peptide
DEEEIRTTNPEATDQYGSVSTELEFGNS

SEQ ID NO: 34155 - protein, 28 aa, Artificial Sequence
  Description of Artificial Sequence: Synthetic peptide
DEEEIRSTNPVSTEQYGSVSDNLQTGDL

SEQ ID NO: 34156 - protein, 28 aa, Artificial Sequence
  Description of Artificial Sequence: Synthetic peptide
DDSEIRTTNPVATEVYGSVSMQLQQGNR

SEQ ID NO: 34157 - protein, 32 aa, Artificial Sequence
  Description of Artificial Sequence: Synthetic polypeptide
DEEEIRTTNPVATEQYGSVISTCNPQDRGPTR

SEQ ID NO: 34158 - protein, 28 aa, Artificial Sequence
  Description of Artificial Sequence: Synthetic peptide
DEEEIRTTNPEATRQYGQVPTDLQRGNF

SEQ ID NO: 34159 - protein, 31 aa, Artificial Sequence
  Description of Artificial Sequence: Synthetic polypeptide
DEEEIATTNPVATEQYGSVDSAENLQDRGNF

SEQ ID NO: 34160 - protein, 28 aa, Artificial Sequence
  Description of Artificial Sequence: Synthetic peptide
DEEEIRTTNPEATEQYGSVSTNDQVEEF

SEQ ID NO: 34161 - protein, 32 aa, Artificial Sequence
  Description of Artificial Sequence: Synthetic polypeptide
DEEEIRTTNPVCTEQYGSVSCTMNDQQERGNR

SEQ ID NO: 34162 - protein, 31 aa, Artificial Sequence
  Description of Artificial Sequence: Synthetic polypeptide
DEEEIRTTNPVATEQYGSVSECNEQERGTTR

SEQ ID NO: 34163 - protein, 28 aa, Artificial Sequence
  Description of Artificial Sequence: Synthetic peptide
DEEEIATTNPVATEQYGSVPENPQRENL

SEQ ID NO: 34164 - protein, 30 aa, Artificial Sequence
  Description of Artificial Sequence: Synthetic polypeptide
DEEEIATTNPTATEQYGSVSTNEQREGDNQ

SEQ ID NO: 34165 - protein, 28 aa, Artificial Sequence
  Description of Artificial Sequence: Synthetic peptide
DEEEIRCTNPDATECYGSVSTGLQPGNP

SEQ ID NO: 34166 - protein, 32 aa, Artificial Sequence
  Description of Artificial Sequence: Synthetic polypeptide
DEEEIRTTNPVATEQYGSVSDTNGDQRGEDER

SEQ ID NO: 34167 - protein, 31 aa, Artificial Sequence
  Description of Artificial Sequence: Synthetic polypeptide
DEEEIRTTNPVATEQYGSVETELQEIEGENR

SEQ ID NO: 34168 - protein, 31 aa, Artificial Sequence
  Description of Artificial Sequence: Synthetic polypeptide
CEEEIRTTNPVATEQYGSISTDLPQLRGVNR

SEQ ID NO: 34169 - protein, 30 aa, Artificial Sequence
  Description of Artificial Sequence: Synthetic polypeptide
MEQEIRTTNPVATEQYGSVSTNLQENEGNS

SEQ ID NO: 34170 - protein, 30 aa, Artificial Sequence
  Description of Artificial Sequence: Synthetic polypeptide
DEEEIRTTNPVATEQYGSVSTDLQDQGEDL

SEQ ID NO: 34171 - protein, 31 aa, Artificial Sequence
  Description of Artificial Sequence: Synthetic polypeptide
DEEEIRTTNPVATEQYGSVSTMNEQDIGDNV

SEQ ID NO: 34172 - protein, 29 aa, Artificial Sequence
  Description of Artificial Sequence: Synthetic peptide
DEEEIRTTNPVATEQYGWVSTELQFEGDH

SEQ ID NO: 34173 - protein, 28 aa, Artificial Sequence
  Description of Artificial Sequence: Synthetic peptide
DEEEIRATNPVSTEQYGSCSTILQHGGR

SEQ ID NO: 34174 - protein, 29 aa, Artificial Sequence
  Description of Artificial Sequence: Synthetic peptide
DEEEIRTTNPISTEMYGCVSATNLERGNR

SEQ ID NO: 34175 - protein, 30 aa, Artificial Sequence
  Description of Artificial Sequence: Synthetic polypeptide
DEEEIRTTNPEATEQYGSVSTNPDQVEGNF

SEQ ID NO: 34176 - protein, 31 aa, Artificial Sequence
  Description of Artificial Sequence: Synthetic polypeptide
DENEIRTTNPVATEVYGSVSTVNLQERGPNF

SEQ ID NO: 34177 - protein, 28 aa, Artificial Sequence
  Description of Artificial Sequence: Synthetic peptide
DEEEIRTTNPVCSEQYGSVSTNDERENM

SEQ ID NO: 34178 - protein, 28 aa, Artificial Sequence
  Description of Artificial Sequence: Synthetic peptide
YEAEIRTTNPVATEQYGCVSENLQNGNL

SEQ ID NO: 34179 - protein, 34 aa, Artificial Sequence
  Description of Artificial Sequence: Synthetic polypeptide
DEEEIRTTNPVATEQYGSVISTLNLPQLREGVNR

SEQ ID NO: 34180 - protein, 31 aa, Artificial Sequence
  Description of Artificial Sequence: Synthetic polypeptide
DEEEIRTTNPTATEQYGSVSTANLQENGDNE

SEQ ID NO: 34181 - protein, 28 aa, Artificial Sequence
  Description of Artificial Sequence: Synthetic peptide
DEEEIRTTNPVATELYGSVSMDLERGDH

SEQ ID NO: 34182 - protein, 31 aa, Artificial Sequence
  Description of Artificial Sequence: Synthetic polypeptide
DEEEIRTTNPVATEQYGSVSTEPEQRGDEDR

SEQ ID NO: 34183 - protein, 32 aa, Artificial Sequence
  Description of Artificial Sequence: Synthetic polypeptide
DEEEIATTNPVATECYGSVSATNLQDRNGNDR

SEQ ID NO: 34184 - protein, 33 aa, Artificial Sequence
  Description of Artificial Sequence: Synthetic polypeptide
DEEEIRTTNPVATEQYGSVDSTNPLVQIGENDR

SEQ ID NO: 34185 - protein, 30 aa, Artificial Sequence
  Description of Artificial Sequence: Synthetic polypeptide
DEEEIRTTNPVATEQYGSVDETDLVQIGER

SEQ ID NO: 34186 - protein, 28 aa, Artificial Sequence
  Description of Artificial Sequence: Synthetic peptide
DEEEIATTNPVGTEMYGSTSTNLQHLNR

SEQ ID NO: 34187 - protein, 31 aa, Artificial Sequence
  Description of Artificial Sequence: Synthetic polypeptide
DEEEIRTTNPFATEQYGSVSDTPLQRGDEPR

SEQ ID NO: 34188 - protein, 31 aa, Artificial Sequence
  Description of Artificial Sequence: Synthetic polypeptide
DEEEIRTTNPVATEQYGSVSEDLQESEGNDR

SEQ ID NO: 34189 - protein, 28 aa, Artificial Sequence
  Description of Artificial Sequence: Synthetic peptide
DESEINTTNPVATEIYGWVSTNLQRENI

SEQ ID NO: 34190 - protein, 28 aa, Artificial Sequence
  Description of Artificial Sequence: Synthetic peptide
DEHEIRTTNPCATEQYGWVDTNEQRGND

SEQ ID NO: 34191 - protein, 32 aa, Artificial Sequence
  Description of Artificial Sequence: Synthetic polypeptide
DEEEIRTTNPVATEQYGSVSETNLQEHEGEER

SEQ ID NO: 34192 - protein, 28 aa, Artificial Sequence
  Description of Artificial Sequence: Synthetic peptide
DEEEIRCTNPVSTEQYGSVSTNDEGGNL

SEQ ID NO: 34193 - protein, 28 aa, Artificial Sequence
  Description of Artificial Sequence: Synthetic peptide
QEEEIRTTNPVSTEQYGEASENIQRGNR

SEQ ID NO: 34194 - protein, 29 aa, Artificial Sequence
  Description of Artificial Sequence: Synthetic peptide
DEVEIRTTNPVATELYGVCSENLQERGNR

SEQ ID NO: 34195 - protein, 30 aa, Artificial Sequence
  Description of Artificial Sequence: Synthetic polypeptide
DEEEIRTTNPTATEQFGSVSTLLQRSGNTF

SEQ ID NO: 34196 - protein, 28 aa, Artificial Sequence
  Description of Artificial Sequence: Synthetic peptide
DEEEISTTNPVATEQYGDVTTNLQNGDF

SEQ ID NO: 34197 - protein, 29 aa, Artificial Sequence
  Description of Artificial Sequence: Synthetic peptide
GEEEIRTTNPVATEQYGWVSTDLQRDGES

SEQ ID NO: 34198 - protein, 29 aa, Artificial Sequence
  Description of Artificial Sequence: Synthetic peptide
DEEEIRTTNPVADEQYGSVSTGPQFDGNT

SEQ ID NO: 34199 - protein, 32 aa, Artificial Sequence
  Description of Artificial Sequence: Synthetic polypeptide
DEEEIRTTNPVATEQYGSVDSTNLQPEGDNED

SEQ ID NO: 34200 - protein, 28 aa, Artificial Sequence
  Description of Artificial Sequence: Synthetic peptide
GEEEIRTTNPVATEQYGWVATDLDRGNI

SEQ ID NO: 34201 - protein, 28 aa, Artificial Sequence
  Description of Artificial Sequence: Synthetic peptide
DEEEIRTTNPCATEQYGSVSTADENGNM

SEQ ID NO: 34202 - protein, 28 aa, Artificial Sequence
  Description of Artificial Sequence: Synthetic peptide
DDEEIRTTNPVAYEMYGSVGTNLERGND

SEQ ID NO: 34203 - protein, 28 aa, Artificial Sequence
  Description of Artificial Sequence: Synthetic peptide
KEESIRTTNPVATEQYGSVSENLQREEN

SEQ ID NO: 34204 - protein, 30 aa, Artificial Sequence
  Description of Artificial Sequence: Synthetic polypeptide
DEGEIRTTNPVATFHYGSVSTNLQRDGNDE

SEQ ID NO: 34205 - protein, 28 aa, Artificial Sequence
  Description of Artificial Sequence: Synthetic peptide
DEQEIRTTNPVATEQYGSVETEDQGGER

SEQ ID NO: 34206 - protein, 28 aa, Artificial Sequence
  Description of Artificial Sequence: Synthetic peptide
QDEEIHTTNPVGTEQYGSVSTNWQRGDR

SEQ ID NO: 34207 - protein, 31 aa, Artificial Sequence
  Description of Artificial Sequence: Synthetic polypeptide
DEEEIRTTNPVATEQYGSVSETNLEDRGDEI

SEQ ID NO: 34208 - protein, 31 aa, Artificial Sequence
  Description of Artificial Sequence: Synthetic polypeptide
DEEEIRTTNPDATEQYGSVSTGNDPQPRGNA

SEQ ID NO: 34209 - protein, 28 aa, Artificial Sequence
  Description of Artificial Sequence: Synthetic peptide
DEQEIRTTNPVATEQYGSVSTDLEIGEA

SEQ ID NO: 34210 - protein, 28 aa, Artificial Sequence
  Description of Artificial Sequence: Synthetic peptide
DEEEIRCTNPVSTEQYGSVSSNEQWGNE

SEQ ID NO: 34211 - protein, 28 aa, Artificial Sequence
  Description of Artificial Sequence: Synthetic peptide
DEEEISTTNPDATEQWGSVSAAEQRGNR

SEQ ID NO: 34212 - protein, 31 aa, Artificial Sequence
  Description of Artificial Sequence: Synthetic polypeptide
MEEEIRTTNPVATEQYGSVSTNLQESEGNDY

SEQ ID NO: 34213 - protein, 28 aa, Artificial Sequence
  Description of Artificial Sequence: Synthetic peptide
DEEEIRTVNPVATEQWGSSSTDPQRGNS

SEQ ID NO: 34214 - protein, 31 aa, Artificial Sequence
  Description of Artificial Sequence: Synthetic polypeptide
DEEEIRPTNPVATEQYGSVSTNLLMPDGENR

SEQ ID NO: 34215 - protein, 31 aa, Artificial Sequence
  Description of Artificial Sequence: Synthetic polypeptide
DEEEIRTTNPVATECYGSVSATNLQRKGEDT

SEQ ID NO: 34216 - protein, 30 aa, Artificial Sequence
  Description of Artificial Sequence: Synthetic polypeptide
QEEEIVTTNPVATESYGSVSTNEQDRFGNR

SEQ ID NO: 34217 - protein, 31 aa, Artificial Sequence
  Description of Artificial Sequence: Synthetic polypeptide
DEEEIRTTNPVATEQYGSVDSTNPLQDAGED

SEQ ID NO: 34218 - protein, 28 aa, Artificial Sequence
  Description of Artificial Sequence: Synthetic peptide
DETEIRTTNPVATEVYGDVSTNWQYGNH

SEQ ID NO: 34219 - protein, 29 aa, Artificial Sequence
  Description of Artificial Sequence: Synthetic peptide
HESEIRCTNPVATEQYGSVSTLNEQRGNV

SEQ ID NO: 34220 - protein, 31 aa, Artificial Sequence
  Description of Artificial Sequence: Synthetic polypeptide
DEEEIRCTNPVATEQYGSVSETNLQEQDGDR

SEQ ID NO: 34221 - protein, 33 aa, Artificial Sequence
  Description of Artificial Sequence: Synthetic polypeptide
DEEEIRTTNPVATEQYGSVDSVTNGLERKGINR

SEQ ID NO: 34222 - protein, 31 aa, Artificial Sequence
  Description of Artificial Sequence: Synthetic polypeptide
DEQEIRTTNPVATEQYGSVSETNPLVERGNF

SEQ ID NO: 34223 - protein, 31 aa, Artificial Sequence
  Description of Artificial Sequence: Synthetic polypeptide
DEEEIRTTNPVATEQYGSVSCTELQCAGNDH

SEQ ID NO: 34224 - protein, 30 aa, Artificial Sequence
  Description of Artificial Sequence: Synthetic polypeptide
DEEEIATTNPVATEQYGSVSEMNEQRGFNQ

SEQ ID NO: 34225 - protein, 30 aa, Artificial Sequence
  Description of Artificial Sequence: Synthetic polypeptide
DEQEIRTTNPVATEQYGSVSETDDVERGNR

SEQ ID NO: 34226 - protein, 32 aa, Artificial Sequence
  Description of Artificial Sequence: Synthetic polypeptide
DEEEIRTVNPVATEQYGSVSTLNGLQFEGNYR

SEQ ID NO: 34227 - protein, 30 aa, Artificial Sequence
  Description of Artificial Sequence: Synthetic polypeptide
DEEEIRTTNPVATEQYGSVSTANEQDQGTI

SEQ ID NO: 34228 - protein, 32 aa, Artificial Sequence
  Description of Artificial Sequence: Synthetic polypeptide
DEEEIRTTNPFATEQYGSVSTNLVDLRGENPR

SEQ ID NO: 34229 - protein, 32 aa, Artificial Sequence
  Description of Artificial Sequence: Synthetic polypeptide
DEQEIRTTNPVATEQYGSVDSTINDQERNGNR

SEQ ID NO: 34230 - protein, 28 aa, Artificial Sequence
  Description of Artificial Sequence: Synthetic peptide
DTEEIRTTNPVATEQYGSWSTPDQPGNP

SEQ ID NO: 34231 - protein, 29 aa, Artificial Sequence
  Description of Artificial Sequence: Synthetic peptide
DEEEIRTTNPVATECYGSVSTNEMMIGNQ

SEQ ID NO: 34232 - protein, 31 aa, Artificial Sequence
  Description of Artificial Sequence: Synthetic polypeptide
DEEEIRTTNPDATEIYGSVSATDNDQRGNQR

SEQ ID NO: 34233 - protein, 29 aa, Artificial Sequence
  Description of Artificial Sequence: Synthetic peptide
DEEEIRTTNPTATEQYGSVSTNEQLGTTL

SEQ ID NO: 34234 - protein, 28 aa, Artificial Sequence
  Description of Artificial Sequence: Synthetic peptide
MEEEIRTTNPVATEQYGSVSEDEQNGNM

SEQ ID NO: 34235 - protein, 28 aa, Artificial Sequence
  Description of Artificial Sequence: Synthetic peptide
VEEEIRTTNPVATEMYGSVSTDLQVGDH

SEQ ID NO: 34236 - protein, 30 aa, Artificial Sequence
  Description of Artificial Sequence: Synthetic polypeptide
DEEEIRTTNPVAIEQYGSVSVVNLWRGDNH

SEQ ID NO: 34237 - protein, 28 aa, Artificial Sequence
  Description of Artificial Sequence: Synthetic peptide
DEEEIATTNPVATECYGSVSMPLQQGNN

SEQ ID NO: 34238 - protein, 28 aa, Artificial Sequence
  Description of Artificial Sequence: Synthetic peptide
DEEEIRTTNPVATEQYGSVETPLDREDN

SEQ ID NO: 34239 - protein, 30 aa, Artificial Sequence
  Description of Artificial Sequence: Synthetic polypeptide
DEAEICTTNPVATEQYGVSVSENLQGEGNR

SEQ ID NO: 34240 - protein, 28 aa, Artificial Sequence
  Description of Artificial Sequence: Synthetic peptide
DEEEIRCTNPVCTEQFGSVSVNPQRGNE

SEQ ID NO: 34241 - protein, 32 aa, Artificial Sequence
  Description of Artificial Sequence: Synthetic polypeptide
SEEEIRTTNPEATEQYGSVSSTNLQTRDGMNR

SEQ ID NO: 34242 - protein, 30 aa, Artificial Sequence
  Description of Artificial Sequence: Synthetic polypeptide
DEVEIRTTNPVATEQYGSVSENLCCRGNDS

SEQ ID NO: 34243 - protein, 30 aa, Artificial Sequence
  Description of Artificial Sequence: Synthetic polypeptide
DEEEIRTTNPVATEQYGNVAEVLLQRGFNR

SEQ ID NO: 34244 - protein, 29 aa, Artificial Sequence
  Description of Artificial Sequence: Synthetic peptide
DENEIRTTNPVATEQYGSVSDNLQDNGDM

SEQ ID NO: 34245 - protein, 28 aa, Artificial Sequence
  Description of Artificial Sequence: Synthetic peptide
DEEEIRTTNPEATEQYGSVSTDDQNGEL

SEQ ID NO: 34246 - protein, 31 aa, Artificial Sequence
  Description of Artificial Sequence: Synthetic polypeptide
DEEEIRTTNPVATEQYGSVSETNLEDRGEEL

SEQ ID NO: 34247 - protein, 28 aa, Artificial Sequence
  Description of Artificial Sequence: Synthetic peptide
KEQEIRTTNPVATECYGSVSTDLQSGNF

SEQ ID NO: 34248 - protein, 32 aa, Artificial Sequence
  Description of Artificial Sequence: Synthetic polypeptide
DEEEIRTTNPVATEQYGSVSTMNPQDREGDNF

SEQ ID NO: 34249 - protein, 32 aa, Artificial Sequence
  Description of Artificial Sequence: Synthetic polypeptide
DEEEIRTTNPVATEQYGCSVSCTNLVQAEGNG

SEQ ID NO: 34250 - protein, 28 aa, Artificial Sequence
  Description of Artificial Sequence: Synthetic peptide
DEEEIYATNPCATEQYGNVSTNLQRGEE

SEQ ID NO: 34251 - protein, 28 aa, Artificial Sequence
  Description of Artificial Sequence: Synthetic peptide
DEEEISTTNPVATEQYGEMSCQLQQGNR

SEQ ID NO: 34252 - protein, 28 aa, Artificial Sequence
  Description of Artificial Sequence: Synthetic peptide
SEEEIRTTNPEATELYGSVSTNLQGGDL

SEQ ID NO: 34253 - protein, 32 aa, Artificial Sequence
  Description of Artificial Sequence: Synthetic polypeptide
DEEEIRTTNPVATEQYGSVSTNLQDDEGENEE

SEQ ID NO: 34254 - protein, 30 aa, Artificial Sequence
  Description of Artificial Sequence: Synthetic polypeptide
DEEEIRATNPVATEQYGSVSAENLQEKMNR

SEQ ID NO: 34255 - protein, 32 aa, Artificial Sequence
  Description of Artificial Sequence: Synthetic polypeptide
DEEEIRTTNPVATEQYGSVSETPGLDERGNDR

SEQ ID NO: 34256 - protein, 28 aa, Artificial Sequence
  Description of Artificial Sequence: Synthetic peptide
SEECIRTTNPTATEQFGSVSTGLQRGNG

SEQ ID NO: 34257 - protein, 28 aa, Artificial Sequence
  Description of Artificial Sequence: Synthetic peptide
QEMEICTTNPVATENYGSVSTVLQHGNR

SEQ ID NO: 34258 - protein, 28 aa, Artificial Sequence
  Description of Artificial Sequence: Synthetic peptide
DENEIRTTNPVATEQYGWVSDALERGNA

SEQ ID NO: 34259 - protein, 31 aa, Artificial Sequence
  Description of Artificial Sequence: Synthetic polypeptide
DEEEIRTTNPVATECYGSVDSTNLQVGDNSL

SEQ ID NO: 34260 - protein, 28 aa, Artificial Sequence
  Description of Artificial Sequence: Synthetic peptide
QEEEIATTNPVATEQYGSVSTELQVGEV

SEQ ID NO: 34261 - protein, 31 aa, Artificial Sequence
  Description of Artificial Sequence: Synthetic polypeptide
DEEEIRTTNPVATFQYGSVSDTDLQLPNGNR

SEQ ID NO: 34262 - protein, 28 aa, Artificial Sequence
  Description of Artificial Sequence: Synthetic peptide
DEEEIRTTNPFATEQYGSVSTDQITGNN

SEQ ID NO: 34263 - protein, 31 aa, Artificial Sequence
  Description of Artificial Sequence: Synthetic polypeptide
DENEIRTTNPVATEIYGSVSTENLQNNGDNR

SEQ ID NO: 34264 - protein, 28 aa, Artificial Sequence
  Description of Artificial Sequence: Synthetic peptide
DEEEICTVNPEATEVYGSVSTNLQNGNN

SEQ ID NO: 34265 - protein, 29 aa, Artificial Sequence
  Description of Artificial Sequence: Synthetic peptide
DEEEIRTTNPTATEQYGDVSTNEPQNENR

SEQ ID NO: 34266 - protein, 28 aa, Artificial Sequence
  Description of Artificial Sequence: Synthetic peptide
DEEEIRTTNPEATEQYGSVSTEDQAGDL

SEQ ID NO: 34267 - protein, 28 aa, Artificial Sequence
  Description of Artificial Sequence: Synthetic peptide
DEEEIRTTNPVATEQYGSVETPDQNGEG

SEQ ID NO: 34268 - protein, 32 aa, Artificial Sequence
  Description of Artificial Sequence: Synthetic polypeptide
DEEEVRTTNPVATESYGSVSCTNGLQQREGNR

SEQ ID NO: 34269 - protein, 28 aa, Artificial Sequence
  Description of Artificial Sequence: Synthetic peptide
DEEEIRTTNPVATEQWGSVDENEMRGNF

SEQ ID NO: 34270 - protein, 33 aa, Artificial Sequence
  Description of Artificial Sequence: Synthetic polypeptide
DEEEIRTTNPVATEQYGSVDSSTQNLQQFRGNM

SEQ ID NO: 34271 - protein, 28 aa, Artificial Sequence
  Description of Artificial Sequence: Synthetic peptide
DEEEIRTTNPVATEIYGCVGMNLERPNR

SEQ ID NO: 34272 - protein, 30 aa, Artificial Sequence
  Description of Artificial Sequence: Synthetic polypeptide
DEEEIRTTNPVATEQYGDVPTNLQIRGEDN

SEQ ID NO: 34273 - protein, 30 aa, Artificial Sequence
  Description of Artificial Sequence: Synthetic polypeptide
MEEEIRTTNPVATEQYGSVSTDLQENEGNM

SEQ ID NO: 34274 - protein, 30 aa, Artificial Sequence
  Description of Artificial Sequence: Synthetic polypeptide
DEEEISTTNPVATECYGSVSTELQITGNDR

SEQ ID NO: 34275 - protein, 31 aa, Artificial Sequence
  Description of Artificial Sequence: Synthetic polypeptide
SEEEIRTTNPTATEQYGSVSTMNLQDRGDTR

SEQ ID NO: 34276 - protein, 28 aa, Artificial Sequence
  Description of Artificial Sequence: Synthetic peptide
DEEEIRTTNPVATQCYGSVSTPLDDGND

SEQ ID NO: 34277 - protein, 32 aa, Artificial Sequence
  Description of Artificial Sequence: Synthetic polypeptide
DEEEIRTTNPVATEQYGSVETNPLQERGDEPR

SEQ ID NO: 34278 - protein, 32 aa, Artificial Sequence
  Description of Artificial Sequence: Synthetic polypeptide
DEEEIRTTNPVATEQYGSYVSETNDEDRGNDR

SEQ ID NO: 34279 - protein, 28 aa, Artificial Sequence
  Description of Artificial Sequence: Synthetic peptide
DEIEICGTNPVATEQYGSVSTNEQGGNF

SEQ ID NO: 34280 - protein, 28 aa, Artificial Sequence
  Description of Artificial Sequence: Synthetic peptide
NEEEIKSTNPVATESYGSVSTELERGNR

SEQ ID NO: 34281 - protein, 28 aa, Artificial Sequence
  Description of Artificial Sequence: Synthetic peptide
QEVEITCTNPVATEIYGSVSTNLQRGNN

SEQ ID NO: 34282 - protein, 28 aa, Artificial Sequence
  Description of Artificial Sequence: Synthetic peptide
DEGELRTTNPVATEQYGSVTTNQQIGND

SEQ ID NO: 34283 - protein, 30 aa, Artificial Sequence
  Description of Artificial Sequence: Synthetic polypeptide
DEEEIRTTNPDATEQYGSVSTPPLQEWGER

SEQ ID NO: 34284 - protein, 28 aa, Artificial Sequence
  Description of Artificial Sequence: Synthetic peptide
DEQEIRTTNPVATEQYGSVETDDQRGEL

SEQ ID NO: 34285 - protein, 28 aa, Artificial Sequence
  Description of Artificial Sequence: Synthetic peptide
DEEEIRTTNPTATEMYGSVSTDEQVGNY

SEQ ID NO: 34286 - protein, 28 aa, Artificial Sequence
  Description of Artificial Sequence: Synthetic peptide
DEEEIRTTNPVATEQYGSVETNPEAEDR

SEQ ID NO: 34287 - protein, 28 aa, Artificial Sequence
  Description of Artificial Sequence: Synthetic peptide
SEFEIRATNPVATECYGSVSTNLQRGTS

SEQ ID NO: 34288 - protein, 29 aa, Artificial Sequence
  Description of Artificial Sequence: Synthetic peptide
DEEEIRTTNPVATEQWGSVSTNEMWLGNW

SEQ ID NO: 34289 - protein, 30 aa, Artificial Sequence
  Description of Artificial Sequence: Synthetic polypeptide
DEEEIRTTNPEATEQYGSVSTNDQEKGDNH

SEQ ID NO: 34290 - protein, 32 aa, Artificial Sequence
  Description of Artificial Sequence: Synthetic polypeptide
SEEEIRTTNPVATEQFGSVISTMNLPQRSGNR

SEQ ID NO: 34291 - protein, 28 aa, Artificial Sequence
  Description of Artificial Sequence: Synthetic peptide
DEECIRTTNPVATCQYGDVHTNLLRGDR

SEQ ID NO: 34292 - protein, 30 aa, Artificial Sequence
  Description of Artificial Sequence: Synthetic polypeptide
DEVEIAATNPVATEQYGSVSTNEQREGNTR

SEQ ID NO: 34293 - protein, 29 aa, Artificial Sequence
  Description of Artificial Sequence: Synthetic peptide
DEEEIRTTNPTASEIYGCVSSNLQFRGNR

SEQ ID NO: 34294 - protein, 34 aa, Artificial Sequence
  Description of Artificial Sequence: Synthetic polypeptide
DEEEIRTTNPVATEQYGSVSSLTMNGLVQRGENR

SEQ ID NO: 34295 - protein, 30 aa, Artificial Sequence
  Description of Artificial Sequence: Synthetic polypeptide
DEHEIRTTNPVATEQYGSVSENLCCREGNA

SEQ ID NO: 34296 - protein, 28 aa, Artificial Sequence
  Description of Artificial Sequence: Synthetic peptide
DEEEIRTTNPVATECWGSVSTNEEQGNW

SEQ ID NO: 34297 - protein, 30 aa, Artificial Sequence
  Description of Artificial Sequence: Synthetic polypeptide
DEEEIRTTNPVATETFGSVSTGNLQMGNDF

SEQ ID NO: 34298 - protein, 28 aa, Artificial Sequence
  Description of Artificial Sequence: Synthetic peptide
DENEISTTNPEATEQYGDVSTNPQRGNA

SEQ ID NO: 34299 - protein, 29 aa, Artificial Sequence
  Description of Artificial Sequence: Synthetic peptide
DEEEIRTTNPTATEQYGEVSENLQDRGDV

SEQ ID NO: 34300 - protein, 28 aa, Artificial Sequence
  Description of Artificial Sequence: Synthetic peptide
DEEEIRTTNPEATEQYGSVSTNDEVENF

SEQ ID NO: 34301 - protein, 30 aa, Artificial Sequence
  Description of Artificial Sequence: Synthetic polypeptide
DEEEIRATNPVATEQYGSVSTELQDIGEDR

SEQ ID NO: 34302 - protein, 28 aa, Artificial Sequence
  Description of Artificial Sequence: Synthetic peptide
QEEEIITTNPVATEQYGEVSENSQRDNR

SEQ ID NO: 34303 - protein, 29 aa, Artificial Sequence
  Description of Artificial Sequence: Synthetic peptide
SEEEIRTTNPVCTEQYGSVSTNGLQTGTA

SEQ ID NO: 34304 - protein, 30 aa, Artificial Sequence
  Description of Artificial Sequence: Synthetic polypeptide
DEQEIRATNPVSTEAYGSVSTNPLQREGNR

SEQ ID NO: 34305 - protein, 31 aa, Artificial Sequence
  Description of Artificial Sequence: Synthetic polypeptide
DEEEIMTTNPVATEQYGSVSTGNEQQIGPNR

SEQ ID NO: 34306 - protein, 31 aa, Artificial Sequence
  Description of Artificial Sequence: Synthetic polypeptide
DEEEIATTNPVATEQYGSVSTNLQDDGENDH

SEQ ID NO: 34307 - protein, 30 aa, Artificial Sequence
  Description of Artificial Sequence: Synthetic polypeptide
DEEEIRTTNPDATEQYGSVSTGLQRDGELA

SEQ ID NO: 34308 - protein, 30 aa, Artificial Sequence
  Description of Artificial Sequence: Synthetic polypeptide
DEEEIRTTNPVATEQYGSVSATNLEEHGEL

SEQ ID NO: 34309 - protein, 28 aa, Artificial Sequence
  Description of Artificial Sequence: Synthetic peptide
DEQEIRCTNPVATEIYGCVATNLERGNR

SEQ ID NO: 34310 - protein, 31 aa, Artificial Sequence
  Description of Artificial Sequence: Synthetic polypeptide
DEEEIRTTNPVATEQYGSVSTNLEEDDGEDR

SEQ ID NO: 34311 - protein, 28 aa, Artificial Sequence
  Description of Artificial Sequence: Synthetic peptide
DEEEIRTTNPIATFQYGSVSSDLERGNP

SEQ ID NO: 34312 - protein, 28 aa, Artificial Sequence
  Description of Artificial Sequence: Synthetic peptide
DENEIRCTNPVCTEQYGWVSTNLQLGNV

SEQ ID NO: 34313 - protein, 28 aa, Artificial Sequence
  Description of Artificial Sequence: Synthetic peptide
DEEEIRTTNPVATEQYGVVSACLCPGNE

SEQ ID NO: 34314 - protein, 30 aa, Artificial Sequence
  Description of Artificial Sequence: Synthetic polypeptide
QEEEICTTNPVATEQYGSVSTNGGQVGNTR

SEQ ID NO: 34315 - protein, 31 aa, Artificial Sequence
  Description of Artificial Sequence: Synthetic polypeptide
DEEEIRTTNPVATECYGSVSTNLQDRGEEDA

SEQ ID NO: 34316 - protein, 31 aa, Artificial Sequence
  Description of Artificial Sequence: Synthetic polypeptide
DEEEIRTTNPVATEQYGSVSTDLQERKGEDL

SEQ ID NO: 34317 - protein, 29 aa, Artificial Sequence
  Description of Artificial Sequence: Synthetic peptide
SEDEITTTNPVATETYGSVSEANLQRGNR

SEQ ID NO: 34318 - protein, 28 aa, Artificial Sequence
  Description of Artificial Sequence: Synthetic peptide
DEEEIATTNPVATEQYGWVSTDLERGED

SEQ ID NO: 34319 - protein, 28 aa, Artificial Sequence
  Description of Artificial Sequence: Synthetic peptide
DENEIRTTNPVATECWGSVSTNEQLGNM

SEQ ID NO: 34320 - protein, 28 aa, Artificial Sequence
  Description of Artificial Sequence: Synthetic peptide
DEEEIATTNPVATEIYGSVGQNLQRGEV

SEQ ID NO: 34321 - protein, 33 aa, Artificial Sequence
  Description of Artificial Sequence: Synthetic polypeptide
DEEEIRTTNPVATEQYGSVDCTMNLQREGENDR

SEQ ID NO: 34322 - protein, 28 aa, Artificial Sequence
  Description of Artificial Sequence: Synthetic peptide
MENEIRTTNPVATEQYGSVATNLQVGEL

SEQ ID NO: 34323 - protein, 29 aa, Artificial Sequence
  Description of Artificial Sequence: Synthetic peptide
DEEEIRCTNPVATECYGSVSTELELMGNR

SEQ ID NO: 34324 - protein, 32 aa, Artificial Sequence
  Description of Artificial Sequence: Synthetic polypeptide
WEEEIRTTNPVATEQYGSVNTSNLKQRGENYR

SEQ ID NO: 34325 - protein, 28 aa, Artificial Sequence
  Description of Artificial Sequence: Synthetic peptide
DEEEISATNPVAHEQYGEVSTNLQRGQS

SEQ ID NO: 34326 - protein, 33 aa, Artificial Sequence
  Description of Artificial Sequence: Synthetic polypeptide
DEEEIRTTNPVATEQYGSVSLTVNLERDGENDR

SEQ ID NO: 34327 - protein, 31 aa, Artificial Sequence
  Description of Artificial Sequence: Synthetic polypeptide
DENEIRTTNPVATEQYGVVSTTENDQRGNDR

SEQ ID NO: 34328 - protein, 31 aa, Artificial Sequence
  Description of Artificial Sequence: Synthetic polypeptide
DEEEIRTTNPVATECYGSVSATNLQDHNGNM

SEQ ID NO: 34329 - protein, 30 aa, Artificial Sequence
  Description of Artificial Sequence: Synthetic polypeptide
AEEEIRTTNPVATEQYGSVMWTELQRGNMM

SEQ ID NO: 34330 - protein, 30 aa, Artificial Sequence
  Description of Artificial Sequence: Synthetic polypeptide
KEEEIRTTNPVATEQYGSVSTELQHEGNDT

SEQ ID NO: 34331 - protein, 30 aa, Artificial Sequence
  Description of Artificial Sequence: Synthetic polypeptide
DEEEIRTTNPVATECYGCVSETNLQVNGND

SEQ ID NO: 34332 - protein, 28 aa, Artificial Sequence
  Description of Artificial Sequence: Synthetic peptide
DENEIRATNPVATEQYGWASDNLQIGNR

SEQ ID NO: 34333 - protein, 29 aa, Artificial Sequence
  Description of Artificial Sequence: Synthetic peptide
MENEIRTTNPVATECYGSVSTNLQERGDM

SEQ ID NO: 34334 - protein, 28 aa, Artificial Sequence
  Description of Artificial Sequence: Synthetic peptide
DDEEIRSVNPVATEQYGSCSTNLQNGNY

SEQ ID NO: 34335 - protein, 28 aa, Artificial Sequence
  Description of Artificial Sequence: Synthetic peptide
DEEEIRSTNPVAVEQYGDVSTNLERGDG

SEQ ID NO: 34336 - protein, 28 aa, Artificial Sequence
  Description of Artificial Sequence: Synthetic peptide
DEQEIRTVNPVATEQYGEASENLQHGNR

SEQ ID NO: 34337 - protein, 28 aa, Artificial Sequence
  Description of Artificial Sequence: Synthetic peptide
DEEEIRTTNPVATELWGDVSTNEQRGTA

SEQ ID NO: 34338 - protein, 28 aa, Artificial Sequence
  Description of Artificial Sequence: Synthetic peptide
DEEEIVTTNPVATECYGSVSTNLETGEA

SEQ ID NO: 34339 - protein, 28 aa, Artificial Sequence
  Description of Artificial Sequence: Synthetic peptide
DEQEIRTTNPVATEQYGSVSTDLEDGEF

SEQ ID NO: 34340 - protein, 29 aa, Artificial Sequence
  Description of Artificial Sequence: Synthetic peptide
DEEEIRTTNPVATENYGTVGTNYQERGER

SEQ ID NO: 34341 - protein, 28 aa, Artificial Sequence
  Description of Artificial Sequence: Synthetic peptide
DEEEIRTTNPFATEQYGSVSTGQELGNH

SEQ ID NO: 34342 - protein, 31 aa, Artificial Sequence
  Description of Artificial Sequence: Synthetic polypeptide
MEEEIRTTNPVATEQYGSVSTDLQENEGNDR

SEQ ID NO: 34343 - protein, 29 aa, Artificial Sequence
  Description of Artificial Sequence: Synthetic peptide
KEEEIRTTNPVATEQYGTMSTNLQERGDF

SEQ ID NO: 34344 - protein, 32 aa, Artificial Sequence
  Description of Artificial Sequence: Synthetic polypeptide
DEEEIRTTNPVATEQYGSYVSAPNGLQERGNM

SEQ ID NO: 34345 - protein, 28 aa, Artificial Sequence
  Description of Artificial Sequence: Synthetic peptide
DEEEIRCTNPVATEQWGSYSTNEQVGDR

SEQ ID NO: 34346 - protein, 28 aa, Artificial Sequence
  Description of Artificial Sequence: Synthetic peptide
DEEEIRTTNPVATEQYGTVDTEPQQGNQ

SEQ ID NO: 34347 - protein, 28 aa, Artificial Sequence
  Description of Artificial Sequence: Synthetic peptide
DTEEIRTTNPVATEQYGSVETNGLHGNG

SEQ ID NO: 34348 - protein, 30 aa, Artificial Sequence
  Description of Artificial Sequence: Synthetic polypeptide
DEEEIRTTNPVATEQYGSVSTVPLQEHGEW

SEQ ID NO: 34349 - protein, 28 aa, Artificial Sequence
  Description of Artificial Sequence: Synthetic peptide
DENEIVTTNPFATEQYGSVSTGLQVGNQ

SEQ ID NO: 34350 - protein, 30 aa, Artificial Sequence
  Description of Artificial Sequence: Synthetic polypeptide
DEEEIRTTNPVATEQYGSVSTEPLQIDGDM

SEQ ID NO: 34351 - protein, 29 aa, Artificial Sequence
  Description of Artificial Sequence: Synthetic peptide
DEEEIRSTNPVATEQYGSVSTDLQENGES

SEQ ID NO: 34352 - protein, 28 aa, Artificial Sequence
  Description of Artificial Sequence: Synthetic peptide
QEEEIRTVNPVATEVYGSVSEVLQHGNR

SEQ ID NO: 34353 - protein, 31 aa, Artificial Sequence
  Description of Artificial Sequence: Synthetic polypeptide
DEEEIVTTNPVATEQYGSVSEENGLQRNGND

SEQ ID NO: 34354 - protein, 31 aa, Artificial Sequence
  Description of Artificial Sequence: Synthetic polypeptide
DEEEIRTTNPVATEQYGSVDPTNLQWIGENA

SEQ ID NO: 34355 - protein, 28 aa, Artificial Sequence
  Description of Artificial Sequence: Synthetic peptide
NEEEIRTTNPVATEQYGSVDTDWQQGNS

SEQ ID NO: 34356 - protein, 31 aa, Artificial Sequence
  Description of Artificial Sequence: Synthetic polypeptide
DEEEIRTTNPEATEQYGSVSDTNEAFDRGNR

SEQ ID NO: 34357 - protein, 32 aa, Artificial Sequence
  Description of Artificial Sequence: Synthetic polypeptide
DEEEIRTTNPVATEQYGSVSTCNEQERGDNTQ

SEQ ID NO: 34358 - protein, 30 aa, Artificial Sequence
  Description of Artificial Sequence: Synthetic polypeptide
DEEEIRTTNPVATEQYGSVSENLQEHGEDN

SEQ ID NO: 34359 - protein, 31 aa, Artificial Sequence
  Description of Artificial Sequence: Synthetic polypeptide
DEEEIRTTNPVATEQYGSVSCTMELCDRGNH

SEQ ID NO: 34360 - protein, 28 aa, Artificial Sequence
  Description of Artificial Sequence: Synthetic peptide
DEEEIRTTNPVSTEWYGSVSTNEQQGTS

SEQ ID NO: 34361 - protein, 32 aa, Artificial Sequence
  Description of Artificial Sequence: Synthetic polypeptide
DEEEIRTTNPVATEQYGSVISTCNEPQRGDNS

SEQ ID NO: 34362 - protein, 28 aa, Artificial Sequence
  Description of Artificial Sequence: Synthetic peptide
SEEEIRTTNPVATEQYGSVCTNGESGNT

SEQ ID NO: 34363 - protein, 28 aa, Artificial Sequence
  Description of Artificial Sequence: Synthetic peptide
DEEEIRTTNPEATEMYGCVSADLQRGNQ

SEQ ID NO: 34364 - protein, 33 aa, Artificial Sequence
  Description of Artificial Sequence: Synthetic polypeptide
DEEEIRTTNPVATEQYGSVDSTNLQERDGENEE

SEQ ID NO: 34365 - protein, 30 aa, Artificial Sequence
  Description of Artificial Sequence: Synthetic polypeptide
DEEEIRTTNPVATEQYGSVSTDLQEQGEDI

SEQ ID NO: 34366 - protein, 32 aa, Artificial Sequence
  Description of Artificial Sequence: Synthetic polypeptide
DEEEIVTTNPVATEQYGSVSITNLQVAKGVNR

SEQ ID NO: 34367 - protein, 28 aa, Artificial Sequence
  Description of Artificial Sequence: Synthetic peptide
DEEEIATTNPCATEQYGSVFTNEQREDR

SEQ ID NO: 34368 - protein, 30 aa, Artificial Sequence
  Description of Artificial Sequence: Synthetic polypeptide
DEQEIRTTNPVATEQYGESVSTNPDEIGNR

SEQ ID NO: 34369 - protein, 31 aa, Artificial Sequence
  Description of Artificial Sequence: Synthetic polypeptide
DEEEIRTTNPVATEVYGSVSTMNNLQAGFQR

SEQ ID NO: 34370 - protein, 31 aa, Artificial Sequence
  Description of Artificial Sequence: Synthetic polypeptide
DEEEIRTTNPVATEIYGSVSTEALQHEGNDR

SEQ ID NO: 34371 - protein, 28 aa, Artificial Sequence
  Description of Artificial Sequence: Synthetic peptide
DDNEIRTTNPVATEQYGSVHTQEQRGDR

SEQ ID NO: 34372 - protein, 30 aa, Artificial Sequence
  Description of Artificial Sequence: Synthetic polypeptide
DEEEIRTTNPVATEQYGSVDTMDDQRGNDV

SEQ ID NO: 34373 - protein, 31 aa, Artificial Sequence
  Description of Artificial Sequence: Synthetic polypeptide
DEEEIRTTNPVATEQYGSVSTMNEPQDQGNF

SEQ ID NO: 34374 - protein, 28 aa, Artificial Sequence
  Description of Artificial Sequence: Synthetic peptide
DEEEIRTTNPVATEWYGIVSTNEMQGNA

SEQ ID NO: 34375 - protein, 28 aa, Artificial Sequence
  Description of Artificial Sequence: Synthetic peptide
DEECIRTTNPVATEQYGSWSTPDDRGNP

SEQ ID NO: 34376 - protein, 31 aa, Artificial Sequence
  Description of Artificial Sequence: Synthetic polypeptide
DEEEIRTTNPVATEQYGSVSTNNGTDEEGNR

SEQ ID NO: 34377 - protein, 28 aa, Artificial Sequence
  Description of Artificial Sequence: Synthetic peptide
DDSEIRTVNPVATEQYGSVATNLDRGNT

SEQ ID NO: 34378 - protein, 28 aa, Artificial Sequence
  Description of Artificial Sequence: Synthetic peptide
QEDEICTTNPTATEQYGSVSANPQRGNR

SEQ ID NO: 34379 - protein, 30 aa, Artificial Sequence
  Description of Artificial Sequence: Synthetic polypeptide
DEEEISTTNPVATEQYGSVSDMNLQEHGNL

SEQ ID NO: 34380 - protein, 28 aa, Artificial Sequence
  Description of Artificial Sequence: Synthetic peptide
SEEEIRTTNPTATEQYGSVSTNWQNGTV

SEQ ID NO: 34381 - protein, 32 aa, Artificial Sequence
  Description of Artificial Sequence: Synthetic polypeptide
DEEEIRTTNPVATEQYGVSVISHNNLQRGNNM

SEQ ID NO: 34382 - protein, 31 aa, Artificial Sequence
  Description of Artificial Sequence: Synthetic polypeptide
DEEEIRTTNPVATEQYGSVSCTMDLQHGNDA

SEQ ID NO: 34383 - protein, 28 aa, Artificial Sequence
  Description of Artificial Sequence: Synthetic peptide
DEEEIRTTNPLATEQYGSVNINVQHGER

SEQ ID NO: 34384 - protein, 32 aa, Artificial Sequence
  Description of Artificial Sequence: Synthetic polypeptide
DAEEIRTTNPVATEIYGSVSTNPLQRNGDNPR

SEQ ID NO: 34385 - protein, 31 aa, Artificial Sequence
  Description of Artificial Sequence: Synthetic polypeptide
DEEEIRTTNPTATEQYGSVSTNLQELEGDNF

SEQ ID NO: 34386 - protein, 32 aa, Artificial Sequence
  Description of Artificial Sequence: Synthetic polypeptide
DEEEIRTTNPVATEQYGSWSCTQNLDIRDGNR

SEQ ID NO: 34387 - protein, 28 aa, Artificial Sequence
  Description of Artificial Sequence: Synthetic peptide
DEEEIRTTNPVATEQYGSVSEYLESGDD

SEQ ID NO: 34388 - protein, 31 aa, Artificial Sequence
  Description of Artificial Sequence: Synthetic polypeptide
DEEEIRTTNPVGTEQYGCVYSNNLPQDRGNR

SEQ ID NO: 34389 - protein, 28 aa, Artificial Sequence
  Description of Artificial Sequence: Synthetic peptide
DEEEIAQTNPVATEQYGSVSTDLENGNV

SEQ ID NO: 34390 - protein, 28 aa, Artificial Sequence
  Description of Artificial Sequence: Synthetic peptide
DEEEIRTTNPEATEQYGSVSTPDQWGEW

SEQ ID NO: 34391 - protein, 28 aa, Artificial Sequence
  Description of Artificial Sequence: Synthetic peptide
DEEEIRTTNPEATEQYGSVSTEDQGGEM

SEQ ID NO: 34392 - protein, 29 aa, Artificial Sequence
  Description of Artificial Sequence: Synthetic peptide
DEEELRSTNPCATEQYGSVSSNLQFPGNR

SEQ ID NO: 34393 - protein, 31 aa, Artificial Sequence
  Description of Artificial Sequence: Synthetic polypeptide
DEEEIRTTNPVCTEQYGSVSCTALQTRNGND

SEQ ID NO: 34394 - protein, 32 aa, Artificial Sequence
  Description of Artificial Sequence: Synthetic polypeptide
DEEEIRTTNPVATEQYGSVSATNLQLDNGNDE

SEQ ID NO: 34395 - protein, 28 aa, Artificial Sequence
  Description of Artificial Sequence: Synthetic peptide
DEQEIRTTNPVATEQYGSVSTDLEGGEN

SEQ ID NO: 34396 - protein, 30 aa, Artificial Sequence
  Description of Artificial Sequence: Synthetic polypeptide
DEEEIRTTNPVATEQYGSASTNLQEHQEER

SEQ ID NO: 34397 - protein, 30 aa, Artificial Sequence
  Description of Artificial Sequence: Synthetic polypeptide
DEEEIRTTNPVATEIYGVVSTNLQLTGENM

SEQ ID NO: 34398 - protein, 32 aa, Artificial Sequence
  Description of Artificial Sequence: Synthetic polypeptide
QEEEIRTTNPVATEQYGSVSDTNLEERNGENR

SEQ ID NO: 34399 - protein, 31 aa, Artificial Sequence
  Description of Artificial Sequence: Synthetic polypeptide
DEEEIRTTNPVATEQYGSVSTMNEQDIGDNF

SEQ ID NO: 34400 - protein, 31 aa, Artificial Sequence
  Description of Artificial Sequence: Synthetic polypeptide
DEEEIRTTNPEATEQYGSVSTINEVQRGDNM

SEQ ID NO: 34401 - protein, 28 aa, Artificial Sequence
  Description of Artificial Sequence: Synthetic peptide
DEVEIAATNPVATEQFGSVSTNEQQGNR

SEQ ID NO: 34402 - protein, 29 aa, Artificial Sequence
  Description of Artificial Sequence: Synthetic peptide
QEQEIATTNPVATEQYGWVSADNLQRGNR

SEQ ID NO: 34403 - protein, 28 aa, Artificial Sequence
  Description of Artificial Sequence: Synthetic peptide
DEVEIVTTNPVATEVYGVVSENLQRGNN

SEQ ID NO: 34404 - protein, 28 aa, Artificial Sequence
  Description of Artificial Sequence: Synthetic peptide
KEQEIRQTNPVATEQYGSVSTELQNGNT

SEQ ID NO: 34405 - protein, 30 aa, Artificial Sequence
  Description of Artificial Sequence: Synthetic polypeptide
DEEEIRCTNPVATELYGSVSTALMRGENDR

SEQ ID NO: 34406 - protein, 28 aa, Artificial Sequence
  Description of Artificial Sequence: Synthetic peptide
AEEEITTTNPVATEQYGDVSTNDQRGEE

SEQ ID NO: 34407 - protein, 28 aa, Artificial Sequence
  Description of Artificial Sequence: Synthetic peptide
HEEEIRTTNPDSTEQYGSVSTNIQSGMR

SEQ ID NO: 34408 - protein, 33 aa, Artificial Sequence
  Description of Artificial Sequence: Synthetic polypeptide
DEEEIRTTNPVATEQYGSFVSNTGNLQYREGNV

SEQ ID NO: 34409 - protein, 29 aa, Artificial Sequence
  Description of Artificial Sequence: Synthetic peptide
GEEEIACTNPVATECYGWVSDTNLQRGNR

SEQ ID NO: 34410 - protein, 29 aa, Artificial Sequence
  Description of Artificial Sequence: Synthetic peptide
DEEEITTTNPVATEQYGCVSAAGQRGNDR

SEQ ID NO: 34411 - protein, 30 aa, Artificial Sequence
  Description of Artificial Sequence: Synthetic polypeptide
DEEEIRCTNPVATEIYGCVSATNLERNGNR

SEQ ID NO: 34412 - protein, 31 aa, Artificial Sequence
  Description of Artificial Sequence: Synthetic polypeptide
DEEEIRTTNPFATEQYGSVSTNNLFREGMND

SEQ ID NO: 34413 - protein, 30 aa, Artificial Sequence
  Description of Artificial Sequence: Synthetic polypeptide
YEHEIRTTNPVATEQYGSVSTMNLQTNGTR

SEQ ID NO: 34414 - protein, 30 aa, Artificial Sequence
  Description of Artificial Sequence: Synthetic polypeptide
DEEEIRTTNPSATEQYGSVSCTECYQRGER

SEQ ID NO: 34415 - protein, 30 aa, Artificial Sequence
  Description of Artificial Sequence: Synthetic polypeptide
DEEEIRTTNPVATEMYGVVSTNLQETEGNF

SEQ ID NO: 34416 - protein, 28 aa, Artificial Sequence
  Description of Artificial Sequence: Synthetic peptide
DENEIRTTNPVATEQYGSYHTIEQQGNR

SEQ ID NO: 34417 - protein, 30 aa, Artificial Sequence
  Description of Artificial Sequence: Synthetic polypeptide
DEQEIRTTNPVATEQYGSVDCEELQRGNDR

SEQ ID NO: 34418 - protein, 28 aa, Artificial Sequence
  Description of Artificial Sequence: Synthetic peptide
DEECIRATNPVATAQYGSVETNEQQGNR

SEQ ID NO: 34419 - protein, 28 aa, Artificial Sequence
  Description of Artificial Sequence: Synthetic peptide
DEQEVRTTNPIAYEMYGSVSTNLERGNR

SEQ ID NO: 34420 - protein, 28 aa, Artificial Sequence
  Description of Artificial Sequence: Synthetic peptide
DEEEIAQTNPVATEQYGEVSEVLQHGNR

SEQ ID NO: 34421 - protein, 31 aa, Artificial Sequence
  Description of Artificial Sequence: Synthetic polypeptide
DEEEIRTTNPVATECYGSVEFTNPDQREGNR

SEQ ID NO: 34422 - protein, 34 aa, Artificial Sequence
  Description of Artificial Sequence: Synthetic polypeptide
DEEEIRTTNPVATEQYGESVTSTNNLTQVRGINR

SEQ ID NO: 34423 - protein, 28 aa, Artificial Sequence
  Description of Artificial Sequence: Synthetic peptide
DEQEIRTTNPVATELWGSVSENLMTGNR

SEQ ID NO: 34424 - protein, 30 aa, Artificial Sequence
  Description of Artificial Sequence: Synthetic polypeptide
DEEEIRTTNPVATEQYGSVSATDDQSGEER

SEQ ID NO: 34425 - protein, 28 aa, Artificial Sequence
  Description of Artificial Sequence: Synthetic peptide
GEEEIRATNPVATEIYGSVSSDEQRGNR

SEQ ID NO: 34426 - protein, 31 aa, Artificial Sequence
  Description of Artificial Sequence: Synthetic polypeptide
DEEEIRTTNPVATEQYGSVSCEMDLQRGNDS

SEQ ID NO: 34427 - protein, 28 aa, Artificial Sequence
  Description of Artificial Sequence: Synthetic peptide
DEEEIRTTNPMATDIYGSVATSLQRGNH

SEQ ID NO: 34428 - protein, 28 aa, Artificial Sequence
  Description of Artificial Sequence: Synthetic peptide
DEEEIRTTNPEATEQYGSVSTEEQAGEY

SEQ ID NO: 34429 - protein, 30 aa, Artificial Sequence
  Description of Artificial Sequence: Synthetic polypeptide
DEEEIRCTNPVASEIYGCVSATNLQREGNR

SEQ ID NO: 34430 - protein, 28 aa, Artificial Sequence
  Description of Artificial Sequence: Synthetic peptide
DEEEIATTNPAATEQYGSVSTTLQGGDW

SEQ ID NO: 34431 - protein, 30 aa, Artificial Sequence
  Description of Artificial Sequence: Synthetic polypeptide
DEEEIRYTNPVATEQYGSVSVNQDRGSNSR

SEQ ID NO: 34432 - protein, 28 aa, Artificial Sequence
  Description of Artificial Sequence: Synthetic peptide
DEEEISTTNPVATENYGYVSTNLQHGQP

SEQ ID NO: 34433 - protein, 31 aa, Artificial Sequence
  Description of Artificial Sequence: Synthetic polypeptide
DEEEIRTTNPVATQQYGSVSTPNDQLRGENP

SEQ ID NO: 34434 - protein, 28 aa, Artificial Sequence
  Description of Artificial Sequence: Synthetic peptide
DEEEIRTTNPVATEQYGDVSENLQNEEL

SEQ ID NO: 34435 - protein, 31 aa, Artificial Sequence
  Description of Artificial Sequence: Synthetic polypeptide
DENEIRTTNPVATEMYGSVTSTPNLQLDGNR

SEQ ID NO: 34436 - protein, 28 aa, Artificial Sequence
  Description of Artificial Sequence: Synthetic peptide
SEEEIRTTNPAATEQYGSVSTNEQLGDY

SEQ ID NO: 34437 - protein, 30 aa, Artificial Sequence
  Description of Artificial Sequence: Synthetic polypeptide
DEEEIRTTNPVATEQYGSIVVSVPLQPGNW

SEQ ID NO: 34438 - protein, 28 aa, Artificial Sequence
  Description of Artificial Sequence: Synthetic peptide
DEVEIRTTNPVATELYGSVSENEQQGNF

SEQ ID NO: 34439 - protein, 28 aa, Artificial Sequence
  Description of Artificial Sequence: Synthetic peptide
DEEEIRTTNPVATEQWGSVSENEEIGNA

SEQ ID NO: 34440 - protein, 31 aa, Artificial Sequence
  Description of Artificial Sequence: Synthetic polypeptide
DEEEIRTTNPVATEQYGSVSITALQEKGVNI

SEQ ID NO: 34441 - protein, 32 aa, Artificial Sequence
  Description of Artificial Sequence: Synthetic polypeptide
DEEEIRTTNPVATEQYGSVSTTNLVQVNGEND

SEQ ID NO: 34442 - protein, 29 aa, Artificial Sequence
  Description of Artificial Sequence: Synthetic peptide
DEHEIRSTNPVATEQYGSVSSDLQYRGNQ

SEQ ID NO: 34443 - protein, 32 aa, Artificial Sequence
  Description of Artificial Sequence: Synthetic polypeptide
DEEEIRTTNPVATEQYGSVMTSNLQQDREGNF

SEQ ID NO: 34444 - protein, 32 aa, Artificial Sequence
  Description of Artificial Sequence: Synthetic polypeptide
DEEEIRTTNPVATEQYGSVSTNEQEVEGDNDR

SEQ ID NO: 34445 - protein, 28 aa, Artificial Sequence
  Description of Artificial Sequence: Synthetic peptide
DEVEIRTTNPVATEQFGGVSENLQQGDR

SEQ ID NO: 34446 - protein, 28 aa, Artificial Sequence
  Description of Artificial Sequence: Synthetic peptide
DEEEICTTNPAATEIFGSVSTNDQRGNP

SEQ ID NO: 34447 - protein, 31 aa, Artificial Sequence
  Description of Artificial Sequence: Synthetic polypeptide
DEEEIVTTNPVATEIYGSVSTGNLQSQGNFR

SEQ ID NO: 34448 - protein, 28 aa, Artificial Sequence
  Description of Artificial Sequence: Synthetic peptide
SEEEIRTTNPAATETYGSVSTNPQIGNF

SEQ ID NO: 34449 - protein, 28 aa, Artificial Sequence
  Description of Artificial Sequence: Synthetic peptide
HEEEIRSTNPVATELYGSVSQNLQRGEN

SEQ ID NO: 34450 - protein, 28 aa, Artificial Sequence
  Description of Artificial Sequence: Synthetic peptide
QEEEIATTNPVATEQYGSASENCQHGNR

SEQ ID NO: 34451 - protein, 32 aa, Artificial Sequence
  Description of Artificial Sequence: Synthetic polypeptide
DEEEIRTTNPVATEQYGSNVSTCNLQEPGINA

SEQ ID NO: 34452 - protein, 30 aa, Artificial Sequence
  Description of Artificial Sequence: Synthetic polypeptide
DEEEIRTTNPVATEQYGSVSTENLEDEGDF

SEQ ID NO: 34453 - protein, 30 aa, Artificial Sequence
  Description of Artificial Sequence: Synthetic polypeptide
DEEEIRTTNPVATEQYGVVSTELEVDEGNR

SEQ ID NO: 34454 - protein, 33 aa, Artificial Sequence
  Description of Artificial Sequence: Synthetic polypeptide
DEEEIRTTNPVATEQYGSVSITNLVQERKGDNV

SEQ ID NO: 34455 - protein, 29 aa, Artificial Sequence
  Description of Artificial Sequence: Synthetic peptide
DEEEICTTNPVATEQYGSVGASNLQVENR

SEQ ID NO: 34456 - protein, 28 aa, Artificial Sequence
  Description of Artificial Sequence: Synthetic peptide
DEEEICTTNPAATEQYGEVSENLQIGTR

SEQ ID NO: 34457 - protein, 30 aa, Artificial Sequence
  Description of Artificial Sequence: Synthetic polypeptide
DEEEIRTTNPAATECYGSVSTNLQSGINTV

SEQ ID NO: 34458 - protein, 31 aa, Artificial Sequence
  Description of Artificial Sequence: Synthetic polypeptide
DEECIRTTNPVATMQYGSVASTCNLDRGCNR

SEQ ID NO: 34459 - protein, 28 aa, Artificial Sequence
  Description of Artificial Sequence: Synthetic peptide
KEQEIRTTNPVATECYGSVSTDLQSGNS

SEQ ID NO: 34460 - protein, 28 aa, Artificial Sequence
  Description of Artificial Sequence: Synthetic peptide
DEEEIRTTNPVATEQYGSVETPEEPGER

SEQ ID NO: 34461 - protein, 29 aa, Artificial Sequence
  Description of Artificial Sequence: Synthetic peptide
DESEISTTNPVATEQYGSMSENLQWYGNR

SEQ ID NO: 34462 - protein, 28 aa, Artificial Sequence
  Description of Artificial Sequence: Synthetic peptide
DEQEIRTTNPVATEQYGSVSTNDDMGEA

SEQ ID NO: 34463 - protein, 28 aa, Artificial Sequence
  Description of Artificial Sequence: Synthetic peptide
SEEEIRTTNPAATEQFGSVSTNEQRGTS

SEQ ID NO: 34464 - protein, 28 aa, Artificial Sequence
  Description of Artificial Sequence: Synthetic peptide
DEEEIATTNPVATECYGSVSTNLQEEEL

SEQ ID NO: 34465 - protein, 28 aa, Artificial Sequence
  Description of Artificial Sequence: Synthetic peptide
DEEEIRCTNPVATEQYGSSSTPLQQGPS

SEQ ID NO: 34466 - protein, 32 aa, Artificial Sequence
  Description of Artificial Sequence: Synthetic polypeptide
DEEEIRTTNPVATEQYGSVSDTNDQDRDGNEP

SEQ ID NO: 34467 - protein, 30 aa, Artificial Sequence
  Description of Artificial Sequence: Synthetic polypeptide
DEEEIRTTNPVATEVYGWVSTNLQREGEDL

SEQ ID NO: 34468 - protein, 28 aa, Artificial Sequence
  Description of Artificial Sequence: Synthetic peptide
VEEEIRATNPVCTEQYGSVSDNLQYGNV

SEQ ID NO: 34469 - protein, 30 aa, Artificial Sequence
  Description of Artificial Sequence: Synthetic polypeptide
DEEEIRTTNPVATEQYGSVSTLNLTVGHEA

SEQ ID NO: 34470 - protein, 30 aa, Artificial Sequence
  Description of Artificial Sequence: Synthetic polypeptide
DEEEIRTTNPCATEQYGSVSCTNEQCYGND

SEQ ID NO: 34471 - protein, 28 aa, Artificial Sequence
  Description of Artificial Sequence: Synthetic peptide
SEEEIMTTNPVATECYGSVAAALQRGNR

SEQ ID NO: 34472 - protein, 28 aa, Artificial Sequence
  Description of Artificial Sequence: Synthetic peptide
DEEEIRPTNPICTEQYGFVATNLQSGNR

SEQ ID NO: 34473 - protein, 30 aa, Artificial Sequence
  Description of Artificial Sequence: Synthetic polypeptide
DEEEIRTTNPVATEMYGSVSTNPQDVGDTR

SEQ ID NO: 34474 - protein, 31 aa, Artificial Sequence
  Description of Artificial Sequence: Synthetic polypeptide
DEEEIRTTNPVATDQYGSTVYSTNLHRGSNP

SEQ ID NO: 34475 - protein, 31 aa, Artificial Sequence
  Description of Artificial Sequence: Synthetic polypeptide
DEQEIRTTNPVATEQYGSVDTENDVQRGDNR

SEQ ID NO: 34476 - protein, 28 aa, Artificial Sequence
  Description of Artificial Sequence: Synthetic peptide
DEEEIATTNPVATECYGSVSTNLEHGEL

SEQ ID NO: 34477 - protein, 29 aa, Artificial Sequence
  Description of Artificial Sequence: Synthetic peptide
SEEEITTTNPVATETYGSVSEENLQLGNR

SEQ ID NO: 34478 - protein, 28 aa, Artificial Sequence
  Description of Artificial Sequence: Synthetic peptide
DEEEIRTTNPVATQCYGSVSTGDQPGER

SEQ ID NO: 34479 - protein, 32 aa, Artificial Sequence
  Description of Artificial Sequence: Synthetic polypeptide
DEEEIRTTNPVATEQYGSVSITENLEDRDGNL

SEQ ID NO: 34480 - protein, 30 aa, Artificial Sequence
  Description of Artificial Sequence: Synthetic polypeptide
DEEEIRTTNPVATEQYGSVSTDLQDVGEDL

SEQ ID NO: 34481 - protein, 28 aa, Artificial Sequence
  Description of Artificial Sequence: Synthetic peptide
DEEEIRTTNPTATECFGSVSTNPQQGNI

SEQ ID NO: 34482 - protein, 28 aa, Artificial Sequence
  Description of Artificial Sequence: Synthetic peptide
DEEEIATTNPAATEQFGSVSTNEQQGNF

SEQ ID NO: 34483 - protein, 28 aa, Artificial Sequence
  Description of Artificial Sequence: Synthetic peptide
DEEEIRTTNPDATEQYGSVSTDLERDEM

SEQ ID NO: 34484 - protein, 30 aa, Artificial Sequence
  Description of Artificial Sequence: Synthetic polypeptide
DEEEIRTTNPVATEIYGIVSTNLQDRNGDL

SEQ ID NO: 34485 - protein, 31 aa, Artificial Sequence
  Description of Artificial Sequence: Synthetic polypeptide
DEEEIRTTNPTATEQYGSVISTMNWQDRGNV

SEQ ID NO: 34486 - protein, 28 aa, Artificial Sequence
  Description of Artificial Sequence: Synthetic peptide
DEEEIATTNPVATEQYGSVSTPQEDGNQ

SEQ ID NO: 34487 - protein, 28 aa, Artificial Sequence
  Description of Artificial Sequence: Synthetic peptide
DEEEIRTTNPDATEQYGSVSTAGQFGEW

SEQ ID NO: 34488 - protein, 28 aa, Artificial Sequence
  Description of Artificial Sequence: Synthetic peptide
DEEEICCTNPEATEQYGSVSTNDQLGNH

SEQ ID NO: 34489 - protein, 30 aa, Artificial Sequence
  Description of Artificial Sequence: Synthetic polypeptide
DEHEIRTTNPVATEQYGTVDCTMNLQRGNI

SEQ ID NO: 34490 - protein, 28 aa, Artificial Sequence
  Description of Artificial Sequence: Synthetic peptide
LEQEIRCTNPVATEQYGSVSTNLENGND

SEQ ID NO: 34491 - protein, 30 aa, Artificial Sequence
  Description of Artificial Sequence: Synthetic polypeptide
DEEEIATTNPVATEQYGDVSCTNLQHGEDR

SEQ ID NO: 34492 - protein, 28 aa, Artificial Sequence
  Description of Artificial Sequence: Synthetic peptide
DEEEIRSVNPCATEQYGSVSSNEQFGNR

SEQ ID NO: 34493 - protein, 28 aa, Artificial Sequence
  Description of Artificial Sequence: Synthetic peptide
MEEEIRATNPVATEQYGWVSTDLQNGNI

SEQ ID NO: 34494 - protein, 28 aa, Artificial Sequence
  Description of Artificial Sequence: Synthetic peptide
VEEEIRTVNPVATEIYGAVSTNLERGNI

SEQ ID NO: 34495 - protein, 31 aa, Artificial Sequence
  Description of Artificial Sequence: Synthetic polypeptide
DEEEIRTTNPVATEQYGSVSTANPQELGNTE

SEQ ID NO: 34496 - protein, 29 aa, Artificial Sequence
  Description of Artificial Sequence: Synthetic peptide
DEEEIRTTNPTATEVYGSVSTNLQQGVPE

SEQ ID NO: 34497 - protein, 30 aa, Artificial Sequence
  Description of Artificial Sequence: Synthetic polypeptide
DEEEIRTTNPVATERYGSVEDFTGLQRGNY

SEQ ID NO: 34498 - protein, 28 aa, Artificial Sequence
  Description of Artificial Sequence: Synthetic peptide
DEEEIRTTNPVATECYGSVSEDLQQGDD

SEQ ID NO: 34499 - protein, 29 aa, Artificial Sequence
  Description of Artificial Sequence: Synthetic peptide
DEEEIRTTNPDATEQYGNVSTNLWSGENQ

SEQ ID NO: 34500 - protein, 31 aa, Artificial Sequence
  Description of Artificial Sequence: Synthetic polypeptide
DEQEIRTTNPVATEQYGSVSTNDQDRNGENF

SEQ ID NO: 34501 - protein, 29 aa, Artificial Sequence
  Description of Artificial Sequence: Synthetic peptide
DEEEIATTNPVATEMYGEVSTMNLQQGDR

SEQ ID NO: 34502 - protein, 28 aa, Artificial Sequence
  Description of Artificial Sequence: Synthetic peptide
NEQEIRTTNPVATEQYGSVSTDDQHGNA

SEQ ID NO: 34503 - protein, 30 aa, Artificial Sequence
  Description of Artificial Sequence: Synthetic polypeptide
DEEEIRTTNPVATEQYGSVDCTDLQVGNDE

SEQ ID NO: 34504 - protein, 28 aa, Artificial Sequence
  Description of Artificial Sequence: Synthetic peptide
DEEEIRTTNPEATEQYGSVSTDDQDGEW

SEQ ID NO: 34505 - protein, 30 aa, Artificial Sequence
  Description of Artificial Sequence: Synthetic polypeptide
DEEEIRTTNPVATEQYGSVSTIELQEDGDW

SEQ ID NO: 34506 - protein, 28 aa, Artificial Sequence
  Description of Artificial Sequence: Synthetic peptide
AEMEIITTNPVATEQYGEVSTNLQRGGA

SEQ ID NO: 34507 - protein, 29 aa, Artificial Sequence
  Description of Artificial Sequence: Synthetic peptide
GEEEIRTVNPVATEQYGSVSTDLQNGNDS

SEQ ID NO: 34508 - protein, 31 aa, Artificial Sequence
  Description of Artificial Sequence: Synthetic polypeptide
DEEEIRTTNPVATEQYGSVSCTMDLQVGNDD

SEQ ID NO: 34509 - protein, 28 aa, Artificial Sequence
  Description of Artificial Sequence: Synthetic peptide
NEEEIRTTNPVATEVYGVVDTNWQRGNG

SEQ ID NO: 34510 - protein, 30 aa, Artificial Sequence
  Description of Artificial Sequence: Synthetic polypeptide
DEEEIRTTNPVCTEQYGCVISTNDQRGNWN

SEQ ID NO: 34511 - protein, 30 aa, Artificial Sequence
  Description of Artificial Sequence: Synthetic polypeptide
DEEEIRTTNPVATEQYGSVSTDLQDQGEDA

SEQ ID NO: 34512 - protein, 33 aa, Artificial Sequence
  Description of Artificial Sequence: Synthetic polypeptide
DEEEIRTTNPVATEQYGSMVNATNLTQRNGNDR

SEQ ID NO: 34513 - protein, 30 aa, Artificial Sequence
  Description of Artificial Sequence: Synthetic polypeptide
DEEEIRTTNPEATEQYGSVSTNPEQRDGDE

SEQ ID NO: 34514 - protein, 30 aa, Artificial Sequence
  Description of Artificial Sequence: Synthetic polypeptide
DEEEIRTTNPVATEQYGDVSCENLQTGNDL

SEQ ID NO: 34515 - protein, 28 aa, Artificial Sequence
  Description of Artificial Sequence: Synthetic peptide
DEEEIRTTNPFATEQYGSVSTPLFDGEP

SEQ ID NO: 34516 - protein, 28 aa, Artificial Sequence
  Description of Artificial Sequence: Synthetic peptide
SEEEIRATNPTATEQYGSVSTNLQQGDF

SEQ ID NO: 34517 - protein, 28 aa, Artificial Sequence
  Description of Artificial Sequence: Synthetic peptide
DEEEIRTTNPVATECYGSVSTNDEQGTQ

SEQ ID NO: 34518 - protein, 31 aa, Artificial Sequence
  Description of Artificial Sequence: Synthetic polypeptide
DEEEIRTTNPVATEQYGSVDSTDLQRGEEDW

SEQ ID NO: 34519 - protein, 28 aa, Artificial Sequence
  Description of Artificial Sequence: Synthetic peptide
DEEEIAQTNPVATEQYGSVSTNPLSGER

SEQ ID NO: 34520 - protein, 30 aa, Artificial Sequence
  Description of Artificial Sequence: Synthetic polypeptide
DEEEIRTTNPVATEQYGFVSTVPLQAGGER

SEQ ID NO: 34521 - protein, 29 aa, Artificial Sequence
  Description of Artificial Sequence: Synthetic peptide
DEQEIATVNPVATEQYGSVSENKLQVGNR

SEQ ID NO: 34522 - protein, 28 aa, Artificial Sequence
  Description of Artificial Sequence: Synthetic peptide
EEEEIRTTNPVATEQYGSVSTILQQMDQ

SEQ ID NO: 34523 - protein, 28 aa, Artificial Sequence
  Description of Artificial Sequence: Synthetic peptide
DEEEIRCTNPVATNQYGSVSTFLDDGNE

SEQ ID NO: 34524 - protein, 29 aa, Artificial Sequence
  Description of Artificial Sequence: Synthetic peptide
DENEIRTTNPVATEPYGDVSNNLQRGNDF

SEQ ID NO: 34525 - protein, 28 aa, Artificial Sequence
  Description of Artificial Sequence: Synthetic peptide
DEEEIRQTNPVATEQYGSAPENLQHGNL

SEQ ID NO: 34526 - protein, 28 aa, Artificial Sequence
  Description of Artificial Sequence: Synthetic peptide
DEEEIRTTNPVATEQYGSVSTDEQIDDG

SEQ ID NO: 34527 - protein, 32 aa, Artificial Sequence
  Description of Artificial Sequence: Synthetic polypeptide
DEEEIRTTNPVATEQYGSVSTNPLEDRGENDF

SEQ ID NO: 34528 - protein, 30 aa, Artificial Sequence
  Description of Artificial Sequence: Synthetic polypeptide
DEEEIRTTNPVATQQYGSVSTDGLNQTENR

SEQ ID NO: 34529 - protein, 30 aa, Artificial Sequence
  Description of Artificial Sequence: Synthetic polypeptide
DEEEIRTTNPEATEQYGSVSTPDPEQRGNN

SEQ ID NO: 34530 - protein, 30 aa, Artificial Sequence
  Description of Artificial Sequence: Synthetic polypeptide
DEEEIRTTNPVATEQYGSVSTEPLQVNGET

SEQ ID NO: 34531 - protein, 31 aa, Artificial Sequence
  Description of Artificial Sequence: Synthetic polypeptide
DEEEIRTTNPDATEQYGSVCSTNLERNGNDQ

SEQ ID NO: 34532 - protein, 32 aa, Artificial Sequence
  Description of Artificial Sequence: Synthetic polypeptide
SEEEIRTTNPTATEQYGSVSTLNGLQRGENTR

SEQ ID NO: 34533 - protein, 28 aa, Artificial Sequence
  Description of Artificial Sequence: Synthetic peptide
DEEEIRTTNPVAMCQYGSVHTGDQPGNR

SEQ ID NO: 34534 - protein, 31 aa, Artificial Sequence
  Description of Artificial Sequence: Synthetic polypeptide
DEEEIRTTNPVATEQYGEVISTNEPQRSGNF

SEQ ID NO: 34535 - protein, 31 aa, Artificial Sequence
  Description of Artificial Sequence: Synthetic polypeptide
DEVEIRTTNPVATEQYGSVSTMNLQIEGDNE

SEQ ID NO: 34536 - protein, 32 aa, Artificial Sequence
  Description of Artificial Sequence: Synthetic polypeptide
DEEEIRTTNPVATEQYGESVTSTNPQQRDLNR

SEQ ID NO: 34537 - protein, 31 aa, Artificial Sequence
  Description of Artificial Sequence: Synthetic polypeptide
DECEIRTTNPVATEVYGSVSVTNLQRDGNDQ

SEQ ID NO: 34538 - protein, 28 aa, Artificial Sequence
  Description of Artificial Sequence: Synthetic peptide
DEEEIRTTNPVAYEQYGVVSWNLQVANY

SEQ ID NO: 34539 - protein, 31 aa, Artificial Sequence
  Description of Artificial Sequence: Synthetic polypeptide
DEEEIRTTNPVATEQYGSVSTCCLQLFGNDN

SEQ ID NO: 34540 - protein, 30 aa, Artificial Sequence
  Description of Artificial Sequence: Synthetic polypeptide
DEQEIRTTNPVATEIYGSVSAMNLEREGNR

SEQ ID NO: 34541 - protein, 29 aa, Artificial Sequence
  Description of Artificial Sequence: Synthetic peptide
DEEEICTTNPVATEQYGSYSLENLQHGNA

SEQ ID NO: 34542 - protein, 32 aa, Artificial Sequence
  Description of Artificial Sequence: Synthetic polypeptide
DEEEIRTTNPVATEQYGSYVSTIDPLPQRGNN

SEQ ID NO: 34543 - protein, 32 aa, Artificial Sequence
  Description of Artificial Sequence: Synthetic polypeptide
DEEEIRQTNPVATEQYGSVSTTNLQVVNGDNR

SEQ ID NO: 34544 - protein, 29 aa, Artificial Sequence
  Description of Artificial Sequence: Synthetic peptide
DDEEISTTNPVATEQWGSVSTNEQIVGNR

SEQ ID NO: 34545 - protein, 28 aa, Artificial Sequence
  Description of Artificial Sequence: Synthetic peptide
REEEIRTTNPVACEQYGCVSTNLERPTR

SEQ ID NO: 34546 - protein, 32 aa, Artificial Sequence
  Description of Artificial Sequence: Synthetic polypeptide
DEEEIRTTNPDATEQYGSVSITGLTQRGDNDR

SEQ ID NO: 34547 - protein, 30 aa, Artificial Sequence
  Description of Artificial Sequence: Synthetic polypeptide
DEEEIRTTNPVATEQYGSVSTEPLQILGDY

SEQ ID NO: 34548 - protein, 31 aa, Artificial Sequence
  Description of Artificial Sequence: Synthetic polypeptide
DEEEIRTTNPVATEQYGSVSTTGLQLGENDV

SEQ ID NO: 34549 - protein, 28 aa, Artificial Sequence
  Description of Artificial Sequence: Synthetic peptide
DEEEIRTTNPVATEVWGIVSTNLEIGTR

SEQ ID NO: 34550 - protein, 30 aa, Artificial Sequence
  Description of Artificial Sequence: Synthetic polypeptide
GEEEIATTNPVATEQYGSVSDTNLQVGENL

SEQ ID NO: 34551 - protein, 30 aa, Artificial Sequence
  Description of Artificial Sequence: Synthetic polypeptide
DEEEIRTTNPVATECYGSVSTNLQQEGEDS

SEQ ID NO: 34552 - protein, 28 aa, Artificial Sequence
  Description of Artificial Sequence: Synthetic peptide
AEEEIAQTNPVATEQYGVVSTNLERGDR

SEQ ID NO: 34553 - protein, 28 aa, Artificial Sequence
  Description of Artificial Sequence: Synthetic peptide
DEEEIRTTNPVATECYGSVDTNEMGGNA

SEQ ID NO: 34554 - protein, 28 aa, Artificial Sequence
  Description of Artificial Sequence: Synthetic peptide
DEEEIRTTNPVAYEQYGGVSTCGQRPNE

SEQ ID NO: 34555 - protein, 28 aa, Artificial Sequence
  Description of Artificial Sequence: Synthetic peptide
DEEEIRTTNPDAYEQYGSVSTNLDDGED

SEQ ID NO: 34556 - protein, 31 aa, Artificial Sequence
  Description of Artificial Sequence: Synthetic polypeptide
DEEEIRTTNPVATEQYGSVSCTANDERGENL

SEQ ID NO: 34557 - protein, 30 aa, Artificial Sequence
  Description of Artificial Sequence: Synthetic polypeptide
DEEEIRTTNPLATEQFGSVSAGNLQEQGNR

SEQ ID NO: 34558 - protein, 32 aa, Artificial Sequence
  Description of Artificial Sequence: Synthetic polypeptide
DEEEIRTTNPVATEQYGSVSETNLEERDGDND

SEQ ID NO: 34559 - protein, 28 aa, Artificial Sequence
  Description of Artificial Sequence: Synthetic peptide
DEEEIATTNPVASEQYGSVSTELEQGNI

SEQ ID NO: 34560 - protein, 33 aa, Artificial Sequence
  Description of Artificial Sequence: Synthetic polypeptide
DEEEIRTTNPVATEQYGSVSITPGPLVQRGNPR

SEQ ID NO: 34561 - protein, 28 aa, Artificial Sequence
  Description of Artificial Sequence: Synthetic peptide
DEEEIRTTNPVATECYGSVSTDLEIGES

SEQ ID NO: 34562 - protein, 28 aa, Artificial Sequence
  Description of Artificial Sequence: Synthetic peptide
DEEEVRCTNPVSTEGYGSVAMNLQRGNR

SEQ ID NO: 34563 - protein, 28 aa, Artificial Sequence
  Description of Artificial Sequence: Synthetic peptide
DEEEISTTNPTATEQYGAVATNLQLGNH

SEQ ID NO: 34564 - protein, 30 aa, Artificial Sequence
  Description of Artificial Sequence: Synthetic polypeptide
DEEEIRATNPVATEQYGSVGMNLQLRGNDA

SEQ ID NO: 34565 - protein, 31 aa, Artificial Sequence
  Description of Artificial Sequence: Synthetic polypeptide
DEEEIRTTNPVATEQYGSWSTNLQDRGEEDS

SEQ ID NO: 34566 - protein, 28 aa, Artificial Sequence
  Description of Artificial Sequence: Synthetic peptide
DEEEIRTTNPTATEQFGGVSTNEQRGDF

SEQ ID NO: 34567 - protein, 28 aa, Artificial Sequence
  Description of Artificial Sequence: Synthetic peptide
DEEEIRTTNPVATEQYGSVETGETYGNP

SEQ ID NO: 34568 - protein, 31 aa, Artificial Sequence
  Description of Artificial Sequence: Synthetic polypeptide
DEEEIKTTNPVATEQYGSVSTNLQIHNGNDD

SEQ ID NO: 34569 - protein, 28 aa, Artificial Sequence
  Description of Artificial Sequence: Synthetic peptide
AEEEIAQTNPVATEQYGSVSTNLEDGND

SEQ ID NO: 34570 - protein, 28 aa, Artificial Sequence
  Description of Artificial Sequence: Synthetic peptide
QEEEIRTTNPEATQQYGSVSTELQDGNS

SEQ ID NO: 34571 - protein, 29 aa, Artificial Sequence
  Description of Artificial Sequence: Synthetic peptide
KEQEIATTNPVATECYGSVSTDLQREGNR

SEQ ID NO: 34572 - protein, 28 aa, Artificial Sequence
  Description of Artificial Sequence: Synthetic peptide
DEEEIRTTNPVATEQYGSVSTPDEEGTL

SEQ ID NO: 34573 - protein, 30 aa, Artificial Sequence
  Description of Artificial Sequence: Synthetic polypeptide
DEEEIRTTNPVATECYGSVSTELQERGEDD

SEQ ID NO: 34574 - protein, 29 aa, Artificial Sequence
  Description of Artificial Sequence: Synthetic peptide
QEPEIRTTNPVATEQYGNVSENLQRGVNV

SEQ ID NO: 34575 - protein, 28 aa, Artificial Sequence
  Description of Artificial Sequence: Synthetic peptide
DEEEIKTTNPVATEFYGSISTILQRGMS

SEQ ID NO: 34576 - protein, 31 aa, Artificial Sequence
  Description of Artificial Sequence: Synthetic polypeptide
REEEIRTTNPVATEQYGSVSSTGLQERGINM

SEQ ID NO: 34577 - protein, 31 aa, Artificial Sequence
  Description of Artificial Sequence: Synthetic polypeptide
DEEEIRTTNPVATEQYGSVSTQDLQQSGNDS

SEQ ID NO: 34578 - protein, 28 aa, Artificial Sequence
  Description of Artificial Sequence: Synthetic peptide
DEEEIRTTNPVATEQYGSVHHNDQDGEP

SEQ ID NO: 34579 - protein, 28 aa, Artificial Sequence
  Description of Artificial Sequence: Synthetic peptide
DEQEIRTTNPVATEQYGSVSEELERENN

SEQ ID NO: 34580 - protein, 30 aa, Artificial Sequence
  Description of Artificial Sequence: Synthetic polypeptide
DEEEIRTTNPVATECYGSYSTNLQTAGDDR

SEQ ID NO: 34581 - protein, 30 aa, Artificial Sequence
  Description of Artificial Sequence: Synthetic polypeptide
NEEEIRTTNPVATECYGSVSETNLQHGENT

SEQ ID NO: 34582 - protein, 30 aa, Artificial Sequence
  Description of Artificial Sequence: Synthetic polypeptide
DEHEIRTTNPVCTEQYGSVSCTMNEQRGNQ

SEQ ID NO: 34583 - protein, 28 aa, Artificial Sequence
  Description of Artificial Sequence: Synthetic peptide
DEEQIRTTNPVATEWYGSVSTNLEEGEQ

SEQ ID NO: 34584 - protein, 28 aa, Artificial Sequence
  Description of Artificial Sequence: Synthetic peptide
DENEIRTTNPVATEQYGSVDTNLEHGEL

SEQ ID NO: 34585 - protein, 28 aa, Artificial Sequence
  Description of Artificial Sequence: Synthetic peptide
AEEEIRTTNPVATEQYGVCSELLQRGGR

SEQ ID NO: 34586 - protein, 28 aa, Artificial Sequence
  Description of Artificial Sequence: Synthetic peptide
NPEEIRTTNPVAWEQYGSVSSNLQRGLD

SEQ ID NO: 34587 - protein, 28 aa, Artificial Sequence
  Description of Artificial Sequence: Synthetic peptide
DEEEIRTTNPEATEQYGAVSYPPQRGND

SEQ ID NO: 34588 - protein, 28 aa, Artificial Sequence
  Description of Artificial Sequence: Synthetic peptide
DEQEIRTTNPVATEQYGSVSTDLEHGEN

SEQ ID NO: 34589 - protein, 31 aa, Artificial Sequence
  Description of Artificial Sequence: Synthetic polypeptide
DECEIRTTNPVCTEQYGSVSVTNWQREGENR

SEQ ID NO: 34590 - protein, 28 aa, Artificial Sequence
  Description of Artificial Sequence: Synthetic peptide
DEFEIVSTNPVATEQYGSVSTNEQGGNF

SEQ ID NO: 34591 - protein, 30 aa, Artificial Sequence
  Description of Artificial Sequence: Synthetic polypeptide
DENEIRTTNPVATEQYGSVSTDLQENGNDM

SEQ ID NO: 34592 - protein, 31 aa, Artificial Sequence
  Description of Artificial Sequence: Synthetic polypeptide
AEEEIRTTNPVATEQYGVVDDTTNGLQRGNR

SEQ ID NO: 34593 - protein, 31 aa, Artificial Sequence
  Description of Artificial Sequence: Synthetic polypeptide
DEEEIRTTNPVATEQYGSVSTDLQESEGENQ

SEQ ID NO: 34594 - protein, 31 aa, Artificial Sequence
  Description of Artificial Sequence: Synthetic polypeptide
DEEEIRTTNPVATEVYGSVSCTNLETYGNDR

SEQ ID NO: 34595 - protein, 29 aa, Artificial Sequence
  Description of Artificial Sequence: Synthetic peptide
DEQEIRTTNPVAYEIYGSVAANNLQRGNR

SEQ ID NO: 34596 - protein, 30 aa, Artificial Sequence
  Description of Artificial Sequence: Synthetic polypeptide
DEEEIRTTNPVATEQYGCSVSTNPLHIENM

SEQ ID NO: 34597 - protein, 32 aa, Artificial Sequence
  Description of Artificial Sequence: Synthetic polypeptide
DEEEIRTTNPVATEQYGSVSTGNEQDREGDNE

SEQ ID NO: 34598 - protein, 33 aa, Artificial Sequence
  Description of Artificial Sequence: Synthetic polypeptide
DEEEIRTTNPVATEQYGSVSTANEQEREGDNTR

SEQ ID NO: 34599 - protein, 29 aa, Artificial Sequence
  Description of Artificial Sequence: Synthetic peptide
DEEEISATNPVATEQYGSVSTDLQENGNT

SEQ ID NO: 34600 - protein, 29 aa, Artificial Sequence
  Description of Artificial Sequence: Synthetic peptide
YEEEIRTTNPVATEQYGSVSETLQVFGNA

SEQ ID NO: 34601 - protein, 31 aa, Artificial Sequence
  Description of Artificial Sequence: Synthetic polypeptide
DEEEIRTTNPEATEQYGSVSITVNLQREGTI

SEQ ID NO: 34602 - protein, 29 aa, Artificial Sequence
  Description of Artificial Sequence: Synthetic peptide
DEEEIRTTNPVATECYGGVSTELQLKGNL

SEQ ID NO: 34603 - protein, 30 aa, Artificial Sequence
  Description of Artificial Sequence: Synthetic polypeptide
DEEEIRTTNPVATEVYGSVCSTDLERGDER

SEQ ID NO: 34604 - protein, 28 aa, Artificial Sequence
  Description of Artificial Sequence: Synthetic peptide
DEEEVRTVNPCATEQYGSVSTNEQDGNM

SEQ ID NO: 34605 - protein, 28 aa, Artificial Sequence
  Description of Artificial Sequence: Synthetic peptide
DEEEIRTTNPDATEQYGSVSTELDNGDH

SEQ ID NO: 34606 - protein, 28 aa, Artificial Sequence
  Description of Artificial Sequence: Synthetic peptide
DEEEIRTTNPCATEIYGSVSENIQFGNP

SEQ ID NO: 34607 - protein, 28 aa, Artificial Sequence
  Description of Artificial Sequence: Synthetic peptide
DEEEIRTTNPVATEQYGSVSTCEEAGEV

SEQ ID NO: 34608 - protein, 31 aa, Artificial Sequence
  Description of Artificial Sequence: Synthetic polypeptide
DEEEIRTTNPVATEQYGHSVDSTNLIEAGNY

SEQ ID NO: 34609 - protein, 28 aa, Artificial Sequence
  Description of Artificial Sequence: Synthetic peptide
DEEEIRTTNPEATEQYGCVANNLNRGDR

SEQ ID NO: 34610 - protein, 31 aa, Artificial Sequence
  Description of Artificial Sequence: Synthetic polypeptide
DEEEIRTTNPVATEQYGSVSTTNLEDEGNDL

SEQ ID NO: 34611 - protein, 29 aa, Artificial Sequence
  Description of Artificial Sequence: Synthetic peptide
DEHEIRTTNPVSTEQYGSVFTMELQRGNS

SEQ ID NO: 34612 - protein, 28 aa, Artificial Sequence
  Description of Artificial Sequence: Synthetic peptide
DEECIRTTNPVATYVYGSVSTNGQVGNG

SEQ ID NO: 34613 - protein, 30 aa, Artificial Sequence
  Description of Artificial Sequence: Synthetic polypeptide
DEEEIRTTNPVATEQYGSVDYNLQLNGDDR

SEQ ID NO: 34614 - protein, 28 aa, Artificial Sequence
  Description of Artificial Sequence: Synthetic peptide
FEGEIRCTNPVATETYGSASTNLQRGNS

SEQ ID NO: 34615 - protein, 28 aa, Artificial Sequence
  Description of Artificial Sequence: Synthetic peptide
DPEEIRTTNPVATECYGSVSTNDDPGER

SEQ ID NO: 34616 - protein, 31 aa, Artificial Sequence
  Description of Artificial Sequence: Synthetic polypeptide
DEEEIRTTNPVASEQYGVVSETDLQRKGENR

SEQ ID NO: 34617 - protein, 28 aa, Artificial Sequence
  Description of Artificial Sequence: Synthetic peptide
MEQEIRTTNPVATEQYGSVSEDLQQGNH

SEQ ID NO: 34618 - protein, 31 aa, Artificial Sequence
  Description of Artificial Sequence: Synthetic polypeptide
DEEEIRTTNPVATEQYGTSVSTALQVGGNED

SEQ ID NO: 34619 - protein, 28 aa, Artificial Sequence
  Description of Artificial Sequence: Synthetic peptide
AEQEIRTTNPVASEAYGSTSTNLQQGNR

SEQ ID NO: 34620 - protein, 30 aa, Artificial Sequence
  Description of Artificial Sequence: Synthetic polypeptide
DEEEIRTTNPVATEQYGDVSTELQCVGNDC

SEQ ID NO: 34621 - protein, 30 aa, Artificial Sequence
  Description of Artificial Sequence: Synthetic polypeptide
DEEEIATTNPVATEQYGSVSTDLQDRGEDN

SEQ ID NO: 34622 - protein, 28 aa, Artificial Sequence
  Description of Artificial Sequence: Synthetic peptide
MEEEIATTNPVATEQYGSVSEDLQQGNT

SEQ ID NO: 34623 - protein, 28 aa, Artificial Sequence
  Description of Artificial Sequence: Synthetic peptide
DEVEISTTNPAATEQYGCVSTNLQFGNS

SEQ ID NO: 34624 - protein, 31 aa, Artificial Sequence
  Description of Artificial Sequence: Synthetic polypeptide
DEEEIRTTNPVATEQYGSYVTSVENLNRGNH

SEQ ID NO: 34625 - protein, 28 aa, Artificial Sequence
  Description of Artificial Sequence: Synthetic peptide
DEEEIRTTNPLATQQYGSVSTDDQNGNG

SEQ ID NO: 34626 - protein, 29 aa, Artificial Sequence
  Description of Artificial Sequence: Synthetic peptide
DEQEIRTTNPVATEQYGDVSENLQHENDR

SEQ ID NO: 34627 - protein, 29 aa, Artificial Sequence
  Description of Artificial Sequence: Synthetic peptide
DEEEIRTVNPVAWETYGSVSAGELQRGNR

SEQ ID NO: 34628 - protein, 30 aa, Artificial Sequence
  Description of Artificial Sequence: Synthetic polypeptide
DEQEIRTTNPVATEQYGSVDSTPLETGNDR

SEQ ID NO: 34629 - protein, 32 aa, Artificial Sequence
  Description of Artificial Sequence: Synthetic polypeptide
DEEEIRTTNPVATEQYGSLVSTNLVQRDGEES

SEQ ID NO: 34630 - protein, 32 aa, Artificial Sequence
  Description of Artificial Sequence: Synthetic polypeptide
DEEEIRTTNPVATEQYGSVDSTDLQDRGDNPM

SEQ ID NO: 34631 - protein, 30 aa, Artificial Sequence
  Description of Artificial Sequence: Synthetic polypeptide
DEVEIRCTNPCATEQYGSVSTNLQQEGNDR

SEQ ID NO: 34632 - protein, 28 aa, Artificial Sequence
  Description of Artificial Sequence: Synthetic peptide
DEEEIRTTNPVCTEHYGSVSTNVQFGLS

SEQ ID NO: 34633 - protein, 30 aa, Artificial Sequence
  Description of Artificial Sequence: Synthetic polypeptide
DEEEIRTTNPCSTEQYGNVATTNLQRGNLR

SEQ ID NO: 34634 - protein, 28 aa, Artificial Sequence
  Description of Artificial Sequence: Synthetic peptide
DESEVRCTNPVATEQYGAVSMNLQRGTR

SEQ ID NO: 34635 - protein, 28 aa, Artificial Sequence
  Description of Artificial Sequence: Synthetic peptide
MENEIRTTNPVATECYGSVSTNLQSGDM

SEQ ID NO: 34636 - protein, 30 aa, Artificial Sequence
  Description of Artificial Sequence: Synthetic polypeptide
DEEEIRTTNPVATEQYGSVSTDLQEQGEDN

SEQ ID NO: 34637 - protein, 28 aa, Artificial Sequence
  Description of Artificial Sequence: Synthetic peptide
VEDEIRTTNPVASEQYGSVSTNLMRGTI

SEQ ID NO: 34638 - protein, 32 aa, Artificial Sequence
  Description of Artificial Sequence: Synthetic polypeptide
DEEEIRTTNPVATEQYGSVDTPNEVQIRGNPR

SEQ ID NO: 34639 - protein, 32 aa, Artificial Sequence
  Description of Artificial Sequence: Synthetic polypeptide
DEEEIRTTNPVATEQYGSVSTNLQDPDGENDH

SEQ ID NO: 34640 - protein, 28 aa, Artificial Sequence
  Description of Artificial Sequence: Synthetic peptide
DEEEIRSTNPVATEQYGEVSTCEQRGEQ

SEQ ID NO: 34641 - protein, 29 aa, Artificial Sequence
  Description of Artificial Sequence: Synthetic peptide
DEEEIRTTNPFATEQYGSVSTPGIEGVNR

SEQ ID NO: 34642 - protein, 32 aa, Artificial Sequence
  Description of Artificial Sequence: Synthetic polypeptide
DEEEIRTTNPVATEQYGSVCSTCNLQHGVNDN

SEQ ID NO: 34643 - protein, 29 aa, Artificial Sequence
  Description of Artificial Sequence: Synthetic peptide
DEEEIATTNPVATECYGSVSTDLQIHGNA

SEQ ID NO: 34644 - protein, 28 aa, Artificial Sequence
  Description of Artificial Sequence: Synthetic peptide
QEEEIRQTNPVATEGYGEVSTVLQHGNR

SEQ ID NO: 34645 - protein, 28 aa, Artificial Sequence
  Description of Artificial Sequence: Synthetic peptide
WEEEIRTTNPVATEQYGSVSTPPQMGDI

SEQ ID NO: 34646 - protein, 28 aa, Artificial Sequence
  Description of Artificial Sequence: Synthetic peptide
DENEIRTTNPVATEQWGSVSENLMVGNS

SEQ ID NO: 34647 - protein, 28 aa, Artificial Sequence
  Description of Artificial Sequence: Synthetic peptide
DEQEISTTNPVATEQYGSVDTNLQEGET

SEQ ID NO: 34648 - protein, 31 aa, Artificial Sequence
  Description of Artificial Sequence: Synthetic polypeptide
DEEEIRTTNPFATEQYGSVSTTNGLEQGNDR

SEQ ID NO: 34649 - protein, 30 aa, Artificial Sequence
  Description of Artificial Sequence: Synthetic polypeptide
DEEEIRTTNPVATEQYGSVSTIELQHDGEI

SEQ ID NO: 34650 - protein, 30 aa, Artificial Sequence
  Description of Artificial Sequence: Synthetic polypeptide
DEEEIRTTNPVATEQYGSWCSTNLNEGNEN

SEQ ID NO: 34651 - protein, 31 aa, Artificial Sequence
  Description of Artificial Sequence: Synthetic polypeptide
DEEEIRTTNPVATEQYGSVSTNLQEIEGEDF

SEQ ID NO: 34652 - protein, 29 aa, Artificial Sequence
  Description of Artificial Sequence: Synthetic peptide
DEEEIRTTNPVATEMYGSVSTDLQETGEM

SEQ ID NO: 34653 - protein, 31 aa, Artificial Sequence
  Description of Artificial Sequence: Synthetic polypeptide
DEEEIRTTNPVATEQYGSVSCTMDLCRGNDA

SEQ ID NO: 34654 - protein, 31 aa, Artificial Sequence
  Description of Artificial Sequence: Synthetic polypeptide
DEEEIRTTNPVATEQYGSVSDTELEERGNEG

SEQ ID NO: 34655 - protein, 29 aa, Artificial Sequence
  Description of Artificial Sequence: Synthetic peptide
DEEEIRTTNPVATELWGSVSTNEQMQGNS

SEQ ID NO: 34656 - protein, 31 aa, Artificial Sequence
  Description of Artificial Sequence: Synthetic polypeptide
DEEEIRTTNPVATEQYGSVSTLNNLYLIGNH

SEQ ID NO: 34657 - protein, 30 aa, Artificial Sequence
  Description of Artificial Sequence: Synthetic polypeptide
DEEEIRTTNPVATEQYGSVSTDLQEIGEDL

SEQ ID NO: 34658 - protein, 30 aa, Artificial Sequence
  Description of Artificial Sequence: Synthetic polypeptide
DEEEIRTTNPVATEQYGSVSCTEDCDQGNR

SEQ ID NO: 34659 - protein, 28 aa, Artificial Sequence
  Description of Artificial Sequence: Synthetic peptide
DENEIRTTNPVATECYGSVSTCEQREER

SEQ ID NO: 34660 - protein, 29 aa, Artificial Sequence
  Description of Artificial Sequence: Synthetic peptide
DEQEIAATNPVATEQYGSVSTNLQSGENN

SEQ ID NO: 34661 - protein, 31 aa, Artificial Sequence
  Description of Artificial Sequence: Synthetic polypeptide
DEEEIATTNPCATEQYGSVSENLQQDRGNDR

SEQ ID NO: 34662 - protein, 31 aa, Artificial Sequence
  Description of Artificial Sequence: Synthetic polypeptide
DEEEIRTTNPVATEQYGSVSTANEQEIGNTN

SEQ ID NO: 34663 - protein, 28 aa, Artificial Sequence
  Description of Artificial Sequence: Synthetic peptide
SEEEIRTTNPEATEIYGSVSTNWQQGLR

SEQ ID NO: 34664 - protein, 28 aa, Artificial Sequence
  Description of Artificial Sequence: Synthetic peptide
DEEEIRTTNPFATEQYGSVSTGDDPGND

SEQ ID NO: 34665 - protein, 30 aa, Artificial Sequence
  Description of Artificial Sequence: Synthetic polypeptide
DEEEIRTTNPVATEQYGSVSTDLDIDGNDS

SEQ ID NO: 34666 - protein, 30 aa, Artificial Sequence
  Description of Artificial Sequence: Synthetic polypeptide
DEEEIRTTNPVATEQYGSVPFTCNLQREDF

SEQ ID NO: 34667 - protein, 31 aa, Artificial Sequence
  Description of Artificial Sequence: Synthetic polypeptide
MEEEIRTTNPVATEQYGSVSTNLQEIEGNDF

SEQ ID NO: 34668 - protein, 29 aa, Artificial Sequence
  Description of Artificial Sequence: Synthetic peptide
DEEEISTTNPVATEQYGSVSCNWQFGNTH

SEQ ID NO: 34669 - protein, 31 aa, Artificial Sequence
  Description of Artificial Sequence: Synthetic polypeptide
DEEEIRTTNPVATEQYGSVSTMEDQETGNDR

SEQ ID NO: 34670 - protein, 28 aa, Artificial Sequence
  Description of Artificial Sequence: Synthetic peptide
DEAEIRTTNPVSTEIYGSTSTALQLGNR

SEQ ID NO: 34671 - protein, 29 aa, Artificial Sequence
  Description of Artificial Sequence: Synthetic peptide
DEEEIRSTNPVCTEQYGSVATVDEQRGNR

SEQ ID NO: 34672 - protein, 28 aa, Artificial Sequence
  Description of Artificial Sequence: Synthetic peptide
DEEEIHTTNPCATEQYGSVGSNLQPGND

SEQ ID NO: 34673 - protein, 32 aa, Artificial Sequence
  Description of Artificial Sequence: Synthetic polypeptide
DEEEIRTTNPVATEQYGSVSTNLEDDNGENDR

SEQ ID NO: 34674 - protein, 28 aa, Artificial Sequence
  Description of Artificial Sequence: Synthetic peptide
NEEEIRTTNPVATEIYGWVSTALERGNV

SEQ ID NO: 34675 - protein, 28 aa, Artificial Sequence
  Description of Artificial Sequence: Synthetic peptide
DEEEIRTTNPFATEQYGWVSTNLQMEET

SEQ ID NO: 34676 - protein, 31 aa, Artificial Sequence
  Description of Artificial Sequence: Synthetic polypeptide
DEEEIRTTNPVATEQYGSVSTNLQEHEGEDF

SEQ ID NO: 34677 - protein, 28 aa, Artificial Sequence
  Description of Artificial Sequence: Synthetic peptide
DEQEIRTTNPVATEEYGSVSENLQHEER

SEQ ID NO: 34678 - protein, 30 aa, Artificial Sequence
  Description of Artificial Sequence: Synthetic polypeptide
DEEEIRTTNPIATEQYGAVSAENLQRGNYI

SEQ ID NO: 34679 - protein, 30 aa, Artificial Sequence
  Description of Artificial Sequence: Synthetic polypeptide
DENEIRTTNPVCTEQYGSVDCTMNLQHGNR

SEQ ID NO: 34680 - protein, 30 aa, Artificial Sequence
  Description of Artificial Sequence: Synthetic polypeptide
DEEEIRTTNPVATEQYGSVETLNEQIGNEF

SEQ ID NO: 34681 - protein, 28 aa, Artificial Sequence
  Description of Artificial Sequence: Synthetic peptide
DEEPIRTTNPVATEQYGNVSTALQRITQ

SEQ ID NO: 34682 - protein, 28 aa, Artificial Sequence
  Description of Artificial Sequence: Synthetic peptide
DENEIAQTNPVATEQYGSVSEDLQRGNA

SEQ ID NO: 34683 - protein, 28 aa, Artificial Sequence
  Description of Artificial Sequence: Synthetic peptide
DEEEIRSVNPVATEQYGTVSTNQIYGNR

SEQ ID NO: 34684 - protein, 28 aa, Artificial Sequence
  Description of Artificial Sequence: Synthetic peptide
DEEEIAATNPVATEMYGSASTVLQHGNR

SEQ ID NO: 34685 - protein, 28 aa, Artificial Sequence
  Description of Artificial Sequence: Synthetic peptide
DEEEIAATNPVATEQYGSVSENEQRGTF

SEQ ID NO: 34686 - protein, 28 aa, Artificial Sequence
  Description of Artificial Sequence: Synthetic peptide
NPEEIRTTNPVATEQYGSVWTNDQPGND

SEQ ID NO: 34687 - protein, 28 aa, Artificial Sequence
  Description of Artificial Sequence: Synthetic peptide
DEEEIRTTNPVAYQQYGSNSTNKQDGNP

SEQ ID NO: 34688 - protein, 29 aa, Artificial Sequence
  Description of Artificial Sequence: Synthetic peptide
DEEEISTTNPVASEQYGWVSTNLQVGEDR

SEQ ID NO: 34689 - protein, 30 aa, Artificial Sequence
  Description of Artificial Sequence: Synthetic polypeptide
DEEEIATTNPVATEQYGSVSTGLEDRGNDI

SEQ ID NO: 34690 - protein, 28 aa, Artificial Sequence
  Description of Artificial Sequence: Synthetic peptide
DENELRPTNPVATEAYGSVSENLQRGTR

SEQ ID NO: 34691 - protein, 28 aa, Artificial Sequence
  Description of Artificial Sequence: Synthetic peptide
DENEIRTTNPVATECYGDVSENLQRGEM

SEQ ID NO: 34692 - protein, 28 aa, Artificial Sequence
  Description of Artificial Sequence: Synthetic peptide
DEEEIRTTNPEATEQYGSVSTDDQAGEY

SEQ ID NO: 34693 - protein, 29 aa, Artificial Sequence
  Description of Artificial Sequence: Synthetic peptide
DEECIRTTNPVAEEQYGQVSTINVQRGNN

SEQ ID NO: 34694 - protein, 29 aa, Artificial Sequence
  Description of Artificial Sequence: Synthetic peptide
DEEEIRTTNPVATECYGSVSTELQYGDDQ

SEQ ID NO: 34695 - protein, 28 aa, Artificial Sequence
  Description of Artificial Sequence: Synthetic peptide
SEEEIRTTNPTATEQYGSVSTNEQNGTQ

SEQ ID NO: 34696 - protein, 29 aa, Artificial Sequence
  Description of Artificial Sequence: Synthetic peptide
DEQEISTTNPVATEQYGSVSTTLMIRGNA

SEQ ID NO: 34697 - protein, 28 aa, Artificial Sequence
  Description of Artificial Sequence: Synthetic peptide
DEEEIRTTNPVATEWWGSVSTNEQIGTA

SEQ ID NO: 34698 - protein, 31 aa, Artificial Sequence
  Description of Artificial Sequence: Synthetic polypeptide
DEEEIRTTNPFATEQYGSVSITNDQAGVNPR

SEQ ID NO: 34699 - protein, 28 aa, Artificial Sequence
  Description of Artificial Sequence: Synthetic peptide
QEQEIVTTNPVATEQYGVVSTNLQVGNI

SEQ ID NO: 34700 - protein, 30 aa, Artificial Sequence
  Description of Artificial Sequence: Synthetic polypeptide
DEEEIRTTNPVATEQYGSVSATALQSEGES

SEQ ID NO: 34701 - protein, 29 aa, Artificial Sequence
  Description of Artificial Sequence: Synthetic peptide
DEEEIRCTNPVATEQYGSVSTNLEIVGDA

SEQ ID NO: 34702 - protein, 31 aa, Artificial Sequence
  Description of Artificial Sequence: Synthetic polypeptide
DENEIRTTNPVATEQYGSCSTNLQLRGEEDR

SEQ ID NO: 34703 - protein, 30 aa, Artificial Sequence
  Description of Artificial Sequence: Synthetic polypeptide
DEEEIRTTNPVATEQYGSVSTQNLDEMENT

SEQ ID NO: 34704 - protein, 31 aa, Artificial Sequence
  Description of Artificial Sequence: Synthetic polypeptide
DEEEIRTTNPVATEQFGGVSTNLQEIGENTR

SEQ ID NO: 34705 - protein, 30 aa, Artificial Sequence
  Description of Artificial Sequence: Synthetic polypeptide
DEEEIATTNPVATEQYGVVSTNLQDAGNDI

SEQ ID NO: 34706 - protein, 32 aa, Artificial Sequence
  Description of Artificial Sequence: Synthetic polypeptide
DEEEIRTTNPVATEQYGSVDSDTGPPLDRGNR

SEQ ID NO: 34707 - protein, 28 aa, Artificial Sequence
  Description of Artificial Sequence: Synthetic peptide
DEEEITTVNPCATEHYGSVSCNLQRGNL

SEQ ID NO: 34708 - protein, 28 aa, Artificial Sequence
  Description of Artificial Sequence: Synthetic peptide
SEEEIRTTNPVATELYGIVSTNEQGGNF

SEQ ID NO: 34709 - protein, 28 aa, Artificial Sequence
  Description of Artificial Sequence: Synthetic peptide
DEQEIRTTNPVATEWYGSVSENLMLGNF

SEQ ID NO: 34710 - protein, 28 aa, Artificial Sequence
  Description of Artificial Sequence: Synthetic peptide
DEEEIRTTNPVATEQYGSVETPEQTGEL

SEQ ID NO: 34711 - protein, 28 aa, Artificial Sequence
  Description of Artificial Sequence: Synthetic peptide
DEEEIAQTNPVATEQYGSVGENLQHGQR

SEQ ID NO: 34712 - protein, 28 aa, Artificial Sequence
  Description of Artificial Sequence: Synthetic peptide
DEEEIRTTNPVATEQYGVVSTDLETGEN

SEQ ID NO: 34713 - protein, 28 aa, Artificial Sequence
  Description of Artificial Sequence: Synthetic peptide
AEEEISTVNPVASEMYGVVSTNLQRGNR

SEQ ID NO: 34714 - protein, 31 aa, Artificial Sequence
  Description of Artificial Sequence: Synthetic polypeptide
DEEEIRTTNPVATEQYGNVPSTNNLQLDGNW

SEQ ID NO: 34715 - protein, 31 aa, Artificial Sequence
  Description of Artificial Sequence: Synthetic polypeptide
DEEEIRTTNPVATEQYGSVDTNLVQNGEEER

SEQ ID NO: 34716 - protein, 29 aa, Artificial Sequence
  Description of Artificial Sequence: Synthetic peptide
DEMEIRCTNPCATEQYGSVGTNLQRGNDA

SEQ ID NO: 34717 - protein, 32 aa, Artificial Sequence
  Description of Artificial Sequence: Synthetic polypeptide
AEEEIRTTNPVATEQYGVVSATNLQLRNGENR

SEQ ID NO: 34718 - protein, 30 aa, Artificial Sequence
  Description of Artificial Sequence: Synthetic polypeptide
DEEEIRTTNPVATEQYGSVSCTDLQCGDED

SEQ ID NO: 34719 - protein, 28 aa, Artificial Sequence
  Description of Artificial Sequence: Synthetic peptide
DEEMIRTTNPVAMEQWGSVHTNDQPGNR

SEQ ID NO: 34720 - protein, 30 aa, Artificial Sequence
  Description of Artificial Sequence: Synthetic polypeptide
DEAEIRTTNPVATEQYGSASTNLEDNGNDR

SEQ ID NO: 34721 - protein, 29 aa, Artificial Sequence
  Description of Artificial Sequence: Synthetic peptide
DEEEIRTTNPCSTEQYGSTATNLQEGDNR

SEQ ID NO: 34722 - protein, 28 aa, Artificial Sequence
  Description of Artificial Sequence: Synthetic peptide
DEEEIATTNPFATEQYGDVSTNQQRGED

SEQ ID NO: 34723 - protein, 30 aa, Artificial Sequence
  Description of Artificial Sequence: Synthetic polypeptide
DEEEIRTTNPVATEQYGSVSTNLEELGEEL

SEQ ID NO: 34724 - protein, 31 aa, Artificial Sequence
  Description of Artificial Sequence: Synthetic polypeptide
DEEEIRTTNPVATEQYGSVSTNEQLLEGDNQ

SEQ ID NO: 34725 - protein, 31 aa, Artificial Sequence
  Description of Artificial Sequence: Synthetic polypeptide
DEEEIRTTNPVATEQYGSVSDTCQIREGENR

SEQ ID NO: 34726 - protein, 32 aa, Artificial Sequence
  Description of Artificial Sequence: Synthetic polypeptide
DEEEIRTTNPTATEQYGSVSTMNLQLNEGDNR

SEQ ID NO: 34727 - protein, 30 aa, Artificial Sequence
  Description of Artificial Sequence: Synthetic polypeptide
DEECIRTTNPVAYEQYGSVSMNLQEREGNG

SEQ ID NO: 34728 - protein, 28 aa, Artificial Sequence
  Description of Artificial Sequence: Synthetic peptide
DEEEIRSTNPCATEQYGNVSTNPDWGNR

SEQ ID NO: 34729 - protein, 31 aa, Artificial Sequence
  Description of Artificial Sequence: Synthetic polypeptide
DEEEIRTTNPVATEQYGSVSCTMELQTGNDV

SEQ ID NO: 34730 - protein, 30 aa, Artificial Sequence
  Description of Artificial Sequence: Synthetic polypeptide
DEQEIATTNPVATEQYGSVDENLQQRGNDR

SEQ ID NO: 34731 - protein, 31 aa, Artificial Sequence
  Description of Artificial Sequence: Synthetic polypeptide
DEEEIRTTNPVATEQYGSVSTNLQELKGEDC

SEQ ID NO: 34732 - protein, 28 aa, Artificial Sequence
  Description of Artificial Sequence: Synthetic peptide
DEEPTRTTNPVATEQYGDVSTNIQGGQR

SEQ ID NO: 34733 - protein, 28 aa, Artificial Sequence
  Description of Artificial Sequence: Synthetic peptide
DEEEIRTTNPVATEQYGDVSENLQHEEM

SEQ ID NO: 34734 - protein, 30 aa, Artificial Sequence
  Description of Artificial Sequence: Synthetic polypeptide
DEEEIRTTNPVATEMYGSSASTEALYRGNR

SEQ ID NO: 34735 - protein, 28 aa, Artificial Sequence
  Description of Artificial Sequence: Synthetic peptide
DDCEITTTNPVATEQYGSVSTNWQRLNQ

SEQ ID NO: 34736 - protein, 28 aa, Artificial Sequence
  Description of Artificial Sequence: Synthetic peptide
DENEIRTTNPVATEQWGSVSTNDEQGDR

SEQ ID NO: 34737 - protein, 30 aa, Artificial Sequence
  Description of Artificial Sequence: Synthetic polypeptide
DEEEIRTTNPVATEQYGEVSTMNLQIGDTA

SEQ ID NO: 34738 - protein, 28 aa, Artificial Sequence
  Description of Artificial Sequence: Synthetic peptide
MEEEISTCNPVATEQYGSVSENLQFGDR

SEQ ID NO: 34739 - protein, 28 aa, Artificial Sequence
  Description of Artificial Sequence: Synthetic peptide
VEAEIAQTNPVATEHYGGVSTNLQRGNR

SEQ ID NO: 34740 - protein, 28 aa, Artificial Sequence
  Description of Artificial Sequence: Synthetic peptide
DEEEIRTTNPVATEIYGSYSTNDEGGNW

SEQ ID NO: 34741 - protein, 29 aa, Artificial Sequence
  Description of Artificial Sequence: Synthetic peptide
MENEIRTTNPVATEQYGSVSTNLQNGEDS

SEQ ID NO: 34742 - protein, 28 aa, Artificial Sequence
  Description of Artificial Sequence: Synthetic peptide
DEEEIRTTNPFATEQYGSVDTGELRGNE

SEQ ID NO: 34743 - protein, 28 aa, Artificial Sequence
  Description of Artificial Sequence: Synthetic peptide
DEIEIRATNPVATEQYGSVSMIIQRGER

SEQ ID NO: 34744 - protein, 32 aa, Artificial Sequence
  Description of Artificial Sequence: Synthetic polypeptide
DEEEIRTTNPVATEQYGSVSATNLQEDNGNDT

SEQ ID NO: 34745 - protein, 28 aa, Artificial Sequence
  Description of Artificial Sequence: Synthetic peptide
DEEEIRTTNPVATEQYGSVSQEDEREMR

SEQ ID NO: 34746 - protein, 28 aa, Artificial Sequence
  Description of Artificial Sequence: Synthetic peptide
DEEEIVTTNPVATEIYGSTSTNLQHGED

SEQ ID NO: 34747 - protein, 29 aa, Artificial Sequence
  Description of Artificial Sequence: Synthetic peptide
DEEEIRTVNPVATEQYGIVSTELQEQGNH

SEQ ID NO: 34748 - protein, 28 aa, Artificial Sequence
  Description of Artificial Sequence: Synthetic peptide
MEEEIRTTNPVATECYGVVSTNLQAGDI

SEQ ID NO: 34749 - protein, 28 aa, Artificial Sequence
  Description of Artificial Sequence: Synthetic peptide
FEEEIRSTNPVATEQYGTVSDTLQRGTR

SEQ ID NO: 34750 - protein, 32 aa, Artificial Sequence
  Description of Artificial Sequence: Synthetic polypeptide
DEEMIRTTNPVATEFYGSVSCTNGLQRNGDNR

SEQ ID NO: 34751 - protein, 28 aa, Artificial Sequence
  Description of Artificial Sequence: Synthetic peptide
DEEEIRTTNPVATEQYGSVSEDLDTGEM

SEQ ID NO: 34752 - protein, 29 aa, Artificial Sequence
  Description of Artificial Sequence: Synthetic peptide
DELEINTTNPVATEQYGSVSTNLQGMENM

SEQ ID NO: 34753 - protein, 30 aa, Artificial Sequence
  Description of Artificial Sequence: Synthetic polypeptide
DEQEIRTTNPVCTEQYGSVDCTNLQHEGNR

SEQ ID NO: 34754 - protein, 29 aa, Artificial Sequence
  Description of Artificial Sequence: Synthetic peptide
MENEIRTTNPVATEQYGSVSTDLQNEGNM

SEQ ID NO: 34755 - protein, 31 aa, Artificial Sequence
  Description of Artificial Sequence: Synthetic polypeptide
DEEEIRTTNPVATEQYGSYVSTMNLVERGET

SEQ ID NO: 34756 - protein, 30 aa, Artificial Sequence
  Description of Artificial Sequence: Synthetic polypeptide
DEEEIRTTNPVATEQYGSVSTDLQEQGEDM

SEQ ID NO: 34757 - protein, 28 aa, Artificial Sequence
  Description of Artificial Sequence: Synthetic peptide
KEEEIRATNPVATECYGVVSTDLQLGNR

SEQ ID NO: 34758 - protein, 30 aa, Artificial Sequence
  Description of Artificial Sequence: Synthetic polypeptide
DEEEIGTTNPVATEVYGSVSDGNWQDRGNR

SEQ ID NO: 34759 - protein, 28 aa, Artificial Sequence
  Description of Artificial Sequence: Synthetic peptide
DDEDIRTTNPVATEQYGKVSTNHQRVNL

SEQ ID NO: 34760 - protein, 30 aa, Artificial Sequence
  Description of Artificial Sequence: Synthetic polypeptide
DEEEIRTTNPFATEQYGSVTDTNLQARGDH

SEQ ID NO: 34761 - protein, 29 aa, Artificial Sequence
  Description of Artificial Sequence: Synthetic peptide
DEEEIATTNPVATEQYGSVSTDLQYKGED

SEQ ID NO: 34762 - protein, 28 aa, Artificial Sequence
  Description of Artificial Sequence: Synthetic peptide
DEEEIRTTNPTATEMYGSVSTNPQIGDF

SEQ ID NO: 34763 - protein, 32 aa, Artificial Sequence
  Description of Artificial Sequence: Synthetic polypeptide
DEEEIRTTNPVATEQYGSVSATNLQLVNGNDD

SEQ ID NO: 34764 - protein, 28 aa, Artificial Sequence
  Description of Artificial Sequence: Synthetic peptide
HEEEIRTTNPVATECYGGVSMNLQFGNE

SEQ ID NO: 34765 - protein, 31 aa, Artificial Sequence
  Description of Artificial Sequence: Synthetic polypeptide
DEEEIRTTNPVATEQYGSVDCTMDLQVGNDR

SEQ ID NO: 34766 - protein, 29 aa, Artificial Sequence
  Description of Artificial Sequence: Synthetic peptide
DEAEIRTTNPIATEQFGSVSEIVLQRGNR

SEQ ID NO: 34767 - protein, 32 aa, Artificial Sequence
  Description of Artificial Sequence: Synthetic polypeptide
DEEEIRTTNPVATEQYGSVESTNLEDPGDNDR

SEQ ID NO: 34768 - protein, 30 aa, Artificial Sequence
  Description of Artificial Sequence: Synthetic polypeptide
DEEEIRATNPVATECYGVVSTNLQLEGNDR

SEQ ID NO: 34769 - protein, 31 aa, Artificial Sequence
  Description of Artificial Sequence: Synthetic polypeptide
DEEEIRTTNPVATECYGSVSTNLQIINGNDT

SEQ ID NO: 34770 - protein, 28 aa, Artificial Sequence
  Description of Artificial Sequence: Synthetic peptide
DEEEIRATNPVASENYGVVAMNLQRGNR

SEQ ID NO: 34771 - protein, 29 aa, Artificial Sequence
  Description of Artificial Sequence: Synthetic peptide
DEEEIRCTNPVSTEQYGDVSTNGTRGNPR

SEQ ID NO: 34772 - protein, 30 aa, Artificial Sequence
  Description of Artificial Sequence: Synthetic polypeptide
DEEEIRTTNPVATEQFGSVSTNLQENGDPG

SEQ ID NO: 34773 - protein, 31 aa, Artificial Sequence
  Description of Artificial Sequence: Synthetic polypeptide
DEEEIRTTNPVATEQYGCSVSETNDQREDNN

SEQ ID NO: 34774 - protein, 28 aa, Artificial Sequence
  Description of Artificial Sequence: Synthetic peptide
SEEEIRTTNPFATEQYGSVSEGLQREER

SEQ ID NO: 34775 - protein, 28 aa, Artificial Sequence
  Description of Artificial Sequence: Synthetic peptide
DEEEIRATNPVGTEQYGSASDNLQDENR

SEQ ID NO: 34776 - protein, 28 aa, Artificial Sequence
  Description of Artificial Sequence: Synthetic peptide
DEQEIRTTNPVATEQYGSVETPDQDGER

SEQ ID NO: 34777 - protein, 30 aa, Artificial Sequence
  Description of Artificial Sequence: Synthetic polypeptide
DEEEIVTTNPVATEQYGSVSATNFQMVGNF

SEQ ID NO: 34778 - protein, 28 aa, Artificial Sequence
  Description of Artificial Sequence: Synthetic peptide
DEEEIRTTNPVATEQYGTVDENDQQGNS

SEQ ID NO: 34779 - protein, 30 aa, Artificial Sequence
  Description of Artificial Sequence: Synthetic polypeptide
DEEEIRTTNPVATEQYGSVSTDDQWDGDNG

SEQ ID NO: 34780 - protein, 32 aa, Artificial Sequence
  Description of Artificial Sequence: Synthetic polypeptide
DEEEIRTTNPVATEQYGSVSETNDVEEREGNR

SEQ ID NO: 34781 - protein, 31 aa, Artificial Sequence
  Description of Artificial Sequence: Synthetic polypeptide
DEQEIRTTNPVATEQYGSVDETELQRGDNDR

SEQ ID NO: 34782 - protein, 31 aa, Artificial Sequence
  Description of Artificial Sequence: Synthetic polypeptide
DEEEIRTTNPVATEQYGSVSENGQQVRGPER

SEQ ID NO: 34783 - protein, 30 aa, Artificial Sequence
  Description of Artificial Sequence: Synthetic polypeptide
DESEIRTTNPVATECYGSVSTNLQDAGNDM

SEQ ID NO: 34784 - protein, 30 aa, Artificial Sequence
  Description of Artificial Sequence: Synthetic polypeptide
DEEEIRTTNPVATEQYGSVSTELEAEEENR

SEQ ID NO: 34785 - protein, 30 aa, Artificial Sequence
  Description of Artificial Sequence: Synthetic polypeptide
DEEEIRTTNPVATEQYGSVSTELQEFDGEY

SEQ ID NO: 34786 - protein, 29 aa, Artificial Sequence
  Description of Artificial Sequence: Synthetic peptide
DEEEIRTVNPVATEQYGVVSENLQREGDA

SEQ ID NO: 34787 - protein, 30 aa, Artificial Sequence
  Description of Artificial Sequence: Synthetic polypeptide
DEEEIRTTNPVATEQYGSVDCTMDLQQGNI

SEQ ID NO: 34788 - protein, 29 aa, Artificial Sequence
  Description of Artificial Sequence: Synthetic peptide
MENEIRTTNPVATEQYGSVSTNLQYGEDT

SEQ ID NO: 34789 - protein, 29 aa, Artificial Sequence
  Description of Artificial Sequence: Synthetic peptide
DEEEIRTTNPVSTEWYGSVSENDQWRGNQ

SEQ ID NO: 34790 - protein, 29 aa, Artificial Sequence
  Description of Artificial Sequence: Synthetic peptide
MENEIRTTNPVATEQYGSVSTNLQGEGEM

SEQ ID NO: 34791 - protein, 31 aa, Artificial Sequence
  Description of Artificial Sequence: Synthetic polypeptide
DEEEIRATNPVGTMQYGSVSTNLDQERGENR

SEQ ID NO: 34792 - protein, 28 aa, Artificial Sequence
  Description of Artificial Sequence: Synthetic peptide
DEEEIRTTNPYAMEQYGDVSTNEQTGNP

SEQ ID NO: 34793 - protein, 31 aa, Artificial Sequence
  Description of Artificial Sequence: Synthetic polypeptide
DEEEIRTTNPVATEQYGDVSEDNPLQRGNDN

SEQ ID NO: 34794 - protein, 31 aa, Artificial Sequence
  Description of Artificial Sequence: Synthetic polypeptide
DEEEIRTTNPVATEQYGESVSTNLPERGEPD

SEQ ID NO: 34795 - protein, 28 aa, Artificial Sequence
  Description of Artificial Sequence: Synthetic peptide
DENEIRTTNPVATECYGSVSTNLEHGEL

SEQ ID NO: 34796 - protein, 28 aa, Artificial Sequence
  Description of Artificial Sequence: Synthetic peptide
DEEEIRTTNPDATEQYGSVETPLDEGND

SEQ ID NO: 34797 - protein, 30 aa, Artificial Sequence
  Description of Artificial Sequence: Synthetic polypeptide
DEEEIRTTNPVATELYGSVDCTMELQGGNR

SEQ ID NO: 34798 - protein, 28 aa, Artificial Sequence
  Description of Artificial Sequence: Synthetic peptide
DEEEIRTTNPFATEQYGSVSTNDNPDNW

SEQ ID NO: 34799 - protein, 28 aa, Artificial Sequence
  Description of Artificial Sequence: Synthetic peptide
SEEEIRSTNPVATEQWGSVSTNDERGNI

SEQ ID NO: 34800 - protein, 29 aa, Artificial Sequence
  Description of Artificial Sequence: Synthetic peptide
GEEEIRTTNPVATEQYGNVSENLQNGNDA

SEQ ID NO: 34801 - protein, 32 aa, Artificial Sequence
  Description of Artificial Sequence: Synthetic polypeptide
DEEEIRTTNPVATEQYGSVSTMNLPCCRGDNF

SEQ ID NO: 34802 - protein, 29 aa, Artificial Sequence
  Description of Artificial Sequence: Synthetic peptide
DPEEIRTTNPVATEQYGSVFHPPDQRGNR

SEQ ID NO: 34803 - protein, 30 aa, Artificial Sequence
  Description of Artificial Sequence: Synthetic polypeptide
DECEIRTTNPVATEQYGSYVSTNLNYKGNG

SEQ ID NO: 34804 - protein, 28 aa, Artificial Sequence
  Description of Artificial Sequence: Synthetic peptide
DEEEIRTTNPEATEQYGSVSTEEQIGEM

SEQ ID NO: 34805 - protein, 31 aa, Artificial Sequence
  Description of Artificial Sequence: Synthetic polypeptide
DEEEIRTTNPVATEQYGSVSATDLQDREGEL

SEQ ID NO: 34806 - protein, 29 aa, Artificial Sequence
  Description of Artificial Sequence: Synthetic peptide
DEEEIRTTNPVATEQYGIVSTNDEIVGDR

SEQ ID NO: 34807 - protein, 31 aa, Artificial Sequence
  Description of Artificial Sequence: Synthetic polypeptide
DEEEIYTTNPVATEQYGSVSITNLQILGENP

SEQ ID NO: 34808 - protein, 28 aa, Artificial Sequence
  Description of Artificial Sequence: Synthetic peptide
DEEEIASTNPVATEQYGSVACILQRGGR

SEQ ID NO: 34809 - protein, 28 aa, Artificial Sequence
  Description of Artificial Sequence: Synthetic peptide
DEEEIRTTNPFATEQYGSVSTNPLFGEV

SEQ ID NO: 34810 - protein, 28 aa, Artificial Sequence
  Description of Artificial Sequence: Synthetic peptide
DEEEVRTTNPVATEQYGCVATNLQRLPQ

SEQ ID NO: 34811 - protein, 31 aa, Artificial Sequence
  Description of Artificial Sequence: Synthetic polypeptide
DEEEIATTNPTATEQYGSVSTMNLQDRGDNV

SEQ ID NO: 34812 - protein, 30 aa, Artificial Sequence
  Description of Artificial Sequence: Synthetic polypeptide
DEMEIRTTNPVATEQYGSVSTYLQQHNGNS

SEQ ID NO: 34813 - protein, 28 aa, Artificial Sequence
  Description of Artificial Sequence: Synthetic peptide
DEEEIRTTNPVATEQWGDVSTNLMQGDA

SEQ ID NO: 34814 - protein, 28 aa, Artificial Sequence
  Description of Artificial Sequence: Synthetic peptide
DEEEVRATNPVCTEHYGTVSTNLQRLNR

SEQ ID NO: 34815 - protein, 30 aa, Artificial Sequence
  Description of Artificial Sequence: Synthetic polypeptide
DEEEIRTTNPVATECYGVMSTNLQREGNDM

SEQ ID NO: 34816 - protein, 32 aa, Artificial Sequence
  Description of Artificial Sequence: Synthetic polypeptide
DEEEIRTTNPVATEQYGESVDTCNDQREGNPR

SEQ ID NO: 34817 - protein, 30 aa, Artificial Sequence
  Description of Artificial Sequence: Synthetic polypeptide
DEEEIRPTNPVATEQYGMSVSTGGQPEGNR

SEQ ID NO: 34818 - protein, 28 aa, Artificial Sequence
  Description of Artificial Sequence: Synthetic peptide
DEEEIRTTNPVATEQYGSVDTPLDMGET

SEQ ID NO: 34819 - protein, 28 aa, Artificial Sequence
  Description of Artificial Sequence: Synthetic peptide
DEEEIRTTNPVATEQYGCVSTDDEGGDR

SEQ ID NO: 34820 - protein, 32 aa, Artificial Sequence
  Description of Artificial Sequence: Synthetic polypeptide
DEEEIRTTNPVATEQYGSVSTANEQERGDNTG

SEQ ID NO: 34821 - protein, 32 aa, Artificial Sequence
  Description of Artificial Sequence: Synthetic polypeptide
DEEEIRTTNPVATEQYGSVSITENLQLVEGNV

SEQ ID NO: 34822 - protein, 30 aa, Artificial Sequence
  Description of Artificial Sequence: Synthetic polypeptide
SEEELRTTNPVGTEQWGSVSTNLQRKGNER

SEQ ID NO: 34823 - protein, 28 aa, Artificial Sequence
  Description of Artificial Sequence: Synthetic peptide
DEVEICTTNPVATEQYGDVSTVLQRGML

SEQ ID NO: 34824 - protein, 31 aa, Artificial Sequence
  Description of Artificial Sequence: Synthetic polypeptide
DEEEIRSTNPVATEQYGSVCSTGDLQRGEDR

SEQ ID NO: 34825 - protein, 28 aa, Artificial Sequence
  Description of Artificial Sequence: Synthetic peptide
DECEIRTTNPVATELYGDVSTNEQAGNE

SEQ ID NO: 34826 - protein, 28 aa, Artificial Sequence
  Description of Artificial Sequence: Synthetic peptide
VEESIRPTNPVATEQYGSVSTNLLDGNT

SEQ ID NO: 34827 - protein, 28 aa, Artificial Sequence
  Description of Artificial Sequence: Synthetic peptide
DPEEIRTTNPVAYEQYGSWSTPDQRGNP

SEQ ID NO: 34828 - protein, 30 aa, Artificial Sequence
  Description of Artificial Sequence: Synthetic polypeptide
DEEEIRSTNPVSTEVYGSVCSTEPLQRGNR

SEQ ID NO: 34829 - protein, 28 aa, Artificial Sequence
  Description of Artificial Sequence: Synthetic peptide
DEEEIATTNPTATEQYGGVSTNPQVGNA

SEQ ID NO: 34830 - protein, 31 aa, Artificial Sequence
  Description of Artificial Sequence: Synthetic polypeptide
MENEIRTTNPVATEQYGSVSTDLQEREGNDR

SEQ ID NO: 34831 - protein, 31 aa, Artificial Sequence
  Description of Artificial Sequence: Synthetic polypeptide
DEEEIATTNPVATEQYGSVSTNLQDREGEEM

SEQ ID NO: 34832 - protein, 30 aa, Artificial Sequence
  Description of Artificial Sequence: Synthetic polypeptide
DEEEIRTTNPVATEQYGSVDTELQDSGNDL

SEQ ID NO: 34833 - protein, 28 aa, Artificial Sequence
  Description of Artificial Sequence: Synthetic peptide
DEEEIATTNPVATECYGVVSTNLQHGED

SEQ ID NO: 34834 - protein, 30 aa, Artificial Sequence
  Description of Artificial Sequence: Synthetic polypeptide
DEEEIRTTNPVATECYGQVVDTGLQRGDNR

SEQ ID NO: 34835 - protein, 29 aa, Artificial Sequence
  Description of Artificial Sequence: Synthetic peptide
DEQEIRTTNPVATECYGSVQSTNLQVGDE

SEQ ID NO: 34836 - protein, 28 aa, Artificial Sequence
  Description of Artificial Sequence: Synthetic peptide
DEEEIRTTNPEATEQYGSVSTDEQMGDL

SEQ ID NO: 34837 - protein, 29 aa, Artificial Sequence
  Description of Artificial Sequence: Synthetic peptide
DEEEIRTTNPVATEQYGSVSEAAQLAGNV

SEQ ID NO: 34838 - protein, 30 aa, Artificial Sequence
  Description of Artificial Sequence: Synthetic polypeptide
DEEEIRTTNPVATEQYGSVDCTDLCHFGNR

SEQ ID NO: 34839 - protein, 31 aa, Artificial Sequence
  Description of Artificial Sequence: Synthetic polypeptide
DEEEIATTNPVATEQYGSVSTMNEQDQGDNR

SEQ ID NO: 34840 - protein, 29 aa, Artificial Sequence
  Description of Artificial Sequence: Synthetic peptide
DEREIRQTNPVATEIYGSVSTENEQNGNR

SEQ ID NO: 34841 - protein, 28 aa, Artificial Sequence
  Description of Artificial Sequence: Synthetic peptide
DEQEIRTTNPVATEQYGSVDTNDQLGET

SEQ ID NO: 34842 - protein, 33 aa, Artificial Sequence
  Description of Artificial Sequence: Synthetic polypeptide
DEEEIRTTNPVATEQYGSVISTENGEPQRGINR

SEQ ID NO: 34843 - protein, 30 aa, Artificial Sequence
  Description of Artificial Sequence: Synthetic polypeptide
DEEEIRTTNPDATEQYGSVSSTGDVQRGND

SEQ ID NO: 34844 - protein, 31 aa, Artificial Sequence
  Description of Artificial Sequence: Synthetic polypeptide
DEEEIRTTNPVATEQYGSVDSTNDEEHEGNR

SEQ ID NO: 34845 - protein, 28 aa, Artificial Sequence
  Description of Artificial Sequence: Synthetic peptide
DEEEIRTTNPIATEMYGSVANNLEPGNR

SEQ ID NO: 34846 - protein, 28 aa, Artificial Sequence
  Description of Artificial Sequence: Synthetic peptide
DEEMICTTNPLATEQYGSVSTELQRGLG

SEQ ID NO: 34847 - protein, 30 aa, Artificial Sequence
  Description of Artificial Sequence: Synthetic polypeptide
DEEEIRTTNPVATEQYGWVSTNLQEIGEDC

SEQ ID NO: 34848 - protein, 30 aa, Artificial Sequence
  Description of Artificial Sequence: Synthetic polypeptide
DEEEIRTTNPVATEQYGSVSTDLQDVKGEI

SEQ ID NO: 34849 - protein, 31 aa, Artificial Sequence
  Description of Artificial Sequence: Synthetic polypeptide
DEEEIRTTNPVATEIYGSVYSTLNLQDRGDF

SEQ ID NO: 34850 - protein, 31 aa, Artificial Sequence
  Description of Artificial Sequence: Synthetic polypeptide
DEEEIRTTNPVATEQYGSVSETDLEEEGNDR

SEQ ID NO: 34851 - protein, 31 aa, Artificial Sequence
  Description of Artificial Sequence: Synthetic polypeptide
DEEEIRCTNPVATEQYGHVSATNLQVGVNDR

SEQ ID NO: 34852 - protein, 30 aa, Artificial Sequence
  Description of Artificial Sequence: Synthetic polypeptide
DEDEICCTNPVATEQYGSVSTENLQFEGNR

SEQ ID NO: 34853 - protein, 31 aa, Artificial Sequence
  Description of Artificial Sequence: Synthetic polypeptide
DEEEIRTTNPVATEQYGSVSCEMDLQHGNDR

SEQ ID NO: 34854 - protein, 29 aa, Artificial Sequence
  Description of Artificial Sequence: Synthetic peptide
DEEEVRATNPIATEQYGCVSATNLERGNR

SEQ ID NO: 34855 - protein, 28 aa, Artificial Sequence
  Description of Artificial Sequence: Synthetic peptide
DENEIRTTNPVATEQYGWVSDNLQEGEA

SEQ ID NO: 34856 - protein, 29 aa, Artificial Sequence
  Description of Artificial Sequence: Synthetic peptide
DEEEIRTVNPVATECYGSVSTELQMGEDR

SEQ ID NO: 34857 - protein, 31 aa, Artificial Sequence
  Description of Artificial Sequence: Synthetic polypeptide
DEEEIRTTNPVATEQYGSVSCTMDLQMGNDI

SEQ ID NO: 34858 - protein, 28 aa, Artificial Sequence
  Description of Artificial Sequence: Synthetic peptide
DEEEIRTTNPAATELYGTVSTDEQRGNL

SEQ ID NO: 34859 - protein, 28 aa, Artificial Sequence
  Description of Artificial Sequence: Synthetic peptide
DEQEIRTTNPVATEQYGSVSTDEQDGEF

SEQ ID NO: 34860 - protein, 28 aa, Artificial Sequence
  Description of Artificial Sequence: Synthetic peptide
DEDEIRQTNPVATEQYGVVSENLQHGNH

SEQ ID NO: 34861 - protein, 31 aa, Artificial Sequence
  Description of Artificial Sequence: Synthetic polypeptide
DEEEIRTTNPVATECYGSVSTNLQIMEGENM

SEQ ID NO: 34862 - protein, 30 aa, Artificial Sequence
  Description of Artificial Sequence: Synthetic polypeptide
DEEEIRCTNPAATEQYGSVSTNLQTGETDR

SEQ ID NO: 34863 - protein, 30 aa, Artificial Sequence
  Description of Artificial Sequence: Synthetic polypeptide
DEEEIRPTNPVATEQYGSYVSTNPLHRGEL

SEQ ID NO: 34864 - protein, 30 aa, Artificial Sequence
  Description of Artificial Sequence: Synthetic polypeptide
DEEEIATTNPVATECYGSVSATDLQREGND

SEQ ID NO: 34865 - protein, 28 aa, Artificial Sequence
  Description of Artificial Sequence: Synthetic peptide
DEEEIRTVNPVATECYGTVSENLQFGNA

SEQ ID NO: 34866 - protein, 30 aa, Artificial Sequence
  Description of Artificial Sequence: Synthetic polypeptide
DEEEIRATNPVATEQYGSVISENEQRGDNF

SEQ ID NO: 34867 - protein, 28 aa, Artificial Sequence
  Description of Artificial Sequence: Synthetic peptide
DEQEIRTTNPVATEQWGSVDTNEQQGNW

SEQ ID NO: 34868 - protein, 28 aa, Artificial Sequence
  Description of Artificial Sequence: Synthetic peptide
DEEEIVTTNPVATECYGSVSTELETGNW

SEQ ID NO: 34869 - protein, 28 aa, Artificial Sequence
  Description of Artificial Sequence: Synthetic peptide
DEQEIRTTNPEATEQYGSVSTNLEIGEA

SEQ ID NO: 34870 - protein, 29 aa, Artificial Sequence
  Description of Artificial Sequence: Synthetic peptide
DEQEVATVNPVSTEQYGSVSATNLQRGNR

SEQ ID NO: 34871 - protein, 32 aa, Artificial Sequence
  Description of Artificial Sequence: Synthetic polypeptide
DEQEIRTTNPVATEQYGSVDSTENPLQRGENE

SEQ ID NO: 34872 - protein, 31 aa, Artificial Sequence
  Description of Artificial Sequence: Synthetic polypeptide
DEEEIRTTNPTATEQYGSVSTNLQDIEGDNN

SEQ ID NO: 34873 - protein, 28 aa, Artificial Sequence
  Description of Artificial Sequence: Synthetic peptide
DEEEIRATNPVATEMYGWMSTDLQSGNR

SEQ ID NO: 34874 - protein, 31 aa, Artificial Sequence
  Description of Artificial Sequence: Synthetic polypeptide
CEEEIRTTNPVATEQYGAVSTNLQQVRGITR

SEQ ID NO: 34875 - protein, 29 aa, Artificial Sequence
  Description of Artificial Sequence: Synthetic peptide
DEEEIRTTNPVATEQWGSVSTNEMMIGNM

SEQ ID NO: 34876 - protein, 29 aa, Artificial Sequence
  Description of Artificial Sequence: Synthetic peptide
DEHEIRGTNPCATEQYGSVSTNNLQVGNA

SEQ ID NO: 34877 - protein, 33 aa, Artificial Sequence
  Description of Artificial Sequence: Synthetic polypeptide
DEEEIRTTNPVATEQYGSASCTNNLQCRAGNDR

SEQ ID NO: 34878 - protein, 30 aa, Artificial Sequence
  Description of Artificial Sequence: Synthetic polypeptide
DEEEIRTTNPVAYQQYGSVSTPPLQPGNPR

SEQ ID NO: 34879 - protein, 33 aa, Artificial Sequence
  Description of Artificial Sequence: Synthetic polypeptide
DEEEIRTTNPVATEQYGSVSITPGLVQLRGDNR

SEQ ID NO: 34880 - protein, 31 aa, Artificial Sequence
  Description of Artificial Sequence: Synthetic polypeptide
DEGEIRTTNPVATEQYGCVSTGNLQRGENQF

SEQ ID NO: 34881 - protein, 28 aa, Artificial Sequence
  Description of Artificial Sequence: Synthetic peptide
DEEEIRATNPVATENYGAVSMNDERGNR

SEQ ID NO: 34882 - protein, 30 aa, Artificial Sequence
  Description of Artificial Sequence: Synthetic polypeptide
DEEEIRATNPVATEQYGSVGTIDLQGGNDR

SEQ ID NO: 34883 - protein, 29 aa, Artificial Sequence
  Description of Artificial Sequence: Synthetic peptide
DEEEIRTTNPVAVEQYGSVSDNPQHMGQR

SEQ ID NO: 34884 - protein, 28 aa, Artificial Sequence
  Description of Artificial Sequence: Synthetic peptide
DEEEIATTNPVATQQFGSVSTNLYNGLR

SEQ ID NO: 34885 - protein, 29 aa, Artificial Sequence
  Description of Artificial Sequence: Synthetic peptide
DEEEIRCTNPVATEHYGSVSANLPQVENR

SEQ ID NO: 34886 - protein, 28 aa, Artificial Sequence
  Description of Artificial Sequence: Synthetic peptide
DEEEIRTTNPVATECYGSASTDLQTGEI

SEQ ID NO: 34887 - protein, 28 aa, Artificial Sequence
  Description of Artificial Sequence: Synthetic peptide
DENEIRTTNPIATECYGSVSTNLQHGEL

SEQ ID NO: 34888 - protein, 28 aa, Artificial Sequence
  Description of Artificial Sequence: Synthetic peptide
DSNEIRTTNPCATEQYGNVSENLQRGNH

SEQ ID NO: 34889 - protein, 29 aa, Artificial Sequence
  Description of Artificial Sequence: Synthetic peptide
DEEEIRTTNPVATEQYGSVSEILMREDDR

SEQ ID NO: 34890 - protein, 28 aa, Artificial Sequence
  Description of Artificial Sequence: Synthetic peptide
HEEEIRTTNPFATEQYGSVATNPQDGNG

SEQ ID NO: 34891 - protein, 28 aa, Artificial Sequence
  Description of Artificial Sequence: Synthetic peptide
DEEEIRTTNPIASEIYGSVAMNLERGNR

SEQ ID NO: 34892 - protein, 28 aa, Artificial Sequence
  Description of Artificial Sequence: Synthetic peptide
QEAEIATTNPVATEMYGSASTVLQRGNR

SEQ ID NO: 34893 - protein, 31 aa, Artificial Sequence
  Description of Artificial Sequence: Synthetic polypeptide
DEEEIATTNPVATEQYGSVSSFNLQMRGDNL

SEQ ID NO: 34894 - protein, 31 aa, Artificial Sequence
  Description of Artificial Sequence: Synthetic polypeptide
DEEEIRTTNPVATETYGVVSTINGQRGVNWR

SEQ ID NO: 34895 - protein, 31 aa, Artificial Sequence
  Description of Artificial Sequence: Synthetic polypeptide
DEEEIRTTNPVATECYGSVSTNLQDNEGNDM

SEQ ID NO: 34896 - protein, 28 aa, Artificial Sequence
  Description of Artificial Sequence: Synthetic peptide
DEEEIRSTNPVCTEQYGCVAMNLQRGTR

SEQ ID NO: 34897 - protein, 30 aa, Artificial Sequence
  Description of Artificial Sequence: Synthetic polypeptide
DEEEIATTNPVATEQYGSVSTNLQHEGEDF

SEQ ID NO: 34898 - protein, 30 aa, Artificial Sequence
  Description of Artificial Sequence: Synthetic polypeptide
DENEIRTTNPMATEQYGSVGSTNVQVEGNR

SEQ ID NO: 34899 - protein, 31 aa, Artificial Sequence
  Description of Artificial Sequence: Synthetic polypeptide
DEEEIRTTNPVATEQYGSVSVTPDLQDCGNC

SEQ ID NO: 34900 - protein, 33 aa, Artificial Sequence
  Description of Artificial Sequence: Synthetic polypeptide
DEEEIRTTNPVATEQYGSVSDTNLVQIPDGNPR

SEQ ID NO: 34901 - protein, 29 aa, Artificial Sequence
  Description of Artificial Sequence: Synthetic peptide
DEEEIRTTNPVATECYGSVSTELQIKGEN

SEQ ID NO: 34902 - protein, 28 aa, Artificial Sequence
  Description of Artificial Sequence: Synthetic peptide
DEVEIRTTNPVATEQYGNVSENVQQGNG

SEQ ID NO: 34903 - protein, 28 aa, Artificial Sequence
  Description of Artificial Sequence: Synthetic peptide
DESELRTTNPVSTEQYGEVSCTLQRGNR

SEQ ID NO: 34904 - protein, 28 aa, Artificial Sequence
  Description of Artificial Sequence: Synthetic peptide
DEDEIVCTNPVATEQFGSVSTNLQRGTY

SEQ ID NO: 34905 - protein, 30 aa, Artificial Sequence
  Description of Artificial Sequence: Synthetic polypeptide
DEEEIRTTNPVATEQYGSVSSALQLQGNDS

SEQ ID NO: 34906 - protein, 29 aa, Artificial Sequence
  Description of Artificial Sequence: Synthetic peptide
MENEIRTTNPVATEQYGSVSTDLQETGNY

SEQ ID NO: 34907 - protein, 28 aa, Artificial Sequence
  Description of Artificial Sequence: Synthetic peptide
DEEEIRTTNPIASEQYGSVSTGDQGGNF

SEQ ID NO: 34908 - protein, 31 aa, Artificial Sequence
  Description of Artificial Sequence: Synthetic polypeptide
DEEEITTTNPVATEQYGSVDSTDLQQKGENR

SEQ ID NO: 34909 - protein, 29 aa, Artificial Sequence
  Description of Artificial Sequence: Synthetic peptide
DEEEIRTTNPVATEQWGIVDTALQRGEDR

SEQ ID NO: 34910 - protein, 30 aa, Artificial Sequence
  Description of Artificial Sequence: Synthetic polypeptide
DEEEIRTTNPTATEQFGSVSTGNLQRGTTA

SEQ ID NO: 34911 - protein, 28 aa, Artificial Sequence
  Description of Artificial Sequence: Synthetic peptide
DEEEIRTTNPVATEQYGSASDNEQYENI

SEQ ID NO: 34912 - protein, 31 aa, Artificial Sequence
  Description of Artificial Sequence: Synthetic polypeptide
DEEEIRTTNPVATEQYGSVSDTNLEDPGDNE

SEQ ID NO: 34913 - protein, 28 aa, Artificial Sequence
  Description of Artificial Sequence: Synthetic peptide
HEEEIRTTNPVATEQYGSVSTPQQHGDF

SEQ ID NO: 34914 - protein, 30 aa, Artificial Sequence
  Description of Artificial Sequence: Synthetic polypeptide
DEEEIRTTNPVATEQYGDVSTLELVQHENR

SEQ ID NO: 34915 - protein, 28 aa, Artificial Sequence
  Description of Artificial Sequence: Synthetic peptide
DEEEIACTNPVATELYGSVSTNPQHGNF

SEQ ID NO: 34916 - protein, 28 aa, Artificial Sequence
  Description of Artificial Sequence: Synthetic peptide
DEESIRTTNPVATECYGSVFHPLQRGER

SEQ ID NO: 34917 - protein, 28 aa, Artificial Sequence
  Description of Artificial Sequence: Synthetic peptide
DEEEIRTTNPVATEQYGDVSDPLQDEER

SEQ ID NO: 34918 - protein, 28 aa, Artificial Sequence
  Description of Artificial Sequence: Synthetic peptide
DEEEIVTTNPVATEHYGSAGTVLQHGNR

SEQ ID NO: 34919 - protein, 28 aa, Artificial Sequence
  Description of Artificial Sequence: Synthetic peptide
SEEEIRTTNPTATEQYGSVSENEQLGNL

SEQ ID NO: 34920 - protein, 29 aa, Artificial Sequence
  Description of Artificial Sequence: Synthetic peptide
DEEEIRTTNPVATEQYGSVDTNDMVGNDF

SEQ ID NO: 34921 - protein, 28 aa, Artificial Sequence
  Description of Artificial Sequence: Synthetic peptide
DEEEIRTTNPVATLQYGSVWTSLDEGNL

SEQ ID NO: 34922 - protein, 28 aa, Artificial Sequence
  Description of Artificial Sequence: Synthetic peptide
DEEEIRTTNPDATEQYGSVWHGDDRGNR

SEQ ID NO: 34923 - protein, 29 aa, Artificial Sequence
  Description of Artificial Sequence: Synthetic peptide
DEGEIYTTNPVATEQYGTVADNLQRGPNR

SEQ ID NO: 34924 - protein, 30 aa, Artificial Sequence
  Description of Artificial Sequence: Synthetic polypeptide
DEEEIRTTNPVASEQYGCVSAMNLERNGNR

SEQ ID NO: 34925 - protein, 28 aa, Artificial Sequence
  Description of Artificial Sequence: Synthetic peptide
DEVEIYTTNPVATEQFGSVSTNLQGGDN

SEQ ID NO: 34926 - protein, 32 aa, Artificial Sequence
  Description of Artificial Sequence: Synthetic polypeptide
DEEEIRTTNPVATEQYGSVTSLTAPGLLRGNR

SEQ ID NO: 34927 - protein, 30 aa, Artificial Sequence
  Description of Artificial Sequence: Synthetic polypeptide
DEEEIRCTNPEATEQYGSVSMNLQQRGIND

SEQ ID NO: 34928 - protein, 29 aa, Artificial Sequence
  Description of Artificial Sequence: Synthetic peptide
DEEEIATTNPVATECYGSVSEDLQRQGER

SEQ ID NO: 34929 - protein, 28 aa, Artificial Sequence
  Description of Artificial Sequence: Synthetic peptide
AEEEIACVNPVATECYGWVSTNLQRGNR

SEQ ID NO: 34930 - protein, 28 aa, Artificial Sequence
  Description of Artificial Sequence: Synthetic peptide
DENEIRATNPVATEQYGSVSTDLQQGEM

SEQ ID NO: 34931 - protein, 30 aa, Artificial Sequence
  Description of Artificial Sequence: Synthetic polypeptide
DEEEIRTTNPVATECYGSFVSDTALQIGER

SEQ ID NO: 34932 - protein, 29 aa, Artificial Sequence
  Description of Artificial Sequence: Synthetic peptide
DDEEIRTTNPVATEMYGSMSTNLQEAGNN

SEQ ID NO: 34933 - protein, 30 aa, Artificial Sequence
  Description of Artificial Sequence: Synthetic polypeptide
DEEEIVCTNPVATEQYGSVCGTNLQRGEER

SEQ ID NO: 34934 - protein, 30 aa, Artificial Sequence
  Description of Artificial Sequence: Synthetic polypeptide
DEEEIRTTNPVATEQYGSVSTDLQIKGEDD

SEQ ID NO: 34935 - protein, 28 aa, Artificial Sequence
  Description of Artificial Sequence: Synthetic peptide
MEEEIRTTNPVATEQYGSVSEDLQYGDD

SEQ ID NO: 34936 - protein, 28 aa, Artificial Sequence
  Description of Artificial Sequence: Synthetic peptide
GEVEIASTNPVATEQYGQVSTNCQRGNR

SEQ ID NO: 34937 - protein, 28 aa, Artificial Sequence
  Description of Artificial Sequence: Synthetic peptide
DEEEIAATNPVATENYGSVSTNLQDGEQ

SEQ ID NO: 34938 - protein, 29 aa, Artificial Sequence
  Description of Artificial Sequence: Synthetic peptide
DEEEIRTTNPVATEQYGDVSCENLCLGNE

SEQ ID NO: 34939 - protein, 28 aa, Artificial Sequence
  Description of Artificial Sequence: Synthetic peptide
DEEEIRTVNPVATDQYGSVSTNDQDGDD

SEQ ID NO: 34940 - protein, 32 aa, Artificial Sequence
  Description of Artificial Sequence: Synthetic polypeptide
DEEEIRTTNPVATEQYGSVSDTNLEINGENDR

SEQ ID NO: 34941 - protein, 28 aa, Artificial Sequence
  Description of Artificial Sequence: Synthetic peptide
DEVEIRTTNPVATEIYGSVSTNLQFLDG

SEQ ID NO: 34942 - protein, 30 aa, Artificial Sequence
  Description of Artificial Sequence: Synthetic polypeptide
DEEEIRTTNPVATEQYGDVSCENLQAGNDH

SEQ ID NO: 34943 - protein, 28 aa, Artificial Sequence
  Description of Artificial Sequence: Synthetic peptide
DEEEITTTNPVATEQYGSVSEALQWGDL

SEQ ID NO: 34944 - protein, 28 aa, Artificial Sequence
  Description of Artificial Sequence: Synthetic peptide
DEEEIRATNPAATETFGEVSTNWQRGNR

SEQ ID NO: 34945 - protein, 29 aa, Artificial Sequence
  Description of Artificial Sequence: Synthetic peptide
DEEEIRTTNPVATECYGIVSTNDQRGDDQ

SEQ ID NO: 34946 - protein, 31 aa, Artificial Sequence
  Description of Artificial Sequence: Synthetic polypeptide
DEEEIRTTNPEATEQFGSVSTNGLPQRGITR

SEQ ID NO: 34947 - protein, 28 aa, Artificial Sequence
  Description of Artificial Sequence: Synthetic peptide
DENEIRTTNPVATECWGSVDTNEQRGTR

SEQ ID NO: 34948 - protein, 28 aa, Artificial Sequence
  Description of Artificial Sequence: Synthetic peptide
DEEEIRTTNPVATEQYGFVDTGPQAGND

SEQ ID NO: 34949 - protein, 28 aa, Artificial Sequence
  Description of Artificial Sequence: Synthetic peptide
SEEEIRATNPVATEQFGSVSTNEQQGNF

SEQ ID NO: 34950 - protein, 30 aa, Artificial Sequence
  Description of Artificial Sequence: Synthetic polypeptide
NEEEIRCTNPVATEQYGSVSCMNLQQRGND

SEQ ID NO: 34951 - protein, 29 aa, Artificial Sequence
  Description of Artificial Sequence: Synthetic peptide
DEEEIRTTNPDATEQYGSVSTDDDDRGDR

SEQ ID NO: 34952 - protein, 29 aa, Artificial Sequence
  Description of Artificial Sequence: Synthetic peptide
DEEEIRTTNPVATEQYGIVSENLMMQGNF

SEQ ID NO: 34953 - protein, 30 aa, Artificial Sequence
  Description of Artificial Sequence: Synthetic polypeptide
DEQEIATTNPVATEQYGSVSTNLEREGNDL

SEQ ID NO: 34954 - protein, 30 aa, Artificial Sequence
  Description of Artificial Sequence: Synthetic polypeptide
DEEEIATTNPVATEQYGDVDCTMDLQRGNR

SEQ ID NO: 34955 - protein, 29 aa, Artificial Sequence
  Description of Artificial Sequence: Synthetic peptide
DEEEIRTTNPVATEQYGNCSNNCQQLGNR

SEQ ID NO: 34956 - protein, 28 aa, Artificial Sequence
  Description of Artificial Sequence: Synthetic peptide
DEEEIRATNPEATECYGSVSSNLQRMNI

SEQ ID NO: 34957 - protein, 28 aa, Artificial Sequence
  Description of Artificial Sequence: Synthetic peptide
DEVEIAATNPVATEQFGWVSSNLQRGNR

SEQ ID NO: 34958 - protein, 28 aa, Artificial Sequence
  Description of Artificial Sequence: Synthetic peptide
DPEEIRTTNPVAFEQYGSVSENDQREER

SEQ ID NO: 34959 - protein, 28 aa, Artificial Sequence
  Description of Artificial Sequence: Synthetic peptide
DEEEIRTTNPVAVEVYGVCSTNLEMGNR

SEQ ID NO: 34960 - protein, 29 aa, Artificial Sequence
  Description of Artificial Sequence: Synthetic peptide
DDQEIRTTNPVATEQYGSVSTDLQAGEDR

SEQ ID NO: 34961 - protein, 28 aa, Artificial Sequence
  Description of Artificial Sequence: Synthetic peptide
DEQEIRTTNPVATEQYGSVETEEQRENN

SEQ ID NO: 34962 - protein, 28 aa, Artificial Sequence
  Description of Artificial Sequence: Synthetic peptide
DEEEIRTTNPFATEQYGSVSTEGQHGEM

SEQ ID NO: 34963 - protein, 28 aa, Artificial Sequence
  Description of Artificial Sequence: Synthetic peptide
AEEEIRTTNPYATEQWGCVSTNLLSGNR

SEQ ID NO: 34964 - protein, 28 aa, Artificial Sequence
  Description of Artificial Sequence: Synthetic peptide
DEEMIRTTNPVATEQYGFVSTNDDPGER

SEQ ID NO: 34965 - protein, 30 aa, Artificial Sequence
  Description of Artificial Sequence: Synthetic polypeptide
DEEEIRTTNPVATESYGSASATDWQRGNDR

SEQ ID NO: 34966 - protein, 28 aa, Artificial Sequence
  Description of Artificial Sequence: Synthetic peptide
DEEEIRTTNPVATEQYGEVAMNLLVGNW

SEQ ID NO: 34967 - protein, 31 aa, Artificial Sequence
  Description of Artificial Sequence: Synthetic polypeptide
DEEEIRTTNPVATEQYGSVSTGLEENEGNDR

SEQ ID NO: 34968 - protein, 30 aa, Artificial Sequence
  Description of Artificial Sequence: Synthetic polypeptide
DEIELRTTNPVATEQYGSVSTGGVQTRGNR

SEQ ID NO: 34969 - protein, 28 aa, Artificial Sequence
  Description of Artificial Sequence: Synthetic peptide
DEEEIRTTNPVASECYGSASTNLDVGNQ

SEQ ID NO: 34970 - protein, 29 aa, Artificial Sequence
  Description of Artificial Sequence: Synthetic peptide
DEQEIRTTNPVATEQWGSVSTNLMMVGNA

SEQ ID NO: 34971 - protein, 29 aa, Artificial Sequence
  Description of Artificial Sequence: Synthetic peptide
AEDEIRTTNPVATEQYGSVSTDLQWGNDS

SEQ ID NO: 34972 - protein, 28 aa, Artificial Sequence
  Description of Artificial Sequence: Synthetic peptide
DEHEIRTTNPCATEQYGSASEDLQRENR

SEQ ID NO: 34973 - protein, 29 aa, Artificial Sequence
  Description of Artificial Sequence: Synthetic peptide
DEEEIRQTNPVATECYGSVSATDLEQGNR

SEQ ID NO: 34974 - protein, 31 aa, Artificial Sequence
  Description of Artificial Sequence: Synthetic polypeptide
DEEEIRTTNPVATEQYGSVSCEMELQCRGNC

SEQ ID NO: 34975 - protein, 29 aa, Artificial Sequence
  Description of Artificial Sequence: Synthetic peptide
DEEEIYTTNPVATEQYGCVSENLQRGDDA

SEQ ID NO: 34976 - protein, 28 aa, Artificial Sequence
  Description of Artificial Sequence: Synthetic peptide
GEEEIRTVNPVATEIYGTVSTELQRGER

SEQ ID NO: 34977 - protein, 28 aa, Artificial Sequence
  Description of Artificial Sequence: Synthetic peptide
DEEEIRTTNPVATEQYGSVETDLDVGEQ

SEQ ID NO: 34978 - protein, 29 aa, Artificial Sequence
  Description of Artificial Sequence: Synthetic peptide
SEEEIRATNPVATEQFGSVDSTNLQQGTR

SEQ ID NO: 34979 - protein, 30 aa, Artificial Sequence
  Description of Artificial Sequence: Synthetic polypeptide
DEEEIRTTNPVATEQYGSESTMNYGRGNSP

SEQ ID NO: 34980 - protein, 30 aa, Artificial Sequence
  Description of Artificial Sequence: Synthetic polypeptide
DEEEIRTTNPVATELWGSVSENLQMRAGNM

SEQ ID NO: 34981 - protein, 28 aa, Artificial Sequence
  Description of Artificial Sequence: Synthetic peptide
KEEEIATTNPVATEQYGSVSENLQNGEN

SEQ ID NO: 34982 - protein, 32 aa, Artificial Sequence
  Description of Artificial Sequence: Synthetic polypeptide
DEEEIRTTNPVATEQYGSVDSTNGLERGEEDR

SEQ ID NO: 34983 - protein, 28 aa, Artificial Sequence
  Description of Artificial Sequence: Synthetic peptide
DEEEIRTTNPVATECWGSVDTNLQIGTM

SEQ ID NO: 34984 - protein, 28 aa, Artificial Sequence
  Description of Artificial Sequence: Synthetic peptide
DEEEIATTNPVATECYGSVSTDLQMGMP

SEQ ID NO: 34985 - protein, 29 aa, Artificial Sequence
  Description of Artificial Sequence: Synthetic peptide
MEEEIRTVNPVATEAYGSASATNLQRGNT

SEQ ID NO: 34986 - protein, 30 aa, Artificial Sequence
  Description of Artificial Sequence: Synthetic polypeptide
SEEEIRTTNPVAYEQYGSVSTPGLQIPGNR

SEQ ID NO: 34987 - protein, 29 aa, Artificial Sequence
  Description of Artificial Sequence: Synthetic peptide
DENEIRTTNPVATEHWGSVSNNEQWRGNR

SEQ ID NO: 34988 - protein, 28 aa, Artificial Sequence
  Description of Artificial Sequence: Synthetic peptide
DEEEIYTTNPVATEIYGTVSTGLQNGNF

SEQ ID NO: 34989 - protein, 28 aa, Artificial Sequence
  Description of Artificial Sequence: Synthetic peptide
GEEEIRTVNPVATEWYGTVSTNLQRGQS

SEQ ID NO: 34990 - protein, 28 aa, Artificial Sequence
  Description of Artificial Sequence: Synthetic peptide
DEEEIRTTNPVATEQYGSVHDTLQYFNY

SEQ ID NO: 34991 - protein, 28 aa, Artificial Sequence
  Description of Artificial Sequence: Synthetic peptide
DEEEIRTVNPVATECYGSVSTDLQNGES

SEQ ID NO: 34992 - protein, 31 aa, Artificial Sequence
  Description of Artificial Sequence: Synthetic polypeptide
DEEEIRTTNPVATEQYGSVSDTDLERNGNEW

SEQ ID NO: 34993 - protein, 31 aa, Artificial Sequence
  Description of Artificial Sequence: Synthetic polypeptide
DENEIRATNPVATEQYGSVSEMNLQLRDGNR

SEQ ID NO: 34994 - protein, 31 aa, Artificial Sequence
  Description of Artificial Sequence: Synthetic polypeptide
DEEEIRTTNPTATEQYGSVSTGNPQREGDNN

SEQ ID NO: 34995 - protein, 31 aa, Artificial Sequence
  Description of Artificial Sequence: Synthetic polypeptide
DEVEIRTTNPTATEQYGSVSTNLQLRGDNDV

SEQ ID NO: 34996 - protein, 28 aa, Artificial Sequence
  Description of Artificial Sequence: Synthetic peptide
DEEEIRTTNPDATEQYGSVSNALQQGTF

SEQ ID NO: 34997 - protein, 30 aa, Artificial Sequence
  Description of Artificial Sequence: Synthetic polypeptide
DESEIRTTNPVATEQYGMSIVGTNLQVVNR

SEQ ID NO: 34998 - protein, 30 aa, Artificial Sequence
  Description of Artificial Sequence: Synthetic polypeptide
DDEEIRTTNPVATEQYGSMSANLQRGEDDR

SEQ ID NO: 34999 - protein, 28 aa, Artificial Sequence
  Description of Artificial Sequence: Synthetic peptide
DEQEIRTTNPVATEQYGSVSDNEERDNG

SEQ ID NO: 35000 - protein, 31 aa, Artificial Sequence
  Description of Artificial Sequence: Synthetic polypeptide
DEEEIRTTNPVATLQYGSVSTEGLQLRGNPD

SEQ ID NO: 35001 - protein, 28 aa, Artificial Sequence
  Description of Artificial Sequence: Synthetic peptide
DEEEIVTTNPCSTEQYGVVSTALERGNR

SEQ ID NO: 35002 - protein, 29 aa, Artificial Sequence
  Description of Artificial Sequence: Synthetic peptide
DEEEIACTNPVATEMYGSVSAEVLQRGNR

SEQ ID NO: 35003 - protein, 31 aa, Artificial Sequence
  Description of Artificial Sequence: Synthetic polypeptide
DEEEIRTTNPVATEQYGSVEITNLIQRKGDY

SEQ ID NO: 35004 - protein, 31 aa, Artificial Sequence
  Description of Artificial Sequence: Synthetic polypeptide
DEEEIATTNPTATEQYGSVSTNPQLQEGDNR

SEQ ID NO: 35005 - protein, 32 aa, Artificial Sequence
  Description of Artificial Sequence: Synthetic polypeptide
DEEEIRTTNPDATEQYGSVSCTMDLTQRGINR

SEQ ID NO: 35006 - protein, 30 aa, Artificial Sequence
  Description of Artificial Sequence: Synthetic polypeptide
DEVEIRTTNPVATECYGSVYSTNLYRNGNF

SEQ ID NO: 35007 - protein, 31 aa, Artificial Sequence
  Description of Artificial Sequence: Synthetic polypeptide
DEEEIRTTNPVATEQYGSVDDTENLEEGNPR

SEQ ID NO: 35008 - protein, 32 aa, Artificial Sequence
  Description of Artificial Sequence: Synthetic polypeptide
DEEEIRTTNPVATEQYGSVTSTNDEIRNGDNR

SEQ ID NO: 35009 - protein, 28 aa, Artificial Sequence
  Description of Artificial Sequence: Synthetic peptide
DEEEIRTTNPVATEQYGFVGTNLMRLTQ

SEQ ID NO: 35010 - protein, 28 aa, Artificial Sequence
  Description of Artificial Sequence: Synthetic peptide
DEIHIRTTNPVATETYGSVSTNLPRLND

SEQ ID NO: 35011 - protein, 28 aa, Artificial Sequence
  Description of Artificial Sequence: Synthetic peptide
DEEEIRTTNPVATEQYGSVETDDDRGDQ

SEQ ID NO: 35012 - protein, 29 aa, Artificial Sequence
  Description of Artificial Sequence: Synthetic peptide
DEQEIRTTNPVATEQYGTVSTNLQQEGDN

SEQ ID NO: 35013 - protein, 28 aa, Artificial Sequence
  Description of Artificial Sequence: Synthetic peptide
DEEEIACTNPEGTEQYGCVSTNLQRGNF

SEQ ID NO: 35014 - protein, 28 aa, Artificial Sequence
  Description of Artificial Sequence: Synthetic peptide
DEEEIRQTNPVATEQYGDVSTEPQQGER

SEQ ID NO: 35015 - protein, 30 aa, Artificial Sequence
  Description of Artificial Sequence: Synthetic polypeptide
DEEEIATTNPVSTEQYGSVSTQNLQDHGNG

SEQ ID NO: 35016 - protein, 31 aa, Artificial Sequence
  Description of Artificial Sequence: Synthetic polypeptide
DEEEIRTTNPVATEQYGSVSTDLQERKGEDA

SEQ ID NO: 35017 - protein, 31 aa, Artificial Sequence
  Description of Artificial Sequence: Synthetic polypeptide
DEEEIRTTNPVATEQYGSVSTANPQNEGNTF

SEQ ID NO: 35018 - protein, 28 aa, Artificial Sequence
  Description of Artificial Sequence: Synthetic peptide
GECEIGTTNPVATEHYGNVSMNLQRGNR

SEQ ID NO: 35019 - protein, 30 aa, Artificial Sequence
  Description of Artificial Sequence: Synthetic polypeptide
DEEEIRTTNPTATEQFGSVSTANEQRGETR

SEQ ID NO: 35020 - protein, 28 aa, Artificial Sequence
  Description of Artificial Sequence: Synthetic peptide
DEQEISTTNPVGTEQYGSVSTNLNLGND

SEQ ID NO: 35021 - protein, 28 aa, Artificial Sequence
  Description of Artificial Sequence: Synthetic peptide
YEEEVRTTNPMATMQYGSVSTNLQAGNV

SEQ ID NO: 35022 - protein, 30 aa, Artificial Sequence
  Description of Artificial Sequence: Synthetic polypeptide
DEEEIRTTNPVATEQFGSVSTNWQLKGNDE

SEQ ID NO: 35023 - protein, 32 aa, Artificial Sequence
  Description of Artificial Sequence: Synthetic polypeptide
DEEEIRTTNPVATEQYGSVSTMNPQDLGDNTR

SEQ ID NO: 35024 - protein, 28 aa, Artificial Sequence
  Description of Artificial Sequence: Synthetic peptide
DEEEIRTTNPVATEQYGDVPTNEQHGEN

SEQ ID NO: 35025 - protein, 28 aa, Artificial Sequence
  Description of Artificial Sequence: Synthetic peptide
DEEEIRTTNPEATEQYGSVSTDLEREEF

SEQ ID NO: 35026 - protein, 31 aa, Artificial Sequence
  Description of Artificial Sequence: Synthetic polypeptide
DEEEVRATNPVATEQYGSVSTNLQRNGETDR

SEQ ID NO: 35027 - protein, 28 aa, Artificial Sequence
  Description of Artificial Sequence: Synthetic peptide
DEEEIRTTNPVATEQYGDVSECLQHGEM

SEQ ID NO: 35028 - protein, 29 aa, Artificial Sequence
  Description of Artificial Sequence: Synthetic peptide
DEEEIRTTNPVATEQYGSVSESLSARGDL

SEQ ID NO: 35029 - protein, 30 aa, Artificial Sequence
  Description of Artificial Sequence: Synthetic polypeptide
DEEEIRTTNPFATEQYGSVSTELEDRGTDR

SEQ ID NO: 35030 - protein, 30 aa, Artificial Sequence
  Description of Artificial Sequence: Synthetic polypeptide
YEEEIRTTNPVATEQYGTVSTNLQETGNDL

SEQ ID NO: 35031 - protein, 30 aa, Artificial Sequence
  Description of Artificial Sequence: Synthetic polypeptide
DEEEIATTNPVATEVYGSVSCTMNWQHGNR

SEQ ID NO: 35032 - protein, 30 aa, Artificial Sequence
  Description of Artificial Sequence: Synthetic polypeptide
DEEEIRTTNPVACEQYGSVSTNDQNEGVNF

SEQ ID NO: 35033 - protein, 28 aa, Artificial Sequence
  Description of Artificial Sequence: Synthetic peptide
DEQEIRTTNPVATEQYGSVETPDQRGEL

SEQ ID NO: 35034 - protein, 28 aa, Artificial Sequence
  Description of Artificial Sequence: Synthetic peptide
DEEEIRCTNPVATEVYGSVSTALELGNQ

SEQ ID NO: 35035 - protein, 28 aa, Artificial Sequence
  Description of Artificial Sequence: Synthetic peptide
DEEEIRTTNPVSTECYGSVSENEQQGNF

SEQ ID NO: 35036 - protein, 30 aa, Artificial Sequence
  Description of Artificial Sequence: Synthetic polypeptide
SEIEIRTTNPVATEQYGSVSTGNPQVGNWR

SEQ ID NO: 35037 - protein, 28 aa, Artificial Sequence
  Description of Artificial Sequence: Synthetic peptide
DENEIRTTNPVATEQYGVVDDNLQHGNE

SEQ ID NO: 35038 - protein, 28 aa, Artificial Sequence
  Description of Artificial Sequence: Synthetic peptide
DEEEIKTTNPVATEMYGDASCNLQRPNR

SEQ ID NO: 35039 - protein, 30 aa, Artificial Sequence
  Description of Artificial Sequence: Synthetic polypeptide
DEEEIRTTNPFATEQYGSVSIENPQDRGNS

SEQ ID NO: 35040 - protein, 32 aa, Artificial Sequence
  Description of Artificial Sequence: Synthetic polypeptide
DEEEIRTTNPVATEQYGSVSCTMELQCMGNDR

SEQ ID NO: 35041 - protein, 30 aa, Artificial Sequence
  Description of Artificial Sequence: Synthetic polypeptide
DEEEIRTTNPVATENYGGVSTNLQCYGNDG

SEQ ID NO: 35042 - protein, 30 aa, Artificial Sequence
  Description of Artificial Sequence: Synthetic polypeptide
DEDEICTTNPVATETYGSVSTMNGQARGNR

SEQ ID NO: 35043 - protein, 29 aa, Artificial Sequence
  Description of Artificial Sequence: Synthetic peptide
DEEEIRTTNPCSSEVYGSVSTGPLQRGNR

SEQ ID NO: 35044 - protein, 30 aa, Artificial Sequence
  Description of Artificial Sequence: Synthetic polypeptide
DEQEIRTTNPVATEIYGCVSANNLQREGNR

SEQ ID NO: 35045 - protein, 28 aa, Artificial Sequence
  Description of Artificial Sequence: Synthetic peptide
DEEEIRTTNPDATEQYGSVSTELDGGEW

SEQ ID NO: 35046 - protein, 32 aa, Artificial Sequence
  Description of Artificial Sequence: Synthetic polypeptide
DEEEIRTTNPVATEQYGVCVDHITTNLQRGNR

SEQ ID NO: 35047 - protein, 28 aa, Artificial Sequence
  Description of Artificial Sequence: Synthetic peptide
DEEEIATTNPVATECYGSVSTDLQHGED

SEQ ID NO: 35048 - protein, 28 aa, Artificial Sequence
  Description of Artificial Sequence: Synthetic peptide
DEEEIRTTNPVATEQWGSVDTNLEIGTM

SEQ ID NO: 35049 - protein, 30 aa, Artificial Sequence
  Description of Artificial Sequence: Synthetic polypeptide
AEEEIRTTNPVATEQYGVVSTNDVQVRGND

SEQ ID NO: 35050 - protein, 30 aa, Artificial Sequence
  Description of Artificial Sequence: Synthetic polypeptide
DEQEIRTTNPVATEQYGSVDSTEELQEGER

SEQ ID NO: 35051 - protein, 28 aa, Artificial Sequence
  Description of Artificial Sequence: Synthetic peptide
DENEIATTNPVATEQYGVVSTELQIGNY

SEQ ID NO: 35052 - protein, 29 aa, Artificial Sequence
  Description of Artificial Sequence: Synthetic peptide
DEQEIATTNPVATECYGSVSTDLQDHGNR

SEQ ID NO: 35053 - protein, 31 aa, Artificial Sequence
  Description of Artificial Sequence: Synthetic polypeptide
DEEEIRTTNPVATEQYGSVSDTEPLDRNGER

SEQ ID NO: 35054 - protein, 28 aa, Artificial Sequence
  Description of Artificial Sequence: Synthetic peptide
DEEEIVTTNPVATEQYGSCNTNLLNGNF

SEQ ID NO: 35055 - protein, 33 aa, Artificial Sequence
  Description of Artificial Sequence: Synthetic polypeptide
DEEEIRTTNPVATEQYGSVISTCNGLQRGDNTV

SEQ ID NO: 35056 - protein, 29 aa, Artificial Sequence
  Description of Artificial Sequence: Synthetic peptide
DEEEIATTNPVATEQYGSVSTDLEDRGEL

SEQ ID NO: 35057 - protein, 33 aa, Artificial Sequence
  Description of Artificial Sequence: Synthetic polypeptide
DEEEIRTTNPVATEQYGSVDSDTNLEDREGENR

SEQ ID NO: 35058 - protein, 31 aa, Artificial Sequence
  Description of Artificial Sequence: Synthetic polypeptide
DEEEIRATNPVATEQYGSVSETENLEREGNP

SEQ ID NO: 35059 - protein, 28 aa, Artificial Sequence
  Description of Artificial Sequence: Synthetic peptide
DEYEIRTTNPVATEQYGGVSTELDWGND

SEQ ID NO: 35060 - protein, 28 aa, Artificial Sequence
  Description of Artificial Sequence: Synthetic peptide
DEEEIRSTNPTATEMYGSVSANWQRGNF

SEQ ID NO: 35061 - protein, 30 aa, Artificial Sequence
  Description of Artificial Sequence: Synthetic polypeptide
SEEEIRTTNPVATEQFGSVSTENLQRGTTE

SEQ ID NO: 35062 - protein, 30 aa, Artificial Sequence
  Description of Artificial Sequence: Synthetic polypeptide
DEEEIRTTNPVATEIYGVVSTNLQEVKGNL

SEQ ID NO: 35063 - protein, 28 aa, Artificial Sequence
  Description of Artificial Sequence: Synthetic peptide
DPEEIRTTNPVATECYGSVSEEPDRGNR

SEQ ID NO: 35064 - protein, 30 aa, Artificial Sequence
  Description of Artificial Sequence: Synthetic polypeptide
DEEEIRTTNPVATEQYGSVSTDLDREGDDD

SEQ ID NO: 35065 - protein, 32 aa, Artificial Sequence
  Description of Artificial Sequence: Synthetic polypeptide
DEEEIRTTNPVATEQYGSIVSTNLDQINNGNL

SEQ ID NO: 35066 - protein, 30 aa, Artificial Sequence
  Description of Artificial Sequence: Synthetic polypeptide
DEEEIRTTNPTATEQYGSVSTMNEQIGDNF

SEQ ID NO: 35067 - protein, 28 aa, Artificial Sequence
  Description of Artificial Sequence: Synthetic peptide
DEEEIRTTNPVAHMFYGSVSTGLDRGNE

SEQ ID NO: 35068 - protein, 28 aa, Artificial Sequence
  Description of Artificial Sequence: Synthetic peptide
DEEEIATTNPVATETYGGVSENEQQGNR

SEQ ID NO: 35069 - protein, 32 aa, Artificial Sequence
  Description of Artificial Sequence: Synthetic polypeptide
DTEEIRTTNPVATEQYGSVCSTPNPLQPNGNR

SEQ ID NO: 35070 - protein, 28 aa, Artificial Sequence
  Description of Artificial Sequence: Synthetic peptide
DEEEIRTTNPFATEQYGSVSTGPLTGER

SEQ ID NO: 35071 - protein, 32 aa, Artificial Sequence
  Description of Artificial Sequence: Synthetic polypeptide
DEEEIRTTNPVATEQYGSVSETNLQEHDGDNT

SEQ ID NO: 35072 - protein, 28 aa, Artificial Sequence
  Description of Artificial Sequence: Synthetic peptide
NEEEITTTNPVSTEQYGSVSDNLQDLNR

SEQ ID NO: 35073 - protein, 32 aa, Artificial Sequence
  Description of Artificial Sequence: Synthetic polypeptide
DEEEIRTTNPVATEQYGSVDSDTNLEPDGENR

SEQ ID NO: 35074 - protein, 30 aa, Artificial Sequence
  Description of Artificial Sequence: Synthetic polypeptide
DEQEIRTTNPVATEQYGSVETNLQDREEDR

SEQ ID NO: 35075 - protein, 28 aa, Artificial Sequence
  Description of Artificial Sequence: Synthetic peptide
DEEEIATTNPVATECYGSVSTNPQVGEQ

SEQ ID NO: 35076 - protein, 30 aa, Artificial Sequence
  Description of Artificial Sequence: Synthetic polypeptide
DEQEITTTNPVATEQYGDVSTMNLQRGNDA

SEQ ID NO: 35077 - protein, 28 aa, Artificial Sequence
  Description of Artificial Sequence: Synthetic peptide
DEEEIRTTNPFATEQYGSVSTEPERGES

SEQ ID NO: 35078 - protein, 30 aa, Artificial Sequence
  Description of Artificial Sequence: Synthetic polypeptide
DEEEIRTTNPIATEQYGSVSTNLMHEGDSR

SEQ ID NO: 35079 - protein, 30 aa, Artificial Sequence
  Description of Artificial Sequence: Synthetic polypeptide
DEEEIRTTNPDATEQYGSVSTNPDQNGEDR

SEQ ID NO: 35080 - protein, 28 aa, Artificial Sequence
  Description of Artificial Sequence: Synthetic peptide
DEEEIRCTNPVATEQYGVVSTPLQAGDY

SEQ ID NO: 35081 - protein, 31 aa, Artificial Sequence
  Description of Artificial Sequence: Synthetic polypeptide
DEEEITTTNPVATEQYGSVSTNLQVQNGNDH

SEQ ID NO: 35082 - protein, 30 aa, Artificial Sequence
  Description of Artificial Sequence: Synthetic polypeptide
DEEEIRTTNPVATEQYGDVSEMNLQCTGNC

SEQ ID NO: 35083 - protein, 28 aa, Artificial Sequence
  Description of Artificial Sequence: Synthetic peptide
HESEIRTTNPVATEQYGWVSTELQIGNQ

SEQ ID NO: 35084 - protein, 31 aa, Artificial Sequence
  Description of Artificial Sequence: Synthetic polypeptide
DEEEIRTTNPVATEQYGSWSETLNLLDPGNR

SEQ ID NO: 35085 - protein, 29 aa, Artificial Sequence
  Description of Artificial Sequence: Synthetic peptide
DEQEVRTTNPVATEQYGSVAMNLERNGNR

SEQ ID NO: 35086 - protein, 28 aa, Artificial Sequence
  Description of Artificial Sequence: Synthetic peptide
DEEEIRCTNPVATECYGSVSTALQQGEY

SEQ ID NO: 35087 - protein, 30 aa, Artificial Sequence
  Description of Artificial Sequence: Synthetic polypeptide
DEEEIRTTNPVATEQYGSVSATDQEVNGNR

SEQ ID NO: 35088 - protein, 32 aa, Artificial Sequence
  Description of Artificial Sequence: Synthetic polypeptide
DEQEIRTTNPVATEQYGESVSTGNLVEREGNR

SEQ ID NO: 35089 - protein, 30 aa, Artificial Sequence
  Description of Artificial Sequence: Synthetic polypeptide
DEEEIRTTNPVATEQYGSVSEMNDQRGIDI

SEQ ID NO: 35090 - protein, 28 aa, Artificial Sequence
  Description of Artificial Sequence: Synthetic peptide
AEEEIRTTNPDATENYGEVSTNLQLGDR

SEQ ID NO: 35091 - protein, 33 aa, Artificial Sequence
  Description of Artificial Sequence: Synthetic polypeptide
DEEEIRTTNPDATEQYGSVSDTNLTQDRGENDR

SEQ ID NO: 35092 - protein, 28 aa, Artificial Sequence
  Description of Artificial Sequence: Synthetic peptide
DEQEIRTTNPVATEQYGDVSEDEQHGNR

SEQ ID NO: 35093 - protein, 29 aa, Artificial Sequence
  Description of Artificial Sequence: Synthetic peptide
DEEEIRQTNPVATEQYGSVSEEEQEHGNR

SEQ ID NO: 35094 - protein, 31 aa, Artificial Sequence
  Description of Artificial Sequence: Synthetic polypeptide
DEEEIRTTNPVATEQYGSVSTIDDQIKGDNR

SEQ ID NO: 35095 - protein, 30 aa, Artificial Sequence
  Description of Artificial Sequence: Synthetic polypeptide
DEEEIATTNPTATEQYGSVSTNEQDRGDNI

SEQ ID NO: 35096 - protein, 30 aa, Artificial Sequence
  Description of Artificial Sequence: Synthetic polypeptide
DEEEIAQTNPVATEQYGSVSTDLQRGVEDR

SEQ ID NO: 35097 - protein, 31 aa, Artificial Sequence
  Description of Artificial Sequence: Synthetic polypeptide
DEEEIRTTNPVATEQYGSVCSDTNLQNNGDV

SEQ ID NO: 35098 - protein, 30 aa, Artificial Sequence
  Description of Artificial Sequence: Synthetic polypeptide
DEEEIRTTNPVATEQYGSVSDNLQEHGEDM

SEQ ID NO: 35099 - protein, 30 aa, Artificial Sequence
  Description of Artificial Sequence: Synthetic polypeptide
DEQEIRTTNPVATEQYGESVETNLEHGNDR

SEQ ID NO: 35100 - protein, 29 aa, Artificial Sequence
  Description of Artificial Sequence: Synthetic peptide
DEEEIRTTNPVATEGYGEVSTNLMEGNFS

SEQ ID NO: 35101 - protein, 28 aa, Artificial Sequence
  Description of Artificial Sequence: Synthetic peptide
DEEEITTTNPVSTEGYGVVSENLQYGNR

SEQ ID NO: 35102 - protein, 34 aa, Artificial Sequence
  Description of Artificial Sequence: Synthetic polypeptide
DEEEIRTTNPVATEQYGSVSETENGLPQREGNDR

SEQ ID NO: 35103 - protein, 28 aa, Artificial Sequence
  Description of Artificial Sequence: Synthetic peptide
DEEEIRTTNPVATEWWGIVDTNLELGNR

SEQ ID NO: 35104 - protein, 28 aa, Artificial Sequence
  Description of Artificial Sequence: Synthetic peptide
DEVEIATTNPTATEQYGSVSTNPQLGNS

SEQ ID NO: 35105 - protein, 28 aa, Artificial Sequence
  Description of Artificial Sequence: Synthetic peptide
DTEEIRTTNPVATEKYGSVHENLQEWNR

SEQ ID NO: 35106 - protein, 28 aa, Artificial Sequence
  Description of Artificial Sequence: Synthetic peptide
AEQEIRTTNPVATECYGSVSTDQQVGNR

SEQ ID NO: 35107 - protein, 31 aa, Artificial Sequence
  Description of Artificial Sequence: Synthetic polypeptide
DEEEIRTTNPVATEQYGSVSTIELQEAKGNV

SEQ ID NO: 35108 - protein, 28 aa, Artificial Sequence
  Description of Artificial Sequence: Synthetic peptide
DEEEIRTTNPVAWVGYGDVSGNLQRGNQ

SEQ ID NO: 35109 - protein, 31 aa, Artificial Sequence
  Description of Artificial Sequence: Synthetic polypeptide
DEEEIRTTNPVATEQYGSVSTLNPEQEDGER

SEQ ID NO: 35110 - protein, 29 aa, Artificial Sequence
  Description of Artificial Sequence: Synthetic peptide
MEEEIRTTNPVATEQYGSVSTNEQHEGES

SEQ ID NO: 35111 - protein, 28 aa, Artificial Sequence
  Description of Artificial Sequence: Synthetic peptide
AEEEIRQTNPVATEQYGDVSTPLQHGNG

SEQ ID NO: 35112 - protein, 30 aa, Artificial Sequence
  Description of Artificial Sequence: Synthetic polypeptide
DEEEIRTTNPVATEQYGDVSEIEQERGNDR

SEQ ID NO: 35113 - protein, 28 aa, Artificial Sequence
  Description of Artificial Sequence: Synthetic peptide
DEEEIRTTNPEATEQYGSVSTEPEIENR

SEQ ID NO: 35114 - protein, 28 aa, Artificial Sequence
  Description of Artificial Sequence: Synthetic peptide
DEEEIVTTNPVATEQFGSVSTNLQCPEI

SEQ ID NO: 35115 - protein, 29 aa, Artificial Sequence
  Description of Artificial Sequence: Synthetic peptide
DEEEIRTVNPVATEGYGWCSTNLQRAGGR

SEQ ID NO: 35116 - protein, 28 aa, Artificial Sequence
  Description of Artificial Sequence: Synthetic peptide
DEGEIRATNPVATEQYGSASDNIQRGTR

SEQ ID NO: 35117 - protein, 28 aa, Artificial Sequence
  Description of Artificial Sequence: Synthetic peptide
DEEEISTTNPAATEQYGSVSMAEQRGNE

SEQ ID NO: 35118 - protein, 28 aa, Artificial Sequence
  Description of Artificial Sequence: Synthetic peptide
DEEEIRTTNPVATEQYGSVETGLDADER

SEQ ID NO: 35119 - protein, 28 aa, Artificial Sequence
  Description of Artificial Sequence: Synthetic peptide
DEEEIRTTNPVATEIYGVVSTELEGGNV

SEQ ID NO: 35120 - protein, 28 aa, Artificial Sequence
  Description of Artificial Sequence: Synthetic peptide
FEEEIATTNPCCTEQYGSTSTNLQQGNR

SEQ ID NO: 35121 - protein, 28 aa, Artificial Sequence
  Description of Artificial Sequence: Synthetic peptide
DEMEIRQTNPVATEQYGSCSTPLQRGTG

SEQ ID NO: 35122 - protein, 28 aa, Artificial Sequence
  Description of Artificial Sequence: Synthetic peptide
DPEEIRTTNPVAYECYGSVSTNLDDGER

SEQ ID NO: 35123 - protein, 28 aa, Artificial Sequence
  Description of Artificial Sequence: Synthetic peptide
DEEEIRTTNPVATECYGKHSTNEQRRNF

SEQ ID NO: 35124 - protein, 30 aa, Artificial Sequence
  Description of Artificial Sequence: Synthetic polypeptide
DEEEIRTTNPEATEQYGSVSTDEQVRGDNM

SEQ ID NO: 35125 - protein, 30 aa, Artificial Sequence
  Description of Artificial Sequence: Synthetic polypeptide
DEMEISTTNPVATEQYGSVSTQNPQLMGNR

SEQ ID NO: 35126 - protein, 28 aa, Artificial Sequence
  Description of Artificial Sequence: Synthetic peptide
DEQEIRTTNPVATECYGSVSTNLEHGEM

SEQ ID NO: 35127 - protein, 31 aa, Artificial Sequence
  Description of Artificial Sequence: Synthetic polypeptide
DEEEIRTTNPVATEQYGSVSATNLEDHGEDR

SEQ ID NO: 35128 - protein, 28 aa, Artificial Sequence
  Description of Artificial Sequence: Synthetic peptide
DESEIRTTNPVCTEQYGSVSTNDEHGNF

SEQ ID NO: 35129 - protein, 28 aa, Artificial Sequence
  Description of Artificial Sequence: Synthetic peptide
DEQEIATTNPVATECYGSVSTDLQRGED

SEQ ID NO: 35130 - protein, 31 aa, Artificial Sequence
  Description of Artificial Sequence: Synthetic polypeptide
DEEEIRTTNPDATEQYGSVSTTNLIPRGNEM

SEQ ID NO: 35131 - protein, 29 aa, Artificial Sequence
  Description of Artificial Sequence: Synthetic peptide
DEQEIRTTNPVATEQWGSVSTNLEMIGNA

SEQ ID NO: 35132 - protein, 32 aa, Artificial Sequence
  Description of Artificial Sequence: Synthetic polypeptide
DEEEIRTTNPVATEQYGSVSTTDNGLEREENR

SEQ ID NO: 35133 - protein, 31 aa, Artificial Sequence
  Description of Artificial Sequence: Synthetic polypeptide
MEEEIRTTNPVATEQYGSVSTDLQEREGNDM

SEQ ID NO: 35134 - protein, 28 aa, Artificial Sequence
  Description of Artificial Sequence: Synthetic peptide
DEQEVRTTNPVATEIYGAVATNLERGNR

SEQ ID NO: 35135 - protein, 31 aa, Artificial Sequence
  Description of Artificial Sequence: Synthetic polypeptide
DEEEIRTTNPVATEQYGSVSTANPQEIGNTI

SEQ ID NO: 35136 - protein, 28 aa, Artificial Sequence
  Description of Artificial Sequence: Synthetic peptide
DEEEIRCTNPVSTEQYGSVSDELERGNY

SEQ ID NO: 35137 - protein, 28 aa, Artificial Sequence
  Description of Artificial Sequence: Synthetic peptide
DEVEIATTNPTATEQYGSVSTNEQNGNE

SEQ ID NO: 35138 - protein, 29 aa, Artificial Sequence
  Description of Artificial Sequence: Synthetic peptide
DEEEIRQTNPVATEMYGSVSTNLMAAGNQ

SEQ ID NO: 35139 - protein, 31 aa, Artificial Sequence
  Description of Artificial Sequence: Synthetic polypeptide
DEEEIRTTNPVATEQYGSVQLANSLQRGITR

SEQ ID NO: 35140 - protein, 31 aa, Artificial Sequence
  Description of Artificial Sequence: Synthetic polypeptide
DEEEIRTTNPVATEQYGSVSTANPQELGNTI

SEQ ID NO: 35141 - protein, 30 aa, Artificial Sequence
  Description of Artificial Sequence: Synthetic polypeptide
KEEEIRTTNPVATECYGSVSTNLQEYGNDM

SEQ ID NO: 35142 - protein, 28 aa, Artificial Sequence
  Description of Artificial Sequence: Synthetic peptide
DENEIATTNPVATECYGSVSTDLERGNL

SEQ ID NO: 35143 - protein, 29 aa, Artificial Sequence
  Description of Artificial Sequence: Synthetic peptide
DEEEIRATNPVATEQFGSVSENEQREGTR

SEQ ID NO: 35144 - protein, 28 aa, Artificial Sequence
  Description of Artificial Sequence: Synthetic peptide
NEEEIRTTNPVCTEQYGSVSTADQMGND

SEQ ID NO: 35145 - protein, 31 aa, Artificial Sequence
  Description of Artificial Sequence: Synthetic polypeptide
DEEEIRTTNPVATEQYGSFWSCTNLQRFENC

SEQ ID NO: 35146 - protein, 29 aa, Artificial Sequence
  Description of Artificial Sequence: Synthetic peptide
DEEEIRCTNPVACEQYGSCSTLIQSRGNR

SEQ ID NO: 35147 - protein, 28 aa, Artificial Sequence
  Description of Artificial Sequence: Synthetic peptide
DENEIRTTNPVATEQWGSVSENLMQGNF

SEQ ID NO: 35148 - protein, 31 aa, Artificial Sequence
  Description of Artificial Sequence: Synthetic polypeptide
DEEEIRSTNPVATEQYGSAVVSTNTPQRGIR

SEQ ID NO: 35149 - protein, 31 aa, Artificial Sequence
  Description of Artificial Sequence: Synthetic polypeptide
DEEEIATTNPVATEQYGSVSTTNLERNGEND

SEQ ID NO: 35150 - protein, 32 aa, Artificial Sequence
  Description of Artificial Sequence: Synthetic polypeptide
SEEEIRTTNPTATEQYGSVISTNLPQDREGNR

SEQ ID NO: 35151 - protein, 28 aa, Artificial Sequence
  Description of Artificial Sequence: Synthetic peptide
DENECRTTNPVATEQYGSVSTDWQYGNF

SEQ ID NO: 35152 - protein, 32 aa, Artificial Sequence
  Description of Artificial Sequence: Synthetic polypeptide
DEEEIRTTNPDATEQYGSVSTDNLPQQRGTNF

SEQ ID NO: 35153 - protein, 28 aa, Artificial Sequence
  Description of Artificial Sequence: Synthetic peptide
DEQEIRTTNPVATEQYGSVSTELDDGDM

SEQ ID NO: 35154 - protein, 28 aa, Artificial Sequence
  Description of Artificial Sequence: Synthetic peptide
DEQEIRTTNPVATECYGSVSTDLERGEL

SEQ ID NO: 35155 - protein, 29 aa, Artificial Sequence
  Description of Artificial Sequence: Synthetic peptide
DENEIRTTNPVATEQWGIVSTALEWRGNR

SEQ ID NO: 35156 - protein, 30 aa, Artificial Sequence
  Description of Artificial Sequence: Synthetic polypeptide
DEEEIRTTNPVATEQYGSVSTELQVNGEDA

SEQ ID NO: 35157 - protein, 28 aa, Artificial Sequence
  Description of Artificial Sequence: Synthetic peptide
MENEIRTTNPVATEQYGWVSTELQSGNI

SEQ ID NO: 35158 - protein, 28 aa, Artificial Sequence
  Description of Artificial Sequence: Synthetic peptide
DEQEIRTTNPVATEQYGSVSTDLDLGEP

SEQ ID NO: 35159 - protein, 30 aa, Artificial Sequence
  Description of Artificial Sequence: Synthetic polypeptide
DEEEIRTTNPVATEHFGGVSTANLPQRGNQ

SEQ ID NO: 35160 - protein, 28 aa, Artificial Sequence
  Description of Artificial Sequence: Synthetic peptide
DEEEIRTTNPCATELYGVVSSALQWGNR

SEQ ID NO: 35161 - protein, 28 aa, Artificial Sequence
  Description of Artificial Sequence: Synthetic peptide
DEEEIRTTNPVATEQYGSVETPDEIGNQ

SEQ ID NO: 35162 - protein, 30 aa, Artificial Sequence
  Description of Artificial Sequence: Synthetic polypeptide
DEEEIRTTNPVATEQYGDVSENLMNRAGNA

SEQ ID NO: 35163 - protein, 28 aa, Artificial Sequence
  Description of Artificial Sequence: Synthetic peptide
DEEEIRCTNPVATEHFGSVSNNWARGNR

SEQ ID NO: 35164 - protein, 29 aa, Artificial Sequence
  Description of Artificial Sequence: Synthetic peptide
DEEEIRTTNPVATEQYGSVDTMDLCTGNC

SEQ ID NO: 35165 - protein, 28 aa, Artificial Sequence
  Description of Artificial Sequence: Synthetic peptide
DEEEIRSTNPVATELYGAVSTNLQPGEL

SEQ ID NO: 35166 - protein, 32 aa, Artificial Sequence
  Description of Artificial Sequence: Synthetic polypeptide
DEEEIRTTNPVATEQYGSVSETDPLQDNGNDR

SEQ ID NO: 35167 - protein, 30 aa, Artificial Sequence
  Description of Artificial Sequence: Synthetic polypeptide
DEQEIRTTNPVATEQYGSVSENLPEERGER

SEQ ID NO: 35168 - protein, 31 aa, Artificial Sequence
  Description of Artificial Sequence: Synthetic polypeptide
DEEEIRTTNPVATEQYGSVSTDLQDRKGEDT

SEQ ID NO: 35169 - protein, 33 aa, Artificial Sequence
  Description of Artificial Sequence: Synthetic polypeptide
DEEEIRTTNPVATEQYGSVSDTENLQQEGENDR

SEQ ID NO: 35170 - protein, 31 aa, Artificial Sequence
  Description of Artificial Sequence: Synthetic polypeptide
DEEEIRTTNPVATEQYGSVSCTMDLQVGNDQ

SEQ ID NO: 35171 - protein, 28 aa, Artificial Sequence
  Description of Artificial Sequence: Synthetic peptide
DEVEISATNPVATENYGSVSTNQFRGNR

SEQ ID NO: 35172 - protein, 28 aa, Artificial Sequence
  Description of Artificial Sequence: Synthetic peptide
DEEEIRCTNPVASEIYGCVAMNLQRGNR

SEQ ID NO: 35173 - protein, 28 aa, Artificial Sequence
  Description of Artificial Sequence: Synthetic peptide
MENEIRTTNPVATEIYGSVSTELQVGNM

SEQ ID NO: 35174 - protein, 34 aa, Artificial Sequence
  Description of Artificial Sequence: Synthetic polypeptide
DEEEIRTTNPVATEQYGSVESATGNGLQDRDGNR

SEQ ID NO: 35175 - protein, 28 aa, Artificial Sequence
  Description of Artificial Sequence: Synthetic peptide
DEEEIRTTNPVATEQYGSVDQNLSIGEQ

SEQ ID NO: 35176 - protein, 31 aa, Artificial Sequence
  Description of Artificial Sequence: Synthetic polypeptide
DEEEIRTTNPVATEQYGSVETDDGLEREGNR

SEQ ID NO: 35177 - protein, 32 aa, Artificial Sequence
  Description of Artificial Sequence: Synthetic polypeptide
DEEEIRTTNPVATETYGSVSTNLQLREGIDTR

SEQ ID NO: 35178 - protein, 28 aa, Artificial Sequence
  Description of Artificial Sequence: Synthetic peptide
HEEEIYATNPVATEVYGSVSMNLQDGNR

SEQ ID NO: 35179 - protein, 28 aa, Artificial Sequence
  Description of Artificial Sequence: Synthetic peptide
DENEIRTTNPVATEQYGVVSTNLETGEA

SEQ ID NO: 35180 - protein, 31 aa, Artificial Sequence
  Description of Artificial Sequence: Synthetic polypeptide
DEEEIRTTNPVATEQYGSVSTELQDYEGNDD

SEQ ID NO: 35181 - protein, 32 aa, Artificial Sequence
  Description of Artificial Sequence: Synthetic polypeptide
GEEEIRTTNPVATEQYGSVSDTNLQIRNGEDR

SEQ ID NO: 35182 - protein, 29 aa, Artificial Sequence
  Description of Artificial Sequence: Synthetic peptide
DEEEIRTTNPIATEQYGSVSTPLQDNGGL

SEQ ID NO: 35183 - protein, 31 aa, Artificial Sequence
  Description of Artificial Sequence: Synthetic polypeptide
DEEEIRTTNPVATEQYGSVSETNLEERGEDF

SEQ ID NO: 35184 - protein, 28 aa, Artificial Sequence
  Description of Artificial Sequence: Synthetic peptide
DEQEVRCTNPVATEIYGCVSTNLERGNR

SEQ ID NO: 35185 - protein, 32 aa, Artificial Sequence
  Description of Artificial Sequence: Synthetic polypeptide
DEEEIRTTNPVATEQYGSVDSDTNLQQGEEER

SEQ ID NO: 35186 - protein, 29 aa, Artificial Sequence
  Description of Artificial Sequence: Synthetic peptide
KEQEIRTTNPVATECYGSVSTNLQNGNDE

SEQ ID NO: 35187 - protein, 30 aa, Artificial Sequence
  Description of Artificial Sequence: Synthetic polypeptide
DEEEIRTTNPVATEQYGSVSCTELCDNGNH

SEQ ID NO: 35188 - protein, 31 aa, Artificial Sequence
  Description of Artificial Sequence: Synthetic polypeptide
DEQEIRTTNPVATEQYGSTVDSITNDLRGNR

SEQ ID NO: 35189 - protein, 29 aa, Artificial Sequence
  Description of Artificial Sequence: Synthetic peptide
DEEEIRTTNPVATEIWGSVDTNEQNRGNS

SEQ ID NO: 35190 - protein, 31 aa, Artificial Sequence
  Description of Artificial Sequence: Synthetic polypeptide
DEEEIRTTNPVATEQFGSVSTVNLQDFGNTS

SEQ ID NO: 35191 - protein, 30 aa, Artificial Sequence
  Description of Artificial Sequence: Synthetic polypeptide
DEEEIRTTNPCATYNYGSVSTINLQPGNGR

SEQ ID NO: 35192 - protein, 32 aa, Artificial Sequence
  Description of Artificial Sequence: Synthetic polypeptide
DEEEIRTTNPVATEQYGSVSSHPNLQLRGENP

SEQ ID NO: 35193 - protein, 28 aa, Artificial Sequence
  Description of Artificial Sequence: Synthetic peptide
KEEEIATTNPVATEQYGSVSTNLDNPNS

SEQ ID NO: 35194 - protein, 31 aa, Artificial Sequence
  Description of Artificial Sequence: Synthetic polypeptide
DEEEIAATNPVATEQYGSVSENLQREGDNTR

SEQ ID NO: 35195 - protein, 30 aa, Artificial Sequence
  Description of Artificial Sequence: Synthetic polypeptide
DEEEIRTTNPVATEQYGSVSTDLEFEGDPR

SEQ ID NO: 35196 - protein, 29 aa, Artificial Sequence
  Description of Artificial Sequence: Synthetic peptide
DEEEIATTNPVATELYGSVSNDLQRGNTI

SEQ ID NO: 35197 - protein, 30 aa, Artificial Sequence
  Description of Artificial Sequence: Synthetic polypeptide
DEEEIVTTNPVATEQYGSCSATNLLRGTNA

SEQ ID NO: 35198 - protein, 30 aa, Artificial Sequence
  Description of Artificial Sequence: Synthetic polypeptide
DEQEIRTTNPVCTEQYGSVSTMDLQHGNDR

SEQ ID NO: 35199 - protein, 31 aa, Artificial Sequence
  Description of Artificial Sequence: Synthetic polypeptide
DEEEIRTTNPVATEQYGSVSTNEQQPHNGNL

SEQ ID NO: 35200 - protein, 29 aa, Artificial Sequence
  Description of Artificial Sequence: Synthetic peptide
DEEEIRTTNPVATEQYGSVDTNEMWIGNS

SEQ ID NO: 35201 - protein, 30 aa, Artificial Sequence
  Description of Artificial Sequence: Synthetic polypeptide
DEDEIRTTNPVATETYGSVSTMNLQNGTDR

SEQ ID NO: 35202 - protein, 28 aa, Artificial Sequence
  Description of Artificial Sequence: Synthetic peptide
DEEEIRTTNPEATEQYGSVSTPDQDGEY

SEQ ID NO: 35203 - protein, 28 aa, Artificial Sequence
  Description of Artificial Sequence: Synthetic peptide
DENEIRTTNPVATECYGSVDTNEQTGNY

SEQ ID NO: 35204 - protein, 28 aa, Artificial Sequence
  Description of Artificial Sequence: Synthetic peptide
CEEEIRTTNPVATENYGNVSEILQIGNR

SEQ ID NO: 35205 - protein, 29 aa, Artificial Sequence
  Description of Artificial Sequence: Synthetic peptide
DEEEIATTNPVATEQYGSVSTDLQHGEDQ

SEQ ID NO: 35206 - protein, 30 aa, Artificial Sequence
  Description of Artificial Sequence: Synthetic polypeptide
DEEEIRTTNPVSTEQYGSTCSTNLQLREMR

SEQ ID NO: 35207 - protein, 30 aa, Artificial Sequence
  Description of Artificial Sequence: Synthetic polypeptide
AEEEIRTTNPVATEQYGSVSTDGLERGNDD

SEQ ID NO: 35208 - protein, 28 aa, Artificial Sequence
  Description of Artificial Sequence: Synthetic peptide
NEEEIRCTNPVATEQYGAVDTNLQFGNG

SEQ ID NO: 35209 - protein, 30 aa, Artificial Sequence
  Description of Artificial Sequence: Synthetic polypeptide
DEEEIRTTNPDATLQYGSVSTVNQQEIGNR

SEQ ID NO: 35210 - protein, 28 aa, Artificial Sequence
  Description of Artificial Sequence: Synthetic peptide
DEEEIRTTNPVATEIYGVVSTNLEAGED

SEQ ID NO: 35211 - protein, 28 aa, Artificial Sequence
  Description of Artificial Sequence: Synthetic peptide
DEEEIRTTNPVATELYGSVSTNDETGTQ

SEQ ID NO: 35212 - protein, 30 aa, Artificial Sequence
  Description of Artificial Sequence: Synthetic polypeptide
DEEEIRTTNPVATECYGSVSATNLQHGEDL

SEQ ID NO: 35213 - protein, 28 aa, Artificial Sequence
  Description of Artificial Sequence: Synthetic peptide
YEEEIRTTNPVATDQYGSVSTNDTIGNV

SEQ ID NO: 35214 - protein, 31 aa, Artificial Sequence
  Description of Artificial Sequence: Synthetic polypeptide
DEEEIRTTNPVATEQYGSVCSETCLQREEDR

SEQ ID NO: 35215 - protein, 28 aa, Artificial Sequence
  Description of Artificial Sequence: Synthetic peptide
DEEEIRTTNPVATEQYGEVSDDLQQGEV

SEQ ID NO: 35216 - protein, 31 aa, Artificial Sequence
  Description of Artificial Sequence: Synthetic polypeptide
DEEEIRTTNPVATEQYGSVETNLQVRKGDEN

SEQ ID NO: 35217 - protein, 28 aa, Artificial Sequence
  Description of Artificial Sequence: Synthetic peptide
REEEIRQTNPVATEQYGQVSMNLQYGNL

SEQ ID NO: 35218 - protein, 29 aa, Artificial Sequence
  Description of Artificial Sequence: Synthetic peptide
DEVEIRTTNPVATEQFGSVSTNLQDNGTQ

SEQ ID NO: 35219 - protein, 30 aa, Artificial Sequence
  Description of Artificial Sequence: Synthetic polypeptide
DEEEIRCTNPVSTEIYGSVSATNLQREPNR

SEQ ID NO: 35220 - protein, 28 aa, Artificial Sequence
  Description of Artificial Sequence: Synthetic peptide
DEEEIMTTNPIATEVYGSVSVNLQNENR

SEQ ID NO: 35221 - protein, 28 aa, Artificial Sequence
  Description of Artificial Sequence: Synthetic peptide
DEEEIATTNPVATEQYGSVSTDQENGND

SEQ ID NO: 35222 - protein, 28 aa, Artificial Sequence
  Description of Artificial Sequence: Synthetic peptide
DEEEIRTTNPEATEQYGSVSTNLDLEDI

SEQ ID NO: 35223 - protein, 32 aa, Artificial Sequence
  Description of Artificial Sequence: Synthetic polypeptide
DEEEIRTTNPVATEQYGSVSTPNPLQDDGDER

SEQ ID NO: 35224 - protein, 28 aa, Artificial Sequence
  Description of Artificial Sequence: Synthetic peptide
DEEEIRTTNPVATEHYGSVSELLERFNN

SEQ ID NO: 35225 - protein, 30 aa, Artificial Sequence
  Description of Artificial Sequence: Synthetic polypeptide
DEEEIRTTNPCATEVYGVVSCTDLQREGNR

SEQ ID NO: 35226 - protein, 28 aa, Artificial Sequence
  Description of Artificial Sequence: Synthetic peptide
DEQEIRTTNPEATEQYGSVSTDDERGER

SEQ ID NO: 35227 - protein, 31 aa, Artificial Sequence
  Description of Artificial Sequence: Synthetic polypeptide
DEEEIRTTNPVATEQYGSVSTNLQEVNGEDL

SEQ ID NO: 35228 - protein, 28 aa, Artificial Sequence
  Description of Artificial Sequence: Synthetic peptide
DEEEIRTTNPVATESCGSVSTDDQRGLG

SEQ ID NO: 35229 - protein, 31 aa, Artificial Sequence
  Description of Artificial Sequence: Synthetic polypeptide
DEEEIATTNPVATEQYGSVSTMNEQLNEGNR

SEQ ID NO: 35230 - protein, 28 aa, Artificial Sequence
  Description of Artificial Sequence: Synthetic peptide
DEGEIRATNPACTEQYGSVSTNLQGGNA

SEQ ID NO: 35231 - protein, 31 aa, Artificial Sequence
  Description of Artificial Sequence: Synthetic polypeptide
DEQEIATTNPVATEQYGSVSATNLQREGNDI

SEQ ID NO: 35232 - protein, 28 aa, Artificial Sequence
  Description of Artificial Sequence: Synthetic peptide
DEEEIRTTNPVATEMYGFVSDNLQEMNC

SEQ ID NO: 35233 - protein, 28 aa, Artificial Sequence
  Description of Artificial Sequence: Synthetic peptide
DEETIATTNPEATECYGSVSTNLQHGNF

SEQ ID NO: 35234 - protein, 28 aa, Artificial Sequence
  Description of Artificial Sequence: Synthetic peptide
DEEEIRTTNPVATELYGSVSSEDQVGND

SEQ ID NO: 35235 - protein, 28 aa, Artificial Sequence
  Description of Artificial Sequence: Synthetic peptide
DEECIRTTNPDATQQYGSVSTNDDPGNR

SEQ ID NO: 35236 - protein, 28 aa, Artificial Sequence
  Description of Artificial Sequence: Synthetic peptide
DEEEIRTTNPDATEQYGSVSTDPERGEL

SEQ ID NO: 35237 - protein, 32 aa, Artificial Sequence
  Description of Artificial Sequence: Synthetic polypeptide
DEEEIRTTNPVATEQYGSVSTTTNDTIRKGNR

SEQ ID NO: 35238 - protein, 30 aa, Artificial Sequence
  Description of Artificial Sequence: Synthetic polypeptide
DEEEIATTNPVATEQYGSVSTNEQDNGDNV

SEQ ID NO: 35239 - protein, 30 aa, Artificial Sequence
  Description of Artificial Sequence: Synthetic polypeptide
DEEEIRTTNPVATEQYGSVDCEMDLQYGNR

SEQ ID NO: 35240 - protein, 31 aa, Artificial Sequence
  Description of Artificial Sequence: Synthetic polypeptide
DEEEIRTTNPVATEQYGSVSEMDLQCRGNDC

SEQ ID NO: 35241 - protein, 28 aa, Artificial Sequence
  Description of Artificial Sequence: Synthetic peptide
DEEEIRTTNPVATEQYGSVETPLDGGDG

SEQ ID NO: 35242 - protein, 28 aa, Artificial Sequence
  Description of Artificial Sequence: Synthetic peptide
DEEEIATTNPVATEQYGVVSTDDQTGNF

SEQ ID NO: 35243 - protein, 28 aa, Artificial Sequence
  Description of Artificial Sequence: Synthetic peptide
DEEEIRTTNPVATEQWGSYSEIEQRGNA

SEQ ID NO: 35244 - protein, 28 aa, Artificial Sequence
  Description of Artificial Sequence: Synthetic peptide
DESEIRTVNPVATEPYGSVDTNLEWGNR

SEQ ID NO: 35245 - protein, 31 aa, Artificial Sequence
  Description of Artificial Sequence: Synthetic polypeptide
DEEEIRTTNPVATEQYGSVSCTMDLQYGNDC

SEQ ID NO: 35246 - protein, 30 aa, Artificial Sequence
  Description of Artificial Sequence: Synthetic polypeptide
DENEIRTTNPVATEQYGSVSTDLQNEGNDM

SEQ ID NO: 35247 - protein, 28 aa, Artificial Sequence
  Description of Artificial Sequence: Synthetic peptide
SEEEIRATNPVATEQFGSVSENLQIGNQ

SEQ ID NO: 35248 - protein, 28 aa, Artificial Sequence
  Description of Artificial Sequence: Synthetic peptide
DEQEIRSTNPVATEQYGSYSDNLEGGNR

SEQ ID NO: 35249 - protein, 28 aa, Artificial Sequence
  Description of Artificial Sequence: Synthetic peptide
DENEIRTTNPVATEHYGSVYENEQRGNE

SEQ ID NO: 35250 - protein, 30 aa, Artificial Sequence
  Description of Artificial Sequence: Synthetic polypeptide
SEEEIACTNPVATEQYGSVTSTNNLQAGNR

SEQ ID NO: 35251 - protein, 30 aa, Artificial Sequence
  Description of Artificial Sequence: Synthetic polypeptide
DEEEIRTTNPVATECYGSVSTNLEINGNDG

SEQ ID NO: 35252 - protein, 29 aa, Artificial Sequence
  Description of Artificial Sequence: Synthetic peptide
DEEEIRTTNPVCTELYGTVSTNLQLSGNY

SEQ ID NO: 35253 - protein, 32 aa, Artificial Sequence
  Description of Artificial Sequence: Synthetic polypeptide
DEEEIRTTNPFATEQYGSVSITPNLVDLRGNR

SEQ ID NO: 35254 - protein, 28 aa, Artificial Sequence
  Description of Artificial Sequence: Synthetic peptide
DEYEIRQTNPVATEQYGVVSNNLQRGGM

SEQ ID NO: 35255 - protein, 29 aa, Artificial Sequence
  Description of Artificial Sequence: Synthetic peptide
CEEEIRTTNPVATEQYGWVSTVNGDRGNL

SEQ ID NO: 35256 - protein, 28 aa, Artificial Sequence
  Description of Artificial Sequence: Synthetic peptide
DDEEIATTNPVSTEQYGCVATNLERGNR

SEQ ID NO: 35257 - protein, 28 aa, Artificial Sequence
  Description of Artificial Sequence: Synthetic peptide
DEEEIRTTNPVASEQYGSVSMNLFHGDP

SEQ ID NO: 35258 - protein, 28 aa, Artificial Sequence
  Description of Artificial Sequence: Synthetic peptide
DEEEVRTVNPVATEGYGSVSFNLQRAGR

SEQ ID NO: 35259 - protein, 30 aa, Artificial Sequence
  Description of Artificial Sequence: Synthetic polypeptide
DENEIRTTNPVATECYGSVSTNLQDQEGNF

SEQ ID NO: 35260 - protein, 31 aa, Artificial Sequence
  Description of Artificial Sequence: Synthetic polypeptide
SEEEIRTTNPVATEQYGEVSTCNLQDRGDNE

SEQ ID NO: 35261 - protein, 28 aa, Artificial Sequence
  Description of Artificial Sequence: Synthetic peptide
CEEEIRTTNPVATEQYGSVDTDDAQGNR

SEQ ID NO: 35262 - protein, 28 aa, Artificial Sequence
  Description of Artificial Sequence: Synthetic peptide
DEQEIRCTNPVASEQYGCVATNLERGNR

SEQ ID NO: 35263 - protein, 31 aa, Artificial Sequence
  Description of Artificial Sequence: Synthetic polypeptide
DEEEIRTTNPVCTEQYGSVSDDNLQTRGNLD

SEQ ID NO: 35264 - protein, 30 aa, Artificial Sequence
  Description of Artificial Sequence: Synthetic polypeptide
SEEEIRATNPVATEQYGSSVETNLQREGLR

SEQ ID NO: 35265 - protein, 28 aa, Artificial Sequence
  Description of Artificial Sequence: Synthetic peptide
DEECIWTTNPVATEQYGSASTNLPAGDR

SEQ ID NO: 35266 - protein, 28 aa, Artificial Sequence
  Description of Artificial Sequence: Synthetic peptide
DEQEIRTTNPVSTEIYGSYSTNLQLGNS

SEQ ID NO: 35267 - protein, 31 aa, Artificial Sequence
  Description of Artificial Sequence: Synthetic polypeptide
DEEEIRTTNPVATEQYGSVKTNDQREGDNDS

SEQ ID NO: 35268 - protein, 30 aa, Artificial Sequence
  Description of Artificial Sequence: Synthetic polypeptide
DEEEIRCTNPVATENYGDVSAVNLQRGNDR

SEQ ID NO: 35269 - protein, 29 aa, Artificial Sequence
  Description of Artificial Sequence: Synthetic peptide
MEEEIRSTNPVATEQYGSVSTDLQIGNDQ

SEQ ID NO: 35270 - protein, 28 aa, Artificial Sequence
  Description of Artificial Sequence: Synthetic peptide
DENEIRTTNPVATEQWGSVSENEMQGNR

SEQ ID NO: 35271 - protein, 28 aa, Artificial Sequence
  Description of Artificial Sequence: Synthetic peptide
DEEEIRTTNPVATECYGVVSTDDQSGER

SEQ ID NO: 35272 - protein, 30 aa, Artificial Sequence
  Description of Artificial Sequence: Synthetic polypeptide
DEEEIRTTNPVATEQYGSVSTGLEVLEGND

SEQ ID NO: 35273 - protein, 30 aa, Artificial Sequence
  Description of Artificial Sequence: Synthetic polypeptide
MEEEIATTNPVATEQYGSVSTNLQENGNDM

SEQ ID NO: 35274 - protein, 29 aa, Artificial Sequence
  Description of Artificial Sequence: Synthetic peptide
DEEEIRTTNPVATEQYGDVSCEELQLGNV

SEQ ID NO: 35275 - protein, 31 aa, Artificial Sequence
  Description of Artificial Sequence: Synthetic polypeptide
DENEIVTTNPVATEQYGSVSATGDLTQRGNR

SEQ ID NO: 35276 - protein, 28 aa, Artificial Sequence
  Description of Artificial Sequence: Synthetic peptide
QEAEIRCTNPVATEQYGAVSDNLQRGER

SEQ ID NO: 35277 - protein, 29 aa, Artificial Sequence
  Description of Artificial Sequence: Synthetic peptide
DEEEIRATNPTATEQYGSVGTNLELRGND

SEQ ID NO: 35278 - protein, 32 aa, Artificial Sequence
  Description of Artificial Sequence: Synthetic polypeptide
DEEEIRTTNPVATEQYGYVSTVNGLPQNRGNM

SEQ ID NO: 35279 - protein, 31 aa, Artificial Sequence
  Description of Artificial Sequence: Synthetic polypeptide
DEEEIRTTNPVATEQYGGVSTLNLQNGANTF

SEQ ID NO: 35280 - protein, 31 aa, Artificial Sequence
  Description of Artificial Sequence: Synthetic polypeptide
DEEEIRTTNPVATEQYGSVSTANPQENGNTA

SEQ ID NO: 35281 - protein, 29 aa, Artificial Sequence
  Description of Artificial Sequence: Synthetic peptide
DEEEIAATNPTATEQFGSVSTNLQREGTR

SEQ ID NO: 35282 - protein, 28 aa, Artificial Sequence
  Description of Artificial Sequence: Synthetic peptide
DEEEIRTTNPVCTEVYGVVSDELQRGND

SEQ ID NO: 35283 - protein, 28 aa, Artificial Sequence
  Description of Artificial Sequence: Synthetic peptide
DEEEITTTNPVSTEQYGDVSVNLQHGNE

SEQ ID NO: 35284 - protein, 31 aa, Artificial Sequence
  Description of Artificial Sequence: Synthetic polypeptide
DEEEIRTTNPEATEVYGSVSTEALTQDRGNR

SEQ ID NO: 35285 - protein, 30 aa, Artificial Sequence
  Description of Artificial Sequence: Synthetic polypeptide
DEEEIRTTNPIATEQWGSVSTTNEQQEGNR

SEQ ID NO: 35286 - protein, 29 aa, Artificial Sequence
  Description of Artificial Sequence: Synthetic peptide
DEEEIRTTNPVATEQYGGVSTAGGQHGNF

SEQ ID NO: 35287 - protein, 29 aa, Artificial Sequence
  Description of Artificial Sequence: Synthetic peptide
DEGEIRTTNPVATEQYGSVSTLCQGSGNF

SEQ ID NO: 35288 - protein, 28 aa, Artificial Sequence
  Description of Artificial Sequence: Synthetic peptide
DEEEIRTTNPVATEQYGSVSTEEEHGDH

SEQ ID NO: 35289 - protein, 32 aa, Artificial Sequence
  Description of Artificial Sequence: Synthetic polypeptide
DEEEIRTTNPVATEQYGSVSCTMMLQSRGSPR

SEQ ID NO: 35290 - protein, 30 aa, Artificial Sequence
  Description of Artificial Sequence: Synthetic polypeptide
DAEEIRTTNPVATEQYGSVSITGLVQDGER

SEQ ID NO: 35291 - protein, 30 aa, Artificial Sequence
  Description of Artificial Sequence: Synthetic polypeptide
DEECIRTTNPVATQQYGSVTSTGDQRGDNR

SEQ ID NO: 35292 - protein, 28 aa, Artificial Sequence
  Description of Artificial Sequence: Synthetic peptide
DTEEIRTTNPVAYLQYGSVSTNDQPGTR

SEQ ID NO: 35293 - protein, 28 aa, Artificial Sequence
  Description of Artificial Sequence: Synthetic peptide
DEIEIRTTNPVATEQYGAVSENEQYGNA

SEQ ID NO: 35294 - protein, 31 aa, Artificial Sequence
  Description of Artificial Sequence: Synthetic polypeptide
DEVEIRTTNPVATEQYGSVSTMNLQLNGDNV

SEQ ID NO: 35295 - protein, 28 aa, Artificial Sequence
  Description of Artificial Sequence: Synthetic peptide
DEEEIRTTNPIATYQWGSVSQDLQIGNR

SEQ ID NO: 35296 - protein, 28 aa, Artificial Sequence
  Description of Artificial Sequence: Synthetic peptide
DEEEIRTTNPAATEQFGSVSTNPQNGTL

SEQ ID NO: 35297 - protein, 31 aa, Artificial Sequence
  Description of Artificial Sequence: Synthetic polypeptide
DEEEIRTTNPVATEQYGSVSCTMDLQYGNDQ

SEQ ID NO: 35298 - protein, 28 aa, Artificial Sequence
  Description of Artificial Sequence: Synthetic peptide
DEEEIRTTNPAATELYGSVSANDQSGNV

SEQ ID NO: 35299 - protein, 33 aa, Artificial Sequence
  Description of Artificial Sequence: Synthetic polypeptide
DEEEIRTTNPVATEQYGSVSSITGPLQRGDNPR

SEQ ID NO: 35300 - protein, 28 aa, Artificial Sequence
  Description of Artificial Sequence: Synthetic peptide
DEEEIGTTNPTATETFGSVSTALQRGGR

SEQ ID NO: 35301 - protein, 32 aa, Artificial Sequence
  Description of Artificial Sequence: Synthetic polypeptide
DEEEICGTNPVATEQYGSVSTMNLQQDRGNDR

SEQ ID NO: 35302 - protein, 30 aa, Artificial Sequence
  Description of Artificial Sequence: Synthetic polypeptide
DEEEIRTTNPDATEQYGSVSETPPDDRGNR

SEQ ID NO: 35303 - protein, 30 aa, Artificial Sequence
  Description of Artificial Sequence: Synthetic polypeptide
QEEEIRTTNPVATEQYGSVSFTNGLQNGLF

SEQ ID NO: 35304 - protein, 31 aa, Artificial Sequence
  Description of Artificial Sequence: Synthetic polypeptide
DEEEIRTTNPVATEQYGSVSTNLEDHEGEDR

SEQ ID NO: 35305 - protein, 28 aa, Artificial Sequence
  Description of Artificial Sequence: Synthetic peptide
DEEEIRTTNPDATQCYGSVSTGLQRGEE

SEQ ID NO: 35306 - protein, 32 aa, Artificial Sequence
  Description of Artificial Sequence: Synthetic polypeptide
DEEEIRTTNPVATEQYGSVSTMNEQDLEGDNR

SEQ ID NO: 35307 - protein, 30 aa, Artificial Sequence
  Description of Artificial Sequence: Synthetic polypeptide
DEEEIRTTNPVCTEQYGSVISVGGLQGGNR

SEQ ID NO: 35308 - protein, 28 aa, Artificial Sequence
  Description of Artificial Sequence: Synthetic peptide
DEQEIYTTNPVATEQYGNVSDNLQVGNF

SEQ ID NO: 35309 - protein, 28 aa, Artificial Sequence
  Description of Artificial Sequence: Synthetic peptide
DEVEIMTTNPVATEHYGDVSTNLQRENV

SEQ ID NO: 35310 - protein, 28 aa, Artificial Sequence
  Description of Artificial Sequence: Synthetic peptide
DEQEIRTTNPVATEQYGSVSTDLEVGEF

SEQ ID NO: 35311 - protein, 30 aa, Artificial Sequence
  Description of Artificial Sequence: Synthetic polypeptide
DEEEIKTTNPVATEQWGSVSNNLQRKPNDR

SEQ ID NO: 35312 - protein, 29 aa, Artificial Sequence
  Description of Artificial Sequence: Synthetic peptide
DEEEIRTTNPVATECYGSVSTDLQGGDDY

SEQ ID NO: 35313 - protein, 31 aa, Artificial Sequence
  Description of Artificial Sequence: Synthetic polypeptide
DEEEIRTTNPVATEQYGSVSAANLQLHSGNQ

SEQ ID NO: 35314 - protein, 28 aa, Artificial Sequence
  Description of Artificial Sequence: Synthetic peptide
DEEEIRTTNPFATEQYGSVSTEQDVGER

SEQ ID NO: 35315 - protein, 31 aa, Artificial Sequence
  Description of Artificial Sequence: Synthetic polypeptide
DEEEIVTTNPVATEQYGSVSEGNLQDHGNTR

SEQ ID NO: 35316 - protein, 28 aa, Artificial Sequence
  Description of Artificial Sequence: Synthetic peptide
AEVEIRTTNPVACETYGEVSTNQQRGNR

SEQ ID NO: 35317 - protein, 33 aa, Artificial Sequence
  Description of Artificial Sequence: Synthetic polypeptide
DEEEIRTTNPVATEQYGSIVSETNGLIQLEGNR

SEQ ID NO: 35318 - protein, 31 aa, Artificial Sequence
  Description of Artificial Sequence: Synthetic polypeptide
DEEEIRTTNPVATEQYGSVSTDLQENEGNDM

SEQ ID NO: 35319 - protein, 29 aa, Artificial Sequence
  Description of Artificial Sequence: Synthetic peptide
DEEEIVTTNPVATEQYGSVSATVLQREEK

SEQ ID NO: 35320 - protein, 28 aa, Artificial Sequence
  Description of Artificial Sequence: Synthetic peptide
DESELRSTNPVATECYGGVSTNLQRGQR

SEQ ID NO: 35321 - protein, 31 aa, Artificial Sequence
  Description of Artificial Sequence: Synthetic polypeptide
DEEEIRTTNPVATEQYGSVSTNLEDVEGNDQ

SEQ ID NO: 35322 - protein, 29 aa, Artificial Sequence
  Description of Artificial Sequence: Synthetic peptide
DEEELRCTNPIAYEQYGAVSTNLQRNGNR

SEQ ID NO: 35323 - protein, 28 aa, Artificial Sequence
  Description of Artificial Sequence: Synthetic peptide
DENEIRTTNPVATEMYGSMSTDLQQGNN

SEQ ID NO: 35324 - protein, 28 aa, Artificial Sequence
  Description of Artificial Sequence: Synthetic peptide
DEFEIRTTNPVATECYGSVSTELQAGEF

SEQ ID NO: 35325 - protein, 31 aa, Artificial Sequence
  Description of Artificial Sequence: Synthetic polypeptide
DEQEIRTTNPVATEQYGSVSATNLEEHNGNR

SEQ ID NO: 35326 - protein, 28 aa, Artificial Sequence
  Description of Artificial Sequence: Synthetic peptide
DEEEIRTTNPEATEQYGSVSTDEDRGDH

SEQ ID NO: 35327 - protein, 28 aa, Artificial Sequence
  Description of Artificial Sequence: Synthetic peptide
DEEEIRTTNPVATEQYGSVDTPDDEGER

SEQ ID NO: 35328 - protein, 30 aa, Artificial Sequence
  Description of Artificial Sequence: Synthetic polypeptide
DEEEIRTTNPAATECYGSVSTMNLQLGDNE

SEQ ID NO: 35329 - protein, 33 aa, Artificial Sequence
  Description of Artificial Sequence: Synthetic polypeptide
DEEEIRTTNPVATEQYGSVSETNLEERDGENER

SEQ ID NO: 35330 - protein, 28 aa, Artificial Sequence
  Description of Artificial Sequence: Synthetic peptide
DEEEIAQTNPVATEQYGSVSTGQEIGNR

SEQ ID NO: 35331 - protein, 28 aa, Artificial Sequence
  Description of Artificial Sequence: Synthetic peptide
DEEEISTTNPVATYQYGSVSENLQKDNC

SEQ ID NO: 35332 - protein, 28 aa, Artificial Sequence
  Description of Artificial Sequence: Synthetic peptide
DEEEIRTTNPVATEQYGEVSENEQQGDF

SEQ ID NO: 35333 - protein, 28 aa, Artificial Sequence
  Description of Artificial Sequence: Synthetic peptide
QENEIRTTNPVATECYGSVSTDLQRGEW

SEQ ID NO: 35334 - protein, 28 aa, Artificial Sequence
  Description of Artificial Sequence: Synthetic peptide
DEEEIRTTNPVATEQWGSVSENDMQGNF

SEQ ID NO: 35335 - protein, 29 aa, Artificial Sequence
  Description of Artificial Sequence: Synthetic peptide
DEQEIRTTNPVATEQYGSVSTDLQDGGEF

SEQ ID NO: 35336 - protein, 31 aa, Artificial Sequence
  Description of Artificial Sequence: Synthetic polypeptide
DEEEIRTTNPVATEQYGSVSETNLEDGDNEE

SEQ ID NO: 35337 - protein, 32 aa, Artificial Sequence
  Description of Artificial Sequence: Synthetic polypeptide
DEEEIRTTNPVATEQYGSVSTTNLQEDNGENQ

SEQ ID NO: 35338 - protein, 28 aa, Artificial Sequence
  Description of Artificial Sequence: Synthetic peptide
DEEEIRTTNPVATEQYGSVSTNELPDEF

SEQ ID NO: 35339 - protein, 28 aa, Artificial Sequence
  Description of Artificial Sequence: Synthetic peptide
DEEEIRTTNPCSTEQYGVVANNLERGNR

SEQ ID NO: 35340 - protein, 28 aa, Artificial Sequence
  Description of Artificial Sequence: Synthetic peptide
DEEEISCTNPVATEQFGFASTNLQRGTR

SEQ ID NO: 35341 - protein, 29 aa, Artificial Sequence
  Description of Artificial Sequence: Synthetic peptide
DEEEIRTTNPCATEQYGSVSTAEQAEGNV

SEQ ID NO: 35342 - protein, 29 aa, Artificial Sequence
  Description of Artificial Sequence: Synthetic peptide
KEEEIRTTNPVATEQYGSVSTELQDAGEQ

SEQ ID NO: 35343 - protein, 28 aa, Artificial Sequence
  Description of Artificial Sequence: Synthetic peptide
MEQEIRTTNPVATEQYGSVADNLQLGER

SEQ ID NO: 35344 - protein, 32 aa, Artificial Sequence
  Description of Artificial Sequence: Synthetic polypeptide
DEEEIRTTNPVATEQYGSVSETNLEREGENEE

SEQ ID NO: 35345 - protein, 28 aa, Artificial Sequence
  Description of Artificial Sequence: Synthetic peptide
DEEEIMTTNPTASEQYGSVATNLQQGNA

SEQ ID NO: 35346 - protein, 29 aa, Artificial Sequence
  Description of Artificial Sequence: Synthetic peptide
DEEEIAPTNPVATEQYGSVSATNLEFGER

SEQ ID NO: 35347 - protein, 28 aa, Artificial Sequence
  Description of Artificial Sequence: Synthetic peptide
DEEEIVTTNPVATELYGSVSTDLQVGEV

SEQ ID NO: 35348 - protein, 28 aa, Artificial Sequence
  Description of Artificial Sequence: Synthetic peptide
DEEEIRTTNPDATEQYGSVSTPPNMGNY

SEQ ID NO: 35349 - protein, 28 aa, Artificial Sequence
  Description of Artificial Sequence: Synthetic peptide
DEVEIRATNPVATEQFGEVSENLQRGNF

SEQ ID NO: 35350 - protein, 28 aa, Artificial Sequence
  Description of Artificial Sequence: Synthetic peptide
AEEEISQTNPVATEQYGSVSTNDQFGNA

SEQ ID NO: 35351 - protein, 28 aa, Artificial Sequence
  Description of Artificial Sequence: Synthetic peptide
DEQEIRTTNPVATEQYGSVSTEDEMGNA

SEQ ID NO: 35352 - protein, 28 aa, Artificial Sequence
  Description of Artificial Sequence: Synthetic peptide
DEEEIRTTNPVATEQYGSVETPPERDNI

SEQ ID NO: 35353 - protein, 31 aa, Artificial Sequence
  Description of Artificial Sequence: Synthetic polypeptide
DEEEIRTTNPVATEQYGSVSTCNPQRGDTTQ

SEQ ID NO: 35354 - protein, 28 aa, Artificial Sequence
  Description of Artificial Sequence: Synthetic peptide
MENEIRTTNPVATEQYGSVATNLQAGDS

SEQ ID NO: 35355 - protein, 31 aa, Artificial Sequence
  Description of Artificial Sequence: Synthetic polypeptide
DEEEIRTTNPVATEQYGVVSVTIDLQRKGNS

SEQ ID NO: 35356 - protein, 28 aa, Artificial Sequence
  Description of Artificial Sequence: Synthetic peptide
DEQEIATTNPVATEIYGSVSTNLEHGNH

SEQ ID NO: 35357 - protein, 30 aa, Artificial Sequence
  Description of Artificial Sequence: Synthetic polypeptide
MEEEIRTTNPVATECYGSVSTNLQTEGNDV

SEQ ID NO: 35358 - protein, 32 aa, Artificial Sequence
  Description of Artificial Sequence: Synthetic polypeptide
DEEEIRTTNPVATEQYGSVSTGNLQFQNGVNT

SEQ ID NO: 35359 - protein, 29 aa, Artificial Sequence
  Description of Artificial Sequence: Synthetic peptide
DETEIRTTNPVATECYGSVSTDLQSNGNA

SEQ ID NO: 35360 - protein, 31 aa, Artificial Sequence
  Description of Artificial Sequence: Synthetic polypeptide
DEEEIRTTNPVATEQYGSVSTIEPLQERGEE

SEQ ID NO: 35361 - protein, 28 aa, Artificial Sequence
  Description of Artificial Sequence: Synthetic peptide
DEHEIRTTNPVATEQYGDVSEELQYGNI

SEQ ID NO: 35362 - protein, 28 aa, Artificial Sequence
  Description of Artificial Sequence: Synthetic peptide
DEEEIATTNPVATEQYGSVSTPQEVGNI

SEQ ID NO: 35363 - protein, 28 aa, Artificial Sequence
  Description of Artificial Sequence: Synthetic peptide
DEQEIRTTNPEATEQYGSVSTDLQMEER

SEQ ID NO: 35364 - protein, 30 aa, Artificial Sequence
  Description of Artificial Sequence: Synthetic polypeptide
AEEEIRTTNPVATEQYGDVSATDLQLRGER

SEQ ID NO: 35365 - protein, 29 aa, Artificial Sequence
  Description of Artificial Sequence: Synthetic peptide
DEEEIRTTNPVATEQWGSVDTNLEMRGTQ

SEQ ID NO: 35366 - protein, 28 aa, Artificial Sequence
  Description of Artificial Sequence: Synthetic peptide
DEQEISTTNPVATEQYGQVTTNLQIGND

SEQ ID NO: 35367 - protein, 30 aa, Artificial Sequence
  Description of Artificial Sequence: Synthetic polypeptide
DEEEIRTTNPVATEQYGSVDCTMDLQMGNA

SEQ ID NO: 35368 - protein, 31 aa, Artificial Sequence
  Description of Artificial Sequence: Synthetic polypeptide
DEEEIRTTNPFATEQYGSVSTNGLVQVMGNG

SEQ ID NO: 35369 - protein, 28 aa, Artificial Sequence
  Description of Artificial Sequence: Synthetic peptide
DEQEIRTTNPVSTEQFGSVSTAPQLGNR

SEQ ID NO: 35370 - protein, 32 aa, Artificial Sequence
  Description of Artificial Sequence: Synthetic polypeptide
DEEEIVTTNPVATEQYGSVSTMNLVQEAGNDR

SEQ ID NO: 35371 - protein, 28 aa, Artificial Sequence
  Description of Artificial Sequence: Synthetic peptide
DEEEIRTTNPFATEQYGSVSTALELGEY

SEQ ID NO: 35372 - protein, 29 aa, Artificial Sequence
  Description of Artificial Sequence: Synthetic peptide
DEEEIRTVNPVATECYGSVSTEPLERGMR

SEQ ID NO: 35373 - protein, 30 aa, Artificial Sequence
  Description of Artificial Sequence: Synthetic polypeptide
DEEEIRTTNPFATEQYGSVSVTNLQDPGDN

SEQ ID NO: 35374 - protein, 28 aa, Artificial Sequence
  Description of Artificial Sequence: Synthetic peptide
DEQEIATTNPVATEQYGSVSTDLEVGNS

SEQ ID NO: 35375 - protein, 29 aa, Artificial Sequence
  Description of Artificial Sequence: Synthetic peptide
DENEIATTNPVATECYGSVSTDLQRGNDI

SEQ ID NO: 35376 - protein, 30 aa, Artificial Sequence
  Description of Artificial Sequence: Synthetic polypeptide
DEEEIATTNPVATEQYGSVSTNLQDHGEDN

SEQ ID NO: 35377 - protein, 28 aa, Artificial Sequence
  Description of Artificial Sequence: Synthetic peptide
DEEEIRTTNPDATEVYGSVSTNDQMDNY

SEQ ID NO: 35378 - protein, 28 aa, Artificial Sequence
  Description of Artificial Sequence: Synthetic peptide
DEEEIRTTNPVATECYGIVSTVPQRGDL

SEQ ID NO: 35379 - protein, 28 aa, Artificial Sequence
  Description of Artificial Sequence: Synthetic peptide
DEDEIRTTNPVATEQYGDVGTNLENGNS

SEQ ID NO: 35380 - protein, 31 aa, Artificial Sequence
  Description of Artificial Sequence: Synthetic polypeptide
DEEEIRTTNPVATEQYGSVSTDLQEYKGNDT

SEQ ID NO: 35381 - protein, 32 aa, Artificial Sequence
  Description of Artificial Sequence: Synthetic polypeptide
DEEEIRTTNPVATEQYGSVSTCNEQDQGDNTR

SEQ ID NO: 35382 - protein, 30 aa, Artificial Sequence
  Description of Artificial Sequence: Synthetic polypeptide
DEEEISATNPCATEQYGSVSTTNLQLQGNR

SEQ ID NO: 35383 - protein, 28 aa, Artificial Sequence
  Description of Artificial Sequence: Synthetic peptide
QEPEIRTTNPVATEQYGWVSENLQMGNT

SEQ ID NO: 35384 - protein, 28 aa, Artificial Sequence
  Description of Artificial Sequence: Synthetic peptide
DEEEISTTNPESTECYGSVSTDLQRGTR

SEQ ID NO: 35385 - protein, 28 aa, Artificial Sequence
  Description of Artificial Sequence: Synthetic peptide
SEDEIRTTNPAATEQYGEVSENWQRGNR

SEQ ID NO: 35386 - protein, 28 aa, Artificial Sequence
  Description of Artificial Sequence: Synthetic peptide
DEEEIRATNPTATEQYGSVSNNVQFGDR

SEQ ID NO: 35387 - protein, 30 aa, Artificial Sequence
  Description of Artificial Sequence: Synthetic polypeptide
DEEEIATTNPDASEQYGSVSMTNLQSRGNA

SEQ ID NO: 35388 - protein, 29 aa, Artificial Sequence
  Description of Artificial Sequence: Synthetic peptide
DENEIVCTNPVATECYGSVSTNLQERGNQ

SEQ ID NO: 35389 - protein, 28 aa, Artificial Sequence
  Description of Artificial Sequence: Synthetic peptide
DEEEIRTTNPDATEQYGSVSTDGERGEI

SEQ ID NO: 35390 - protein, 30 aa, Artificial Sequence
  Description of Artificial Sequence: Synthetic polypeptide
QEPEIRTTNPVATEQYGSVSAENLQFVGNR

SEQ ID NO: 35391 - protein, 30 aa, Artificial Sequence
  Description of Artificial Sequence: Synthetic polypeptide
DEEEIRTTNPVATEQYGSVSATDLEHEGNL

SEQ ID NO: 35392 - protein, 30 aa, Artificial Sequence
  Description of Artificial Sequence: Synthetic polypeptide
QEEEIATTNPVATEQYGSVSDTNLEGEGNR

SEQ ID NO: 35393 - protein, 29 aa, Artificial Sequence
  Description of Artificial Sequence: Synthetic peptide
DEEEIATTNPVATEQYGSVSDTELEPGNL

SEQ ID NO: 35394 - protein, 31 aa, Artificial Sequence
  Description of Artificial Sequence: Synthetic polypeptide
DEEEIRTTNPVATEQYGESYVDTWNEQRGDR

SEQ ID NO: 35395 - protein, 29 aa, Artificial Sequence
  Description of Artificial Sequence: Synthetic peptide
DEEEIRTTNPVSTEQYGSVSTNLEVNGTA

SEQ ID NO: 35396 - protein, 29 aa, Artificial Sequence
  Description of Artificial Sequence: Synthetic peptide
QEEEIRTTNPVATEQYGGVSSNLQNNGNQ

SEQ ID NO: 35397 - protein, 30 aa, Artificial Sequence
  Description of Artificial Sequence: Synthetic polypeptide
DEEEIRTTNPCATELYGSVSTGALQVGDNR

SEQ ID NO: 35398 - protein, 30 aa, Artificial Sequence
  Description of Artificial Sequence: Synthetic polypeptide
DEEEIRTTNPVATEQYGSVSTDLEDLEGNQ

SEQ ID NO: 35399 - protein, 31 aa, Artificial Sequence
  Description of Artificial Sequence: Synthetic polypeptide
DEEEIRTTNPVATECYGSVSTNLQIHNGEER

SEQ ID NO: 35400 - protein, 30 aa, Artificial Sequence
  Description of Artificial Sequence: Synthetic polypeptide
DNEEIRSTNPVATEQYGSVSTNEQREGDPR

SEQ ID NO: 35401 - protein, 28 aa, Artificial Sequence
  Description of Artificial Sequence: Synthetic peptide
DEQEIRTTNPVATEQYGSVETNLDWGDV

SEQ ID NO: 35402 - protein, 30 aa, Artificial Sequence
  Description of Artificial Sequence: Synthetic polypeptide
DEEVIRTTNPVATEQYGSYVSDNDPQRGNP

SEQ ID NO: 35403 - protein, 28 aa, Artificial Sequence
  Description of Artificial Sequence: Synthetic peptide
DEQEIRTTNPVATEIYGVVSTELQYGNI

SEQ ID NO: 35404 - protein, 28 aa, Artificial Sequence
  Description of Artificial Sequence: Synthetic peptide
DEQEIRTTNPVATEQYGSVSTNDEYGEG

SEQ ID NO: 35405 - protein, 28 aa, Artificial Sequence
  Description of Artificial Sequence: Synthetic peptide
DEQEIRTTNPVATEQYGIVSENLMLGNA

SEQ ID NO: 35406 - protein, 30 aa, Artificial Sequence
  Description of Artificial Sequence: Synthetic polypeptide
DEEEIRTTNPVATEQYGSVSEMDLQVGNDS

SEQ ID NO: 35407 - protein, 28 aa, Artificial Sequence
  Description of Artificial Sequence: Synthetic peptide
DEEEIRTTNPDATEQYGSVSTNGLLGEM

SEQ ID NO: 35408 - protein, 28 aa, Artificial Sequence
  Description of Artificial Sequence: Synthetic peptide
DEQEVRCTNPVATEIYGSVATNLERGNR

SEQ ID NO: 35409 - protein, 28 aa, Artificial Sequence
  Description of Artificial Sequence: Synthetic peptide
DEEEIRTTNPTATEQYGSVSTELCHLNC

SEQ ID NO: 35410 - protein, 28 aa, Artificial Sequence
  Description of Artificial Sequence: Synthetic peptide
DENEIRTTNPVATECYGSVSENLQLGTS

SEQ ID NO: 35411 - protein, 29 aa, Artificial Sequence
  Description of Artificial Sequence: Synthetic peptide
DEEEIRTTNPVATEQWGEVSENEQRKGHR

SEQ ID NO: 35412 - protein, 30 aa, Artificial Sequence
  Description of Artificial Sequence: Synthetic polypeptide
DEEEIRTTNPVATEQYGSVSTELQETDGDY

SEQ ID NO: 35413 - protein, 28 aa, Artificial Sequence
  Description of Artificial Sequence: Synthetic peptide
DEEEIRTTNPFATEQYGSVSTCDIRGES

SEQ ID NO: 35414 - protein, 28 aa, Artificial Sequence
  Description of Artificial Sequence: Synthetic peptide
DEAEIRTTNPVASEQYGSTGTNLQNGDR

SEQ ID NO: 35415 - protein, 29 aa, Artificial Sequence
  Description of Artificial Sequence: Synthetic peptide
DENEIRTTNPVATECYGSVSTDLQENGNM

SEQ ID NO: 35416 - protein, 28 aa, Artificial Sequence
  Description of Artificial Sequence: Synthetic peptide
DEEEIRTVNPVATEQYGSVSEDLQAGDD

SEQ ID NO: 35417 - protein, 28 aa, Artificial Sequence
  Description of Artificial Sequence: Synthetic peptide
DEEEIRTTNPVATEQYGSHSQNDSRGEM

SEQ ID NO: 35418 - protein, 29 aa, Artificial Sequence
  Description of Artificial Sequence: Synthetic peptide
DENEIRTTNPVSTEQWGSVSTNLMRGNDF

SEQ ID NO: 35419 - protein, 30 aa, Artificial Sequence
  Description of Artificial Sequence: Synthetic polypeptide
DEEEIATTNPVATEQYGSVSTMNEQLQGNA

SEQ ID NO: 35420 - protein, 28 aa, Artificial Sequence
  Description of Artificial Sequence: Synthetic peptide
DECEIRTTNPVATEQYGSVSTNLFQDEF

SEQ ID NO: 35421 - protein, 33 aa, Artificial Sequence
  Description of Artificial Sequence: Synthetic polypeptide
DEEEIRTTNPVATEQYGSVDSETINDVQRKGNR

SEQ ID NO: 35422 - protein, 32 aa, Artificial Sequence
  Description of Artificial Sequence: Synthetic polypeptide
DEEEIRTTNPVATEQYGSVETPNLQVQGDNER

SEQ ID NO: 35423 - protein, 31 aa, Artificial Sequence
  Description of Artificial Sequence: Synthetic polypeptide
DEEEIRTTNPVATEQYGSVDCTMNLQHGNDD

SEQ ID NO: 35424 - protein, 28 aa, Artificial Sequence
  Description of Artificial Sequence: Synthetic peptide
DEVEIATTNPTATEQYGSVSTNEQQGNF

SEQ ID NO: 35425 - protein, 28 aa, Artificial Sequence
  Description of Artificial Sequence: Synthetic peptide
DEEEIRATNPVATECYGSTSTALERGNL

SEQ ID NO: 35426 - protein, 32 aa, Artificial Sequence
  Description of Artificial Sequence: Synthetic polypeptide
DEEEIRTTNPVATEQYGSVDETDNLQVIGNDR

SEQ ID NO: 35427 - protein, 28 aa, Artificial Sequence
  Description of Artificial Sequence: Synthetic peptide
DEEEIRTTNPVATEQYGSMSTDLDYGEA

SEQ ID NO: 35428 - protein, 28 aa, Artificial Sequence
  Description of Artificial Sequence: Synthetic peptide
DEEEIRTTNPEATEQYGSVSTELFFGDS

SEQ ID NO: 35429 - protein, 31 aa, Artificial Sequence
  Description of Artificial Sequence: Synthetic polypeptide
DEEEITTTNPVATEQYGSVSITNPTQDRGER

SEQ ID NO: 35430 - protein, 28 aa, Artificial Sequence
  Description of Artificial Sequence: Synthetic peptide
DEEEIRTTNPVATEQYGSVSTNDEFEDS

SEQ ID NO: 35431 - protein, 33 aa, Artificial Sequence
  Description of Artificial Sequence: Synthetic polypeptide
DEEEIRTTNPVATEQYGSVDSDTDPLQRNGNPR

SEQ ID NO: 35432 - protein, 28 aa, Artificial Sequence
  Description of Artificial Sequence: Synthetic peptide
DEEEITTTNPVATEVYGAVSTNEQVGNT

SEQ ID NO: 35433 - protein, 30 aa, Artificial Sequence
  Description of Artificial Sequence: Synthetic polypeptide
DEEEIRTTNPVATECYGSVSVNLPQREPNY

SEQ ID NO: 35434 - protein, 28 aa, Artificial Sequence
  Description of Artificial Sequence: Synthetic peptide
AEEEISTTNPVATEQYGNVGTNLQRGTQ

SEQ ID NO: 35435 - protein, 28 aa, Artificial Sequence
  Description of Artificial Sequence: Synthetic peptide
QEEEISTTNPVATEQYGWVSTNLQNGEG

SEQ ID NO: 35436 - protein, 28 aa, Artificial Sequence
  Description of Artificial Sequence: Synthetic peptide
DEEEIRTTNPVATEQYGVVSTALEQGEH

SEQ ID NO: 35437 - protein, 31 aa, Artificial Sequence
  Description of Artificial Sequence: Synthetic polypeptide
DEEEIRTTNPVATEQYGSVSTVNLQADENYW

SEQ ID NO: 35438 - protein, 30 aa, Artificial Sequence
  Description of Artificial Sequence: Synthetic polypeptide
DEEEIRTTNPVATEQYGEVSTMNLQHGDDN

SEQ ID NO: 35439 - protein, 29 aa, Artificial Sequence
  Description of Artificial Sequence: Synthetic peptide
DEEEIATTNPCATEQYGAVSTNDQVGNDR

SEQ ID NO: 35440 - protein, 29 aa, Artificial Sequence
  Description of Artificial Sequence: Synthetic peptide
DEEEIRTTNPVSTEQWGIVSTNLMMRGNA

SEQ ID NO: 35441 - protein, 28 aa, Artificial Sequence
  Description of Artificial Sequence: Synthetic peptide
QEEEIRTTNPVATELYGVVSTPLQRGEE

SEQ ID NO: 35442 - protein, 33 aa, Artificial Sequence
  Description of Artificial Sequence: Synthetic polypeptide
DEEEIRTTNPVATEQYGSVESTENGLQIRGENE

SEQ ID NO: 35443 - protein, 28 aa, Artificial Sequence
  Description of Artificial Sequence: Synthetic peptide
DEMEIRTTNPVATEPYGDVSFNLARGNF

SEQ ID NO: 35444 - protein, 31 aa, Artificial Sequence
  Description of Artificial Sequence: Synthetic polypeptide
DENEIRTTNPVATEQYGSVSTNLQENEGNDM

SEQ ID NO: 35445 - protein, 30 aa, Artificial Sequence
  Description of Artificial Sequence: Synthetic polypeptide
DEEEIYCTNPVATEQYGSVSTNLQLTEGNN

SEQ ID NO: 35446 - protein, 32 aa, Artificial Sequence
  Description of Artificial Sequence: Synthetic polypeptide
DEEEIRTTNPVATEQYGSVVSTMNDVQRFGLR

SEQ ID NO: 35447 - protein, 29 aa, Artificial Sequence
  Description of Artificial Sequence: Synthetic peptide
DEEEIRTTNPVATEQYGSVSEMDLQQGDM

SEQ ID NO: 35448 - protein, 31 aa, Artificial Sequence
  Description of Artificial Sequence: Synthetic polypeptide
SEEEIRTTNPVATEQYGSVSTANPQRGDNTH

SEQ ID NO: 35449 - protein, 28 aa, Artificial Sequence
  Description of Artificial Sequence: Synthetic peptide
DEEEIRTTNPCATEPYGSVSTAEQWGNE

SEQ ID NO: 35450 - protein, 29 aa, Artificial Sequence
  Description of Artificial Sequence: Synthetic peptide
KEEEIRTTNPVATECYGSVSTDLQTEGNI

SEQ ID NO: 35451 - protein, 31 aa, Artificial Sequence
  Description of Artificial Sequence: Synthetic polypeptide
DEEEIRTTNPDATEQYGSVSTNGQQYEGMNR

SEQ ID NO: 35452 - protein, 29 aa, Artificial Sequence
  Description of Artificial Sequence: Synthetic peptide
DEEEIRCTNPVATEQYGSYSTNLQIQGTL

SEQ ID NO: 35453 - protein, 28 aa, Artificial Sequence
  Description of Artificial Sequence: Synthetic peptide
DPEEIRPTNPVATEQYGFVSENDQDGNR

SEQ ID NO: 35454 - protein, 28 aa, Artificial Sequence
  Description of Artificial Sequence: Synthetic peptide
DEEEIATTNPVATEQYGSVSTDQEVGND

SEQ ID NO: 35455 - protein, 28 aa, Artificial Sequence
  Description of Artificial Sequence: Synthetic peptide
DEQEIRTTNPVATEQYGSVSTDLEQGEF

SEQ ID NO: 35456 - protein, 32 aa, Artificial Sequence
  Description of Artificial Sequence: Synthetic polypeptide
DEEEIRTTNPVATEQYGSVSATNLQEDNGNDD

SEQ ID NO: 35457 - protein, 29 aa, Artificial Sequence
  Description of Artificial Sequence: Synthetic peptide
DEDEIRTTNPVSTEIYGCVSTNLQPNGNR

SEQ ID NO: 35458 - protein, 28 aa, Artificial Sequence
  Description of Artificial Sequence: Synthetic peptide
DEQEIRTTNPVATEQYGSVSTDDQNGEN

SEQ ID NO: 35459 - protein, 29 aa, Artificial Sequence
  Description of Artificial Sequence: Synthetic peptide
DEEEIRTTNPVATEQYGWVSNELQYFGNA

SEQ ID NO: 35460 - protein, 29 aa, Artificial Sequence
  Description of Artificial Sequence: Synthetic peptide
DEQEIRCTNPVATEQYGSVSENEQNRGTR

SEQ ID NO: 35461 - protein, 28 aa, Artificial Sequence
  Description of Artificial Sequence: Synthetic peptide
DENEIAAVNPVATECYGSVSTELQRGNR

SEQ ID NO: 35462 - protein, 28 aa, Artificial Sequence
  Description of Artificial Sequence: Synthetic peptide
QEEEIAQTNPVATEQYGSASTNLQHENR

SEQ ID NO: 35463 - protein, 29 aa, Artificial Sequence
  Description of Artificial Sequence: Synthetic peptide
REEEIRTTNPVATEQYGSSVDTNLQQGIP

SEQ ID NO: 35464 - protein, 30 aa, Artificial Sequence
  Description of Artificial Sequence: Synthetic polypeptide
DEQEVRCTNPVATEQYGSVSATNLERNGNR

SEQ ID NO: 35465 - protein, 28 aa, Artificial Sequence
  Description of Artificial Sequence: Synthetic peptide
DEEEIRTTNPVATEQYGSVSTCQDREDV

SEQ ID NO: 35466 - protein, 28 aa, Artificial Sequence
  Description of Artificial Sequence: Synthetic peptide
DEEEIRTTNPVATEQYGSVDTNDEIGES

SEQ ID NO: 35467 - protein, 30 aa, Artificial Sequence
  Description of Artificial Sequence: Synthetic polypeptide
DESEIRTTNPVATEQYGSVSENLQDQGNDN

SEQ ID NO: 35468 - protein, 28 aa, Artificial Sequence
  Description of Artificial Sequence: Synthetic peptide
DEEPIRTTNPVATEQYGEISTNLDRPND

SEQ ID NO: 35469 - protein, 28 aa, Artificial Sequence
  Description of Artificial Sequence: Synthetic peptide
DEEEIRTTNPVATEQYGSVSDNEQNEES

SEQ ID NO: 35470 - protein, 32 aa, Artificial Sequence
  Description of Artificial Sequence: Synthetic polypeptide
DEEEIRTTNPVATEQYGWVASTDGLQMRGNPR

SEQ ID NO: 35471 - protein, 28 aa, Artificial Sequence
  Description of Artificial Sequence: Synthetic peptide
DEEEICTTNPVSTEQYGSVATNICDGNR

SEQ ID NO: 35472 - protein, 31 aa, Artificial Sequence
  Description of Artificial Sequence: Synthetic polypeptide
DEEEIRTTNPVATELYGSVSSNLQQTLGNDR

SEQ ID NO: 35473 - protein, 28 aa, Artificial Sequence
  Description of Artificial Sequence: Synthetic peptide
DEEEIRTTNPVATEQYGSVAEDLQIGEM

SEQ ID NO: 35474 - protein, 28 aa, Artificial Sequence
  Description of Artificial Sequence: Synthetic peptide
DEEEIRTTNPFATEQYGSVSTAGLRGEM

SEQ ID NO: 35475 - protein, 28 aa, Artificial Sequence
  Description of Artificial Sequence: Synthetic peptide
DEPEIWTTNPVATEGYGAVSDNLQRGNT

SEQ ID NO: 35476 - protein, 28 aa, Artificial Sequence
  Description of Artificial Sequence: Synthetic peptide
DEEEIRTTNPIATEMYGSVSTDQQGGND

SEQ ID NO: 35477 - protein, 28 aa, Artificial Sequence
  Description of Artificial Sequence: Synthetic peptide
KEEEIRATNPVATEQYGSMSTDLQYGDR

SEQ ID NO: 35478 - protein, 30 aa, Artificial Sequence
  Description of Artificial Sequence: Synthetic polypeptide
DEEEIMTTNPEATECYGSVSANLQSREGNR

SEQ ID NO: 35479 - protein, 28 aa, Artificial Sequence
  Description of Artificial Sequence: Synthetic peptide
MEEEIRCTNPEATEQYGSVSTNEQRGDH

SEQ ID NO: 35480 - protein, 29 aa, Artificial Sequence
  Description of Artificial Sequence: Synthetic peptide
DEEEIRCTNPCSTEMYGSVSATNLQHGNR

SEQ ID NO: 35481 - protein, 28 aa, Artificial Sequence
  Description of Artificial Sequence: Synthetic peptide
DEEEIRSTNPVATEQYGVVSTPLETGNN

SEQ ID NO: 35482 - protein, 30 aa, Artificial Sequence
  Description of Artificial Sequence: Synthetic polypeptide
DEEEIRTTNPVATEQWGSVSTNDMLGGNDR

SEQ ID NO: 35483 - protein, 28 aa, Artificial Sequence
  Description of Artificial Sequence: Synthetic peptide
QEEEIATTNPVATEQYGSVSECLQRENN

SEQ ID NO: 35484 - protein, 28 aa, Artificial Sequence
  Description of Artificial Sequence: Synthetic peptide
DEEEIRTTNPVATEQYGSVETDDELGNS

SEQ ID NO: 35485 - protein, 28 aa, Artificial Sequence
  Description of Artificial Sequence: Synthetic peptide
QEEEIRATNPVGTEQYGSVSTNLQSGLI

SEQ ID NO: 35486 - protein, 28 aa, Artificial Sequence
  Description of Artificial Sequence: Synthetic peptide
DEEEIRTTNPDATEQYGSVSTDLDWGDD

SEQ ID NO: 35487 - protein, 28 aa, Artificial Sequence
  Description of Artificial Sequence: Synthetic peptide
DEQEIRTTNPVATEQYGSVSTDDENGNG

SEQ ID NO: 35488 - protein, 31 aa, Artificial Sequence
  Description of Artificial Sequence: Synthetic polypeptide
DEEEIRTTNPVATEQYGVVCSTNLQFGENDY

SEQ ID NO: 35489 - protein, 28 aa, Artificial Sequence
  Description of Artificial Sequence: Synthetic peptide
NEEEIRTTNPDATEQYGSVSTCLDIGER

SEQ ID NO: 35490 - protein, 32 aa, Artificial Sequence
  Description of Artificial Sequence: Synthetic polypeptide
DEEEIRTTNPVATEQYGSVSTTNDVERGDNDR

SEQ ID NO: 35491 - protein, 29 aa, Artificial Sequence
  Description of Artificial Sequence: Synthetic peptide
DENEVTTTNPVATEQYGSVSTNLQQEGNN

SEQ ID NO: 35492 - protein, 31 aa, Artificial Sequence
  Description of Artificial Sequence: Synthetic polypeptide
DEEEIRCTNPVATENYGSVSLNNLPQRGDNR

SEQ ID NO: 35493 - protein, 29 aa, Artificial Sequence
  Description of Artificial Sequence: Synthetic peptide
DEEEIRTTNPVATEQYGDVSTCLQVAGEY

SEQ ID NO: 35494 - protein, 30 aa, Artificial Sequence
  Description of Artificial Sequence: Synthetic polypeptide
DEEEIRATNPVATEQYGSTGSNLQTRGNDR

SEQ ID NO: 35495 - protein, 28 aa, Artificial Sequence
  Description of Artificial Sequence: Synthetic peptide
DEEEITTTNPVATEQYGVVSTDLQMGEM

SEQ ID NO: 35496 - protein, 32 aa, Artificial Sequence
  Description of Artificial Sequence: Synthetic polypeptide
DEEEIRTTNPVATEQYGSVSATNLQLDNGNDD

SEQ ID NO: 35497 - protein, 30 aa, Artificial Sequence
  Description of Artificial Sequence: Synthetic polypeptide
DEEEIRTTNPVATEQYGDVSCENLQCLGNE

SEQ ID NO: 35498 - protein, 28 aa, Artificial Sequence
  Description of Artificial Sequence: Synthetic peptide
DEEECNTTNPVATEQYGSVSDNLQDVNA

SEQ ID NO: 35499 - protein, 28 aa, Artificial Sequence
  Description of Artificial Sequence: Synthetic peptide
DEEEIRTTNPDATEQYGSVSYNLMIGDT

SEQ ID NO: 35500 - protein, 28 aa, Artificial Sequence
  Description of Artificial Sequence: Synthetic peptide
DDEEIRTTNPVATEQYGIVHENSQQGNR

SEQ ID NO: 35501 - protein, 30 aa, Artificial Sequence
  Description of Artificial Sequence: Synthetic polypeptide
DEEEIRCTNPVASEIYGSVAATNLQRNGNR

SEQ ID NO: 35502 - protein, 30 aa, Artificial Sequence
  Description of Artificial Sequence: Synthetic polypeptide
DEEEIRCTNPVATEQYGSVSTGNLPQSGTS

SEQ ID NO: 35503 - protein, 30 aa, Artificial Sequence
  Description of Artificial Sequence: Synthetic polypeptide
DEEEIRTTNPEATEQYGSVSTEEQDFKGNR

SEQ ID NO: 35504 - protein, 31 aa, Artificial Sequence
  Description of Artificial Sequence: Synthetic polypeptide
DEEEIRTTNPVATEQYGSVSTDPDQLNGDNR

SEQ ID NO: 35505 - protein, 30 aa, Artificial Sequence
  Description of Artificial Sequence: Synthetic polypeptide
DEEEIRTTNPVATEQYGSVDCTEAEQFGNR

SEQ ID NO: 35506 - protein, 28 aa, Artificial Sequence
  Description of Artificial Sequence: Synthetic peptide
DENEIAQTNPVATEQYGSVSTCLQRENL

SEQ ID NO: 35507 - protein, 30 aa, Artificial Sequence
  Description of Artificial Sequence: Synthetic polypeptide
KEQEIRTTNPVATEQYGWVSTNLQSEGNDR

SEQ ID NO: 35508 - protein, 30 aa, Artificial Sequence
  Description of Artificial Sequence: Synthetic polypeptide
DENEIRTTNPVATEQYGSVSTDLQEAGNDQ

SEQ ID NO: 35509 - protein, 28 aa, Artificial Sequence
  Description of Artificial Sequence: Synthetic peptide
DEEEIRTTNPVATECYGSVSTDLEVGED

SEQ ID NO: 35510 - protein, 30 aa, Artificial Sequence
  Description of Artificial Sequence: Synthetic polypeptide
MEEEIRTTNPVATEQYGSVSENLQDTEGNM

SEQ ID NO: 35511 - protein, 33 aa, Artificial Sequence
  Description of Artificial Sequence: Synthetic polypeptide
DEEEIRTTNPVATEQYGSVSTTTNLELRGENDR

SEQ ID NO: 35512 - protein, 28 aa, Artificial Sequence
  Description of Artificial Sequence: Synthetic peptide
MEEEIATTNPVATEQYGSVSEDLQNGNW

SEQ ID NO: 35513 - protein, 30 aa, Artificial Sequence
  Description of Artificial Sequence: Synthetic polypeptide
DEEEIATTNPTATEQYGSVSTMNLQNGDNL

SEQ ID NO: 35514 - protein, 30 aa, Artificial Sequence
  Description of Artificial Sequence: Synthetic polypeptide
DEEEIRTVNPVATEQYGWVSTNLQDGGNDA

SEQ ID NO: 35515 - protein, 30 aa, Artificial Sequence
  Description of Artificial Sequence: Synthetic polypeptide
DEEEIRTTNPAATEQYGSVISTNWQDSGNS

SEQ ID NO: 35516 - protein, 28 aa, Artificial Sequence
  Description of Artificial Sequence: Synthetic peptide
SEEEIRTTNPAATETYGSVSTNEQRGTQ

SEQ ID NO: 35517 - protein, 28 aa, Artificial Sequence
  Description of Artificial Sequence: Synthetic peptide
DEEEIRCTNPVATEQYGSVSTDPQFGDY

SEQ ID NO: 35518 - protein, 28 aa, Artificial Sequence
  Description of Artificial Sequence: Synthetic peptide
NEEEVRATNPVATEHYGNVSNNLQRGNR

SEQ ID NO: 35519 - protein, 29 aa, Artificial Sequence
  Description of Artificial Sequence: Synthetic peptide
DEEEIRTTNPVSTEQYGIVSTNLEMLGTR

SEQ ID NO: 35520 - protein, 32 aa, Artificial Sequence
  Description of Artificial Sequence: Synthetic polypeptide
DEEEIRTTNPVATEQYGSVCGWMNELQRNGNR

SEQ ID NO: 35521 - protein, 28 aa, Artificial Sequence
  Description of Artificial Sequence: Synthetic peptide
SEEEIRTTNPTATEQYGSVSTNEQNGTE

SEQ ID NO: 35522 - protein, 30 aa, Artificial Sequence
  Description of Artificial Sequence: Synthetic polypeptide
DEEEIRTTNPVATEMFGSVSTLNLQSEGNA

SEQ ID NO: 35523 - protein, 29 aa, Artificial Sequence
  Description of Artificial Sequence: Synthetic peptide
DEEEIATTNPVATEQYGSVSTDLQEHGEM

SEQ ID NO: 35524 - protein, 28 aa, Artificial Sequence
  Description of Artificial Sequence: Synthetic peptide
SEEEIRATNPFATEQYGSVSTGLDRGNQ

SEQ ID NO: 35525 - protein, 29 aa, Artificial Sequence
  Description of Artificial Sequence: Synthetic peptide
DEEEIATVNPVATEQYGSVSENLQVEGNL

SEQ ID NO: 35526 - protein, 29 aa, Artificial Sequence
  Description of Artificial Sequence: Synthetic peptide
DEEEIRTTNPVATEQYGSVDDTELQSGDL

SEQ ID NO: 35527 - protein, 28 aa, Artificial Sequence
  Description of Artificial Sequence: Synthetic peptide
DENEIATTNPVATEQYGSVDTDDQRGNY

SEQ ID NO: 35528 - protein, 28 aa, Artificial Sequence
  Description of Artificial Sequence: Synthetic peptide
DEEEIVTTNPVATEWYGSVSTEPQVGNQ

SEQ ID NO: 35529 - protein, 28 aa, Artificial Sequence
  Description of Artificial Sequence: Synthetic peptide
DENEIRTTNPVATEWWGIVSTNLMVGNR

SEQ ID NO: 35530 - protein, 31 aa, Artificial Sequence
  Description of Artificial Sequence: Synthetic polypeptide
DEEEIRTTNPVATEQYGSVSTNLEERNGEDQ

SEQ ID NO: 35531 - protein, 28 aa, Artificial Sequence
  Description of Artificial Sequence: Synthetic peptide
DEECIRTTNPVATEIYGCVSTNLDPPNR

SEQ ID NO: 35532 - protein, 28 aa, Artificial Sequence
  Description of Artificial Sequence: Synthetic peptide
DEEEIRTTNPVATEQYGSVETDDEIGNG

SEQ ID NO: 35533 - protein, 31 aa, Artificial Sequence
  Description of Artificial Sequence: Synthetic polypeptide
DEECIRTTNPVATEQYGSVESTNLINMVGNR

SEQ ID NO: 35534 - protein, 28 aa, Artificial Sequence
  Description of Artificial Sequence: Synthetic peptide
DEEEIATTNPVATECYGSVSTDLEHGER

SEQ ID NO: 35535 - protein, 28 aa, Artificial Sequence
  Description of Artificial Sequence: Synthetic peptide
HEEEIRTTNPVATEQYGSYSTNLQVHAF

SEQ ID NO: 35536 - protein, 28 aa, Artificial Sequence
  Description of Artificial Sequence: Synthetic peptide
SENEIRTTNPVATEQGGEVSTNLQRGTL

SEQ ID NO: 35537 - protein, 28 aa, Artificial Sequence
  Description of Artificial Sequence: Synthetic peptide
DEEEIRTTNPVGTEQYGLVSANGQRGPS

SEQ ID NO: 35538 - protein, 31 aa, Artificial Sequence
  Description of Artificial Sequence: Synthetic polypeptide
DEEEIRTTNPVATEQYGSVTSDTNLDPGENP

SEQ ID NO: 35539 - protein, 28 aa, Artificial Sequence
  Description of Artificial Sequence: Synthetic peptide
KEEEIRTTNPVAVEQYGSVSTELQGGDL

SEQ ID NO: 35540 - protein, 28 aa, Artificial Sequence
  Description of Artificial Sequence: Synthetic peptide
DEEEIRCTNPVASEQYGSCSTGVQRGQR

SEQ ID NO: 35541 - protein, 28 aa, Artificial Sequence
  Description of Artificial Sequence: Synthetic peptide
DEQEIRQTNPVSTEQYGEVSTVLQHGNR

SEQ ID NO: 35542 - protein, 31 aa, Artificial Sequence
  Description of Artificial Sequence: Synthetic polypeptide
DEEEISTTNPVATEQYGTVSAALNLQLRGNR

SEQ ID NO: 35543 - protein, 31 aa, Artificial Sequence
  Description of Artificial Sequence: Synthetic polypeptide
DEEEIRTTNPVATEQYGSVDCTMELQQRGND

SEQ ID NO: 35544 - protein, 31 aa, Artificial Sequence
  Description of Artificial Sequence: Synthetic polypeptide
DEEEIRTTNPVATECYGSVSTDLQDHEGNDR

SEQ ID NO: 35545 - protein, 29 aa, Artificial Sequence
  Description of Artificial Sequence: Synthetic peptide
DESEIRTTNPVSTEQYGSVSTDLQPEGNT

SEQ ID NO: 35546 - protein, 30 aa, Artificial Sequence
  Description of Artificial Sequence: Synthetic polypeptide
DEEEIRTTNPDATEQYGSVSTYQQTRGENV

SEQ ID NO: 35547 - protein, 30 aa, Artificial Sequence
  Description of Artificial Sequence: Synthetic polypeptide
DEEEIRTTNPVATECYGSVSATDLQDRGEL

SEQ ID NO: 35548 - protein, 28 aa, Artificial Sequence
  Description of Artificial Sequence: Synthetic peptide
KEQEIRTTNPVATECYGSVSTDLQGGNQ

SEQ ID NO: 35549 - protein, 31 aa, Artificial Sequence
  Description of Artificial Sequence: Synthetic polypeptide
DEEEIRTTNPVATEQYGSVDSTPLPLDRGNW

SEQ ID NO: 35550 - protein, 29 aa, Artificial Sequence
  Description of Artificial Sequence: Synthetic peptide
DEEEIRTTNPVATEQWGSVDTNLMMTGTR

SEQ ID NO: 35551 - protein, 29 aa, Artificial Sequence
  Description of Artificial Sequence: Synthetic peptide
DEEEIRTTNPVATECYGSVSDTELQQGES

SEQ ID NO: 35552 - protein, 28 aa, Artificial Sequence
  Description of Artificial Sequence: Synthetic peptide
DEEEIATTNPVATECYGSVSTDLQQGEN

SEQ ID NO: 35553 - protein, 30 aa, Artificial Sequence
  Description of Artificial Sequence: Synthetic polypeptide
DEEEIRCTNPVASEQYGSVSANNLERNGNR

SEQ ID NO: 35554 - protein, 28 aa, Artificial Sequence
  Description of Artificial Sequence: Synthetic peptide
DEEEIRTTNPVATEQYGSVFENDCDGNC

SEQ ID NO: 35555 - protein, 31 aa, Artificial Sequence
  Description of Artificial Sequence: Synthetic polypeptide
DEEEIRTTNPVATSQYGSVASTNNLQRGEDL

SEQ ID NO: 35556 - protein, 29 aa, Artificial Sequence
  Description of Artificial Sequence: Synthetic peptide
DEEEIRATNPVATEQYGSVSTDLQESGEM

SEQ ID NO: 35557 - protein, 28 aa, Artificial Sequence
  Description of Artificial Sequence: Synthetic peptide
HEEEIRSTNPCATECYGSVANNLQRGNR

SEQ ID NO: 35558 - protein, 31 aa, Artificial Sequence
  Description of Artificial Sequence: Synthetic polypeptide
DEEEIGTTNPHATEQYGSVVSENLQERGNHR

SEQ ID NO: 35559 - protein, 28 aa, Artificial Sequence
  Description of Artificial Sequence: Synthetic peptide
DEEEIRTTNPVATECYGSVSENEEGGTR

SEQ ID NO: 35560 - protein, 30 aa, Artificial Sequence
  Description of Artificial Sequence: Synthetic polypeptide
DEEEIRATNPTATEQYGGVSTNLQQEGDNR

SEQ ID NO: 35561 - protein, 28 aa, Artificial Sequence
  Description of Artificial Sequence: Synthetic peptide
DEEEIKTTNPVATCQYGSVSSNGDRGNL

SEQ ID NO: 35562 - protein, 29 aa, Artificial Sequence
  Description of Artificial Sequence: Synthetic peptide
DEVEIATTNPVATEQFGSVSTNEQRGNDS

SEQ ID NO: 35563 - protein, 30 aa, Artificial Sequence
  Description of Artificial Sequence: Synthetic polypeptide
DEQEIVTTNPVATEQYGWVAATTNLQRGNR

SEQ ID NO: 35564 - protein, 28 aa, Artificial Sequence
  Description of Artificial Sequence: Synthetic peptide
DEEEIRTTNPEATEQYGSVSTDQNHGNS

SEQ ID NO: 35565 - protein, 28 aa, Artificial Sequence
  Description of Artificial Sequence: Synthetic peptide
DEVEIVTTNPTATEQYGSVSTNLQHGPF

SEQ ID NO: 35566 - protein, 28 aa, Artificial Sequence
  Description of Artificial Sequence: Synthetic peptide
DEEEIAATNPTATEQFGGVSTNLQVGNR

SEQ ID NO: 35567 - protein, 28 aa, Artificial Sequence
  Description of Artificial Sequence: Synthetic peptide
DEMEIRTVNPCATEQYGSTSTNLQQGNM

SEQ ID NO: 35568 - protein, 28 aa, Artificial Sequence
  Description of Artificial Sequence: Synthetic peptide
DEEEIRSTNPEATEQYGAVSENLQQGNF

SEQ ID NO: 35569 - protein, 30 aa, Artificial Sequence
  Description of Artificial Sequence: Synthetic polypeptide
DEEEIRTTNPTATEQYGSVSTMNEQQGDNV

SEQ ID NO: 35570 - protein, 30 aa, Artificial Sequence
  Description of Artificial Sequence: Synthetic polypeptide
KEEEIRTTNPVATEQYGSVSTDLQAEGNDA

SEQ ID NO: 35571 - protein, 32 aa, Artificial Sequence
  Description of Artificial Sequence: Synthetic polypeptide
DEEEIRTTNPVATEQYGMVYVSTNLDLRGDNR

SEQ ID NO: 35572 - protein, 28 aa, Artificial Sequence
  Description of Artificial Sequence: Synthetic peptide
DEEEIATTNPVATECYGSVSTDLQHGEN

SEQ ID NO: 35573 - protein, 28 aa, Artificial Sequence
  Description of Artificial Sequence: Synthetic peptide
DENEIRTTNPVATEWYGIVSENEQRGNF

SEQ ID NO: 35574 - protein, 28 aa, Artificial Sequence
  Description of Artificial Sequence: Synthetic peptide
TEEEIRTTNPVGTEQYGNVSENLMRGNA

SEQ ID NO: 35575 - protein, 28 aa, Artificial Sequence
  Description of Artificial Sequence: Synthetic peptide
NEEEIRTTNPEATEQYGSVSTNLINGEV

SEQ ID NO: 35576 - protein, 29 aa, Artificial Sequence
  Description of Artificial Sequence: Synthetic peptide
DEEEIRATNPVATEQYGVVSTNLQETGDY

SEQ ID NO: 35577 - protein, 31 aa, Artificial Sequence
  Description of Artificial Sequence: Synthetic polypeptide
VEEEIRTTNPVAYETYGSMVSTNLQLREGNR

SEQ ID NO: 35578 - protein, 28 aa, Artificial Sequence
  Description of Artificial Sequence: Synthetic peptide
DEYEIRTTNPVATEQYGEASVLLQRGMR

SEQ ID NO: 35579 - protein, 31 aa, Artificial Sequence
  Description of Artificial Sequence: Synthetic polypeptide
DEEEIRTTNPVATEQYGIVDVTGNLQRGNEV

SEQ ID NO: 35580 - protein, 28 aa, Artificial Sequence
  Description of Artificial Sequence: Synthetic peptide
MEEEIRTTNPVATEQYGSMSEDLQNGNM

SEQ ID NO: 35581 - protein, 29 aa, Artificial Sequence
  Description of Artificial Sequence: Synthetic peptide
DENEIRGTNPVATEQYGSVSTNGEQMGDR

SEQ ID NO: 35582 - protein, 29 aa, Artificial Sequence
  Description of Artificial Sequence: Synthetic peptide
DDEEIRATNPVATEQYGSVSVTNLERGEG

SEQ ID NO: 35583 - protein, 31 aa, Artificial Sequence
  Description of Artificial Sequence: Synthetic polypeptide
DEEEVRTTNPVATEQYGSVSDLNLQSKGENR

SEQ ID NO: 35584 - protein, 30 aa, Artificial Sequence
  Description of Artificial Sequence: Synthetic polypeptide
NEEEIRTTNPVATEQCGVVSTNLQREGDNG

SEQ ID NO: 35585 - protein, 31 aa, Artificial Sequence
  Description of Artificial Sequence: Synthetic polypeptide
DEEEIRTTNPDATEQYGSVTSDTADQRDGNR

SEQ ID NO: 35586 - protein, 28 aa, Artificial Sequence
  Description of Artificial Sequence: Synthetic peptide
DEQEIRTTNPVATECYGSVSMELQQGNH

SEQ ID NO: 35587 - protein, 29 aa, Artificial Sequence
  Description of Artificial Sequence: Synthetic peptide
KEEEIRTTNPVATEQYGSVFTPPDRGHNR

SEQ ID NO: 35588 - protein, 28 aa, Artificial Sequence
  Description of Artificial Sequence: Synthetic peptide
DEEEIRTTNPDATEQYGSVSTDDEAGNE

SEQ ID NO: 35589 - protein, 28 aa, Artificial Sequence
  Description of Artificial Sequence: Synthetic peptide
DEEEIRATNPVATECYGVVSTDLQGGDR

SEQ ID NO: 35590 - protein, 31 aa, Artificial Sequence
  Description of Artificial Sequence: Synthetic polypeptide
DEEEIRTTNPVATEQYGSVSDTENLQAGDET

SEQ ID NO: 35591 - protein, 30 aa, Artificial Sequence
  Description of Artificial Sequence: Synthetic polypeptide
DEEEIRTTNPEATEQYGSVSTINPEQRGES

SEQ ID NO: 35592 - protein, 29 aa, Artificial Sequence
  Description of Artificial Sequence: Synthetic peptide
DEEEIATTNPVATEMFGSASAENLQRGNR

SEQ ID NO: 35593 - protein, 29 aa, Artificial Sequence
  Description of Artificial Sequence: Synthetic peptide
DEEEIRTTNPVATEQYGSVSENPQFGPDI

SEQ ID NO: 35594 - protein, 31 aa, Artificial Sequence
  Description of Artificial Sequence: Synthetic polypeptide
DEEEIRTTNPVATEQYGSVSTIEPLQVRGEQ

SEQ ID NO: 35595 - protein, 29 aa, Artificial Sequence
  Description of Artificial Sequence: Synthetic peptide
DEEEIRTTNPVADEQYGSVPTNLQNREET

SEQ ID NO: 35596 - protein, 31 aa, Artificial Sequence
  Description of Artificial Sequence: Synthetic polypeptide
DEEEIRTTNPVATECYGSVVSITNPLQPGNP

SEQ ID NO: 35597 - protein, 29 aa, Artificial Sequence
  Description of Artificial Sequence: Synthetic peptide
DEEEIRTTNPVATEQWGIVSENLQMVGNQ

SEQ ID NO: 35598 - protein, 31 aa, Artificial Sequence
  Description of Artificial Sequence: Synthetic polypeptide
DEEEIRTTNPVATEQYGSVSTNKHQERDMIR

SEQ ID NO: 35599 - protein, 28 aa, Artificial Sequence
  Description of Artificial Sequence: Synthetic peptide
SGEEIRTTNPVATQQYGSVSTNPQNGER

SEQ ID NO: 35600 - protein, 28 aa, Artificial Sequence
  Description of Artificial Sequence: Synthetic peptide
DEEEIAQTNPVATEQYGSVSTGLEHGNQ

SEQ ID NO: 35601 - protein, 30 aa, Artificial Sequence
  Description of Artificial Sequence: Synthetic polypeptide
DEEEIRTTNPVATECYGSVSTNLQDDKGEA

SEQ ID NO: 35602 - protein, 31 aa, Artificial Sequence
  Description of Artificial Sequence: Synthetic polypeptide
DEEEIRTTNPVATEQYGSVSATDLEDRGEDR

SEQ ID NO: 35603 - protein, 28 aa, Artificial Sequence
  Description of Artificial Sequence: Synthetic peptide
MENEIRTTNPVATECYGSVSTDLQNGNM

SEQ ID NO: 35604 - protein, 32 aa, Artificial Sequence
  Description of Artificial Sequence: Synthetic polypeptide
DEEEIRTTNPTATEQYGSVSTANLQLIEGENR

SEQ ID NO: 35605 - protein, 32 aa, Artificial Sequence
  Description of Artificial Sequence: Synthetic polypeptide
DEEEIRTTNPVATEQYGSVSTINPEQDRGDNG

SEQ ID NO: 35606 - protein, 28 aa, Artificial Sequence
  Description of Artificial Sequence: Synthetic peptide
DEEVIRTTNPVATEGYGDVSENLMDGNR

SEQ ID NO: 35607 - protein, 28 aa, Artificial Sequence
  Description of Artificial Sequence: Synthetic peptide
DEEEIRTTNPVATEQYGEVSENLQAEEM

SEQ ID NO: 35608 - protein, 28 aa, Artificial Sequence
  Description of Artificial Sequence: Synthetic peptide
NDEEIGTTNPAATEQYGSVSENLQRGNM

SEQ ID NO: 35609 - protein, 28 aa, Artificial Sequence
  Description of Artificial Sequence: Synthetic peptide
DEENIRTTNPVATEQYGYVSDNLMRLNG

SEQ ID NO: 35610 - protein, 32 aa, Artificial Sequence
  Description of Artificial Sequence: Synthetic polypeptide
QEEEIRTTNPVATEQYGSVSTDLQIREGENDR

SEQ ID NO: 35611 - protein, 28 aa, Artificial Sequence
  Description of Artificial Sequence: Synthetic peptide
DEEEIRTTNPVATECYGWVSTDLEQGNA

SEQ ID NO: 35612 - protein, 28 aa, Artificial Sequence
  Description of Artificial Sequence: Synthetic peptide
GEEEIRTTNPVGTEQYGSVSCELQRGQM

SEQ ID NO: 35613 - protein, 28 aa, Artificial Sequence
  Description of Artificial Sequence: Synthetic peptide
YEEEIRTTNPVSTESYGSVCTNWQRENR

SEQ ID NO: 35614 - protein, 31 aa, Artificial Sequence
  Description of Artificial Sequence: Synthetic polypeptide
DEEEIRTTNPVATYQYGSVSETALQEPGNPR

SEQ ID NO: 35615 - protein, 30 aa, Artificial Sequence
  Description of Artificial Sequence: Synthetic polypeptide
DEVEIRTTNPVATEMYGSVSENLQDREGDR

SEQ ID NO: 35616 - protein, 30 aa, Artificial Sequence
  Description of Artificial Sequence: Synthetic polypeptide
DEEEIRATNPVATEQFGSVSTMNEQREGTR

SEQ ID NO: 35617 - protein, 30 aa, Artificial Sequence
  Description of Artificial Sequence: Synthetic polypeptide
DDEEIRTTNPVATEQYGSASTNLQDMEGNA

SEQ ID NO: 35618 - protein, 30 aa, Artificial Sequence
  Description of Artificial Sequence: Synthetic polypeptide
DEQEIRTTNPVATEQWGSVSENEQMRGNDR

SEQ ID NO: 35619 - protein, 33 aa, Artificial Sequence
  Description of Artificial Sequence: Synthetic polypeptide
DEEEIRTTNPVATEQYGSVSCTENLIQPRGLNL

SEQ ID NO: 35620 - protein, 29 aa, Artificial Sequence
  Description of Artificial Sequence: Synthetic peptide
SEEQIRPTNPVAYEQYGSYVSTNLQDGNR

SEQ ID NO: 35621 - protein, 30 aa, Artificial Sequence
  Description of Artificial Sequence: Synthetic polypeptide
DEEEIRTTNPTATEQYGSVSTANEQVGDNI

SEQ ID NO: 35622 - protein, 30 aa, Artificial Sequence
  Description of Artificial Sequence: Synthetic polypeptide
DEEEIRTTNPEATEGYGSVSTNPLQSGENH

SEQ ID NO: 35623 - protein, 32 aa, Artificial Sequence
  Description of Artificial Sequence: Synthetic polypeptide
DEEEIRTTNPVATEQYGSVSTNLQDIEGEEER

SEQ ID NO: 35624 - protein, 29 aa, Artificial Sequence
  Description of Artificial Sequence: Synthetic peptide
DEEEIRTTNPVATECYGTMSTELQREGND

SEQ ID NO: 35625 - protein, 28 aa, Artificial Sequence
  Description of Artificial Sequence: Synthetic peptide
MEEEIRTTNPVATEQYGIVSENLDFGMR

SEQ ID NO: 35626 - protein, 28 aa, Artificial Sequence
  Description of Artificial Sequence: Synthetic peptide
DEEEIRTTNPVATEQYGTVFSNKDRGNQ

SEQ ID NO: 35627 - protein, 29 aa, Artificial Sequence
  Description of Artificial Sequence: Synthetic peptide
DEEEIRTTNPVGTEVYGSVSEENLQFGNF

SEQ ID NO: 35628 - protein, 33 aa, Artificial Sequence
  Description of Artificial Sequence: Synthetic polypeptide
DEEEIRTTNPVATEQYGESVSETNLVQIRGNEY

SEQ ID NO: 35629 - protein, 29 aa, Artificial Sequence
  Description of Artificial Sequence: Synthetic peptide
DENEITTTNPVATEQYGSVSTVMLQIGNH

SEQ ID NO: 35630 - protein, 31 aa, Artificial Sequence
  Description of Artificial Sequence: Synthetic polypeptide
DEEEIRTTNPVATECYGSVSTELQDSGENDR

SEQ ID NO: 35631 - protein, 28 aa, Artificial Sequence
  Description of Artificial Sequence: Synthetic peptide
DEEEIRPTNPVATEQYGQVSTAIIRGND

SEQ ID NO: 35632 - protein, 32 aa, Artificial Sequence
  Description of Artificial Sequence: Synthetic polypeptide
DENEIRTTNPVATEQYGSVPSETNLQHKGNDR

SEQ ID NO: 35633 - protein, 31 aa, Artificial Sequence
  Description of Artificial Sequence: Synthetic polypeptide
SEEEIRTTNPVATEQYGSYSTNLQRNGENDQ

SEQ ID NO: 35634 - protein, 32 aa, Artificial Sequence
  Description of Artificial Sequence: Synthetic polypeptide
DEQEIRTTNPVATEQYGSVETNLVQREGENDR

SEQ ID NO: 35635 - protein, 32 aa, Artificial Sequence
  Description of Artificial Sequence: Synthetic polypeptide
DEGEIRTTNPVATEQYGSVSTANLQERGDTDR

SEQ ID NO: 35636 - protein, 30 aa, Artificial Sequence
  Description of Artificial Sequence: Synthetic polypeptide
SEVEIRTTNPVATEQYGGVISENLPQRGNR

SEQ ID NO: 35637 - protein, 31 aa, Artificial Sequence
  Description of Artificial Sequence: Synthetic polypeptide
DEEEIRATNPVATEVYGVVSTGNLQDRGDNR

SEQ ID NO: 35638 - protein, 28 aa, Artificial Sequence
  Description of Artificial Sequence: Synthetic peptide
DEEEIRATNPAATEMYGEVSTNEQRGNV

SEQ ID NO: 35639 - protein, 28 aa, Artificial Sequence
  Description of Artificial Sequence: Synthetic peptide
DEEEIRTTNPVATEQYGDVSENLMHGQQ

SEQ ID NO: 35640 - protein, 30 aa, Artificial Sequence
  Description of Artificial Sequence: Synthetic polypeptide
DENEIRTTNPCATEQYGDVSENLQRGGNDR

SEQ ID NO: 35641 - protein, 28 aa, Artificial Sequence
  Description of Artificial Sequence: Synthetic peptide
DEEEIRTTNPEATQQYGSVSTNLINGDF

SEQ ID NO: 35642 - protein, 31 aa, Artificial Sequence
  Description of Artificial Sequence: Synthetic polypeptide
DEHEIRTTNPVATEQYGDVSCENLQCRGNDR

SEQ ID NO: 35643 - protein, 28 aa, Artificial Sequence
  Description of Artificial Sequence: Synthetic peptide
KEEEIATTNPVATEQYGSVSTDEQRENA

SEQ ID NO: 35644 - protein, 29 aa, Artificial Sequence
  Description of Artificial Sequence: Synthetic peptide
DEEEIRTTNPVATECYGSVSTDLEDQGNH

SEQ ID NO: 35645 - protein, 30 aa, Artificial Sequence
  Description of Artificial Sequence: Synthetic polypeptide
DEQEIVTTNPVATEQYGSVSTLNGQRGENY

SEQ ID NO: 35646 - protein, 31 aa, Artificial Sequence
  Description of Artificial Sequence: Synthetic polypeptide
DEEEIRTTNPVATEQYGSVSTANEQELGNTV

SEQ ID NO: 35647 - protein, 28 aa, Artificial Sequence
  Description of Artificial Sequence: Synthetic peptide
DEEEIRTTNPVATEIYGIYSTNLQTGDM

SEQ ID NO: 35648 - protein, 29 aa, Artificial Sequence
  Description of Artificial Sequence: Synthetic peptide
QENEIRTTNPVATEQYGSVSTELQMNGNQ

SEQ ID NO: 35649 - protein, 28 aa, Artificial Sequence
  Description of Artificial Sequence: Synthetic peptide
DEEEIRQTNPVATECYGSVSTDLQHGDM

SEQ ID NO: 35650 - protein, 28 aa, Artificial Sequence
  Description of Artificial Sequence: Synthetic peptide
DEEELATVNPVATEQYGVVSFNLQRPNR

SEQ ID NO: 35651 - protein, 28 aa, Artificial Sequence
  Description of Artificial Sequence: Synthetic peptide
DDEEIRTVNPVATEQYGSVATELQVGER

SEQ ID NO: 35652 - protein, 29 aa, Artificial Sequence
  Description of Artificial Sequence: Synthetic peptide
DEEEIRTTNPCATELYGVVSCTNLERGNC

SEQ ID NO: 35653 - protein, 30 aa, Artificial Sequence
  Description of Artificial Sequence: Synthetic polypeptide
DEEEIATTNPVATEQYGSVSETELQREGEW

SEQ ID NO: 35654 - protein, 28 aa, Artificial Sequence
  Description of Artificial Sequence: Synthetic peptide
DEEEIRTCNPVATECYGAVSTDLQNGLR

SEQ ID NO: 35655 - protein, 28 aa, Artificial Sequence
  Description of Artificial Sequence: Synthetic peptide
DEEEIRTTNPEATEQYGSVSTEDDYGER

SEQ ID NO: 35656 - protein, 28 aa, Artificial Sequence
  Description of Artificial Sequence: Synthetic peptide
DENEIRTTNPIATECYGSVSTNLESGNQ

SEQ ID NO: 35657 - protein, 32 aa, Artificial Sequence
  Description of Artificial Sequence: Synthetic polypeptide
DEEEIRTTNPVATEQYGSVSTNGPVQNEGNDR

SEQ ID NO: 35658 - protein, 30 aa, Artificial Sequence
  Description of Artificial Sequence: Synthetic polypeptide
DEQEIRTTNPVATEQYGSVSTDLQETEGNN

SEQ ID NO: 35659 - protein, 28 aa, Artificial Sequence
  Description of Artificial Sequence: Synthetic peptide
DEEEIRTTNPYATEQYGSVSTGDQWENT

SEQ ID NO: 35660 - protein, 28 aa, Artificial Sequence
  Description of Artificial Sequence: Synthetic peptide
SEEEIRTTNPVATEQYGSVSENPQNGTE

SEQ ID NO: 35661 - protein, 28 aa, Artificial Sequence
  Description of Artificial Sequence: Synthetic peptide
DEEEIRTTNPVAYEQYGSWEHNFQPGNR

SEQ ID NO: 35662 - protein, 28 aa, Artificial Sequence
  Description of Artificial Sequence: Synthetic peptide
QEEEIATVNPVATEQYGSASTNLQHGGR

SEQ ID NO: 35663 - protein, 28 aa, Artificial Sequence
  Description of Artificial Sequence: Synthetic peptide
DEEEIATTNPVAHEQYGIVSTNLQIGDF

SEQ ID NO: 35664 - protein, 28 aa, Artificial Sequence
  Description of Artificial Sequence: Synthetic peptide
GENEIRTTNPVASEQYGSCSTNLQGGNQ

SEQ ID NO: 35665 - protein, 28 aa, Artificial Sequence
  Description of Artificial Sequence: Synthetic peptide
DEEEIRTTNPVATEQYGIVGEVLQAGER

SEQ ID NO: 35666 - protein, 30 aa, Artificial Sequence
  Description of Artificial Sequence: Synthetic polypeptide
YEEEIRTTNPVATEQYGSVSCELQRGDNVL

SEQ ID NO: 35667 - protein, 30 aa, Artificial Sequence
  Description of Artificial Sequence: Synthetic polypeptide
DEEEIRTTNPCATENYGSVSTNLQNRANNK

SEQ ID NO: 35668 - protein, 28 aa, Artificial Sequence
  Description of Artificial Sequence: Synthetic peptide
DEEEIRTTNPAATEQFGSVSTNGAHGNH

SEQ ID NO: 35669 - protein, 31 aa, Artificial Sequence
  Description of Artificial Sequence: Synthetic polypeptide
DEEEIATTNPVATEQYGSVSATNLEDRGNDL

SEQ ID NO: 35670 - protein, 31 aa, Artificial Sequence
  Description of Artificial Sequence: Synthetic polypeptide
DEEEIRTTNPVATEQYGSWSQTTNLQIGNDP

SEQ ID NO: 35671 - protein, 31 aa, Artificial Sequence
  Description of Artificial Sequence: Synthetic polypeptide
DEEEIRTTNPVATEQYGSVSTDLQIQKGNDN

SEQ ID NO: 35672 - protein, 32 aa, Artificial Sequence
  Description of Artificial Sequence: Synthetic polypeptide
DEEEIRTTNPVATEQYGSVSTNEVQIKGDNDR

SEQ ID NO: 35673 - protein, 32 aa, Artificial Sequence
  Description of Artificial Sequence: Synthetic polypeptide
SEEEIRATNPVATEQYGSVDSTENGLQRGINR

SEQ ID NO: 35674 - protein, 30 aa, Artificial Sequence
  Description of Artificial Sequence: Synthetic polypeptide
DEEEINTTNPVATEQYGSVSTNLQDMNGEA

SEQ ID NO: 35675 - protein, 29 aa, Artificial Sequence
  Description of Artificial Sequence: Synthetic peptide
SEEEITTTNPEATEQYGSVSTNLEQRGDF

SEQ ID NO: 35676 - protein, 28 aa, Artificial Sequence
  Description of Artificial Sequence: Synthetic peptide
DEHEIRTTNPVATEQYGDVSEELQTGNN

SEQ ID NO: 35677 - protein, 28 aa, Artificial Sequence
  Description of Artificial Sequence: Synthetic peptide
SEEEIRTTNPTATELYGSVPTNLQREDR

SEQ ID NO: 35678 - protein, 32 aa, Artificial Sequence
  Description of Artificial Sequence: Synthetic polypeptide
DEEEIRTTNPVATEQYGSVSTCNDVQDRKGNQ

SEQ ID NO: 35679 - protein, 30 aa, Artificial Sequence
  Description of Artificial Sequence: Synthetic polypeptide
SEVEIACTNPVATEQYGSVSTNLQREGNDR

SEQ ID NO: 35680 - protein, 28 aa, Artificial Sequence
  Description of Artificial Sequence: Synthetic peptide
DEEEIAATNPVAWEQYGSVSTGLYNGNR

SEQ ID NO: 35681 - protein, 28 aa, Artificial Sequence
  Description of Artificial Sequence: Synthetic peptide
SEEEIRTTNPVATECWGNVSTNLMRGNY

SEQ ID NO: 35682 - protein, 28 aa, Artificial Sequence
  Description of Artificial Sequence: Synthetic peptide
DEEEICTTNPEATETYGDVSTNLQTGNE

SEQ ID NO: 35683 - protein, 33 aa, Artificial Sequence
  Description of Artificial Sequence: Synthetic polypeptide
DEEEIRTTNPVATEQYGESYVEDTNLQREGNPR

SEQ ID NO: 35684 - protein, 31 aa, Artificial Sequence
  Description of Artificial Sequence: Synthetic polypeptide
DEEEIATTNPVATEQYGSVSTELQIDKGNDR

SEQ ID NO: 35685 - protein, 29 aa, Artificial Sequence
  Description of Artificial Sequence: Synthetic peptide
SEEEIRTTNPTATEMYGSVSEMNLQQGNR

SEQ ID NO: 35686 - protein, 30 aa, Artificial Sequence
  Description of Artificial Sequence: Synthetic polypeptide
MENEIRTTNPVATEQYGSVSTDLQNEGNDR

SEQ ID NO: 35687 - protein, 28 aa, Artificial Sequence
  Description of Artificial Sequence: Synthetic peptide
DTEEIRGTNPVATEGWGSVSTNLQRGAQ

SEQ ID NO: 35688 - protein, 28 aa, Artificial Sequence
  Description of Artificial Sequence: Synthetic peptide
DEEEISATNPVATEQYGDVDTNLQDGNQ

SEQ ID NO: 35689 - protein, 30 aa, Artificial Sequence
  Description of Artificial Sequence: Synthetic polypeptide
DETEITTTNPVATEQYGAVSCTEELQRGNR

SEQ ID NO: 35690 - protein, 30 aa, Artificial Sequence
  Description of Artificial Sequence: Synthetic polypeptide
SEEEICTTNPVATEQYGSVSECNEQRGNDR

SEQ ID NO: 35691 - protein, 28 aa, Artificial Sequence
  Description of Artificial Sequence: Synthetic peptide
DEEEIRTTNPVASEIYGSVATNIERGND

SEQ ID NO: 35692 - protein, 31 aa, Artificial Sequence
  Description of Artificial Sequence: Synthetic polypeptide
DEEQIRTTNPVATEQYGSVSTNLVQIPEGNP

SEQ ID NO: 35693 - protein, 29 aa, Artificial Sequence
  Description of Artificial Sequence: Synthetic peptide
HESEVWTTNPVAYEQYGSVSDTNLQRGNR

SEQ ID NO: 35694 - protein, 31 aa, Artificial Sequence
  Description of Artificial Sequence: Synthetic polypeptide
DEEEIRTTNPVATEQYGSVSTNLQEVEGEDF

SEQ ID NO: 35695 - protein, 28 aa, Artificial Sequence
  Description of Artificial Sequence: Synthetic peptide
QEVEIVTTNPVSTEQYGSVSTNGQNGNR

SEQ ID NO: 35696 - protein, 28 aa, Artificial Sequence
  Description of Artificial Sequence: Synthetic peptide
DENEIRTTNPVATEQWGIVSTNLMQGNM

SEQ ID NO: 35697 - protein, 30 aa, Artificial Sequence
  Description of Artificial Sequence: Synthetic polypeptide
KEEEIATTNPVATEQYGSVSTNLQHEGEDR

SEQ ID NO: 35698 - protein, 32 aa, Artificial Sequence
  Description of Artificial Sequence: Synthetic polypeptide
DEEEIRTTNPVATEQYGSVQSEMNLYRTGNTR

SEQ ID NO: 35699 - protein, 30 aa, Artificial Sequence
  Description of Artificial Sequence: Synthetic polypeptide
DEEEIRTTNPVATEQYGDVSENLMNQAGNA

SEQ ID NO: 35700 - protein, 28 aa, Artificial Sequence
  Description of Artificial Sequence: Synthetic peptide
DEEEIRTTNPEATEQYGSVSTPDDNENR

SEQ ID NO: 35701 - protein, 28 aa, Artificial Sequence
  Description of Artificial Sequence: Synthetic peptide
MEQEIRTTNPVATECYGSVSTNLQSGDA

SEQ ID NO: 35702 - protein, 28 aa, Artificial Sequence
  Description of Artificial Sequence: Synthetic peptide
DEEEIMTTNPVATEQYGSVSTNLEGEDG

SEQ ID NO: 35703 - protein, 30 aa, Artificial Sequence
  Description of Artificial Sequence: Synthetic polypeptide
DEEEIRTTNPVATEQYGSVSENLQDEDGDH

SEQ ID NO: 35704 - protein, 30 aa, Artificial Sequence
  Description of Artificial Sequence: Synthetic polypeptide
DEEEIRTTNPVATEQYGSVSTCNLEPPGEH

SEQ ID NO: 35705 - protein, 33 aa, Artificial Sequence
  Description of Artificial Sequence: Synthetic polypeptide
DEEEIRTTNPVATEQYGESVDSTNPLPQAKGNR

SEQ ID NO: 35706 - protein, 28 aa, Artificial Sequence
  Description of Artificial Sequence: Synthetic peptide
SEVEIRATNPVATEMFGSVSENLQRGNR

SEQ ID NO: 35707 - protein, 28 aa, Artificial Sequence
  Description of Artificial Sequence: Synthetic peptide
QEEEICGTNPVATETYGSVSTNLQQGNH

SEQ ID NO: 35708 - protein, 31 aa, Artificial Sequence
  Description of Artificial Sequence: Synthetic polypeptide
DEEEIRTTNPVATEQYGSVSSTELSDRGNDW

SEQ ID NO: 35709 - protein, 30 aa, Artificial Sequence
  Description of Artificial Sequence: Synthetic polypeptide
GEEEIRTTNPVATEQYGSASTMNLQYGNNF

SEQ ID NO: 35710 - protein, 31 aa, Artificial Sequence
  Description of Artificial Sequence: Synthetic polypeptide
DEEEIATTNPVATEQYGSVRSENLNQIRGNQ

SEQ ID NO: 35711 - protein, 28 aa, Artificial Sequence
  Description of Artificial Sequence: Synthetic peptide
DEEEIRTTNPVATEQWGIVSENEQIGNW

SEQ ID NO: 35712 - protein, 31 aa, Artificial Sequence
  Description of Artificial Sequence: Synthetic polypeptide
DEEEIRTTNPIATEQYGSVSHTAWLQDVGNR

SEQ ID NO: 35713 - protein, 30 aa, Artificial Sequence
  Description of Artificial Sequence: Synthetic polypeptide
DEEEIRCTNPVATEGYGSVSNGAGLQRGNR

SEQ ID NO: 35714 - protein, 31 aa, Artificial Sequence
  Description of Artificial Sequence: Synthetic polypeptide
DEEEIRTTNPVATECYGSVSATNLQVEGEDR

SEQ ID NO: 35715 - protein, 29 aa, Artificial Sequence
  Description of Artificial Sequence: Synthetic peptide
DEEEIRTTNPVATELWGSVSENEQIQGNR

SEQ ID NO: 35716 - protein, 31 aa, Artificial Sequence
  Description of Artificial Sequence: Synthetic polypeptide
DEEEIRTTNPFATEQYGVVSTNLQFRAGEND

SEQ ID NO: 35717 - protein, 28 aa, Artificial Sequence
  Description of Artificial Sequence: Synthetic peptide
DESEITTTNPCSTEQYGSVSTSLQPGNR

SEQ ID NO: 35718 - protein, 33 aa, Artificial Sequence
  Description of Artificial Sequence: Synthetic polypeptide
DEEEIRTTNPVATEQYGSVSTQNNDPQRGLNLR

SEQ ID NO: 35719 - protein, 29 aa, Artificial Sequence
  Description of Artificial Sequence: Synthetic peptide
DEAEIRTVNPCATEQYGSVSTNEQIEGNR

SEQ ID NO: 35720 - protein, 30 aa, Artificial Sequence
  Description of Artificial Sequence: Synthetic polypeptide
DEEEIRTTNPTATEQYGSVSTMNEQNGDNF

SEQ ID NO: 35721 - protein, 29 aa, Artificial Sequence
  Description of Artificial Sequence: Synthetic peptide
DEEEIRTTNPVATEQYGDVSENDQREFNL

SEQ ID NO: 35722 - protein, 28 aa, Artificial Sequence
  Description of Artificial Sequence: Synthetic peptide
DEEEIRTTNPVATEQYGSVETKLANGEM

SEQ ID NO: 35723 - protein, 28 aa, Artificial Sequence
  Description of Artificial Sequence: Synthetic peptide
DENEIRTTNPVATEWWGSVDTNLMRGNF

SEQ ID NO: 35724 - protein, 28 aa, Artificial Sequence
  Description of Artificial Sequence: Synthetic peptide
DEEEIRTTNPFATEQYGSVSTNQDLGDL

SEQ ID NO: 35725 - protein, 28 aa, Artificial Sequence
  Description of Artificial Sequence: Synthetic peptide
MEEEIRTTNPVATECYGSVSTDLQNGDD

SEQ ID NO: 35726 - protein, 31 aa, Artificial Sequence
  Description of Artificial Sequence: Synthetic polypeptide
DEEEIRTTNPVATEQYGTVSCTNLQVYKGNY

SEQ ID NO: 35727 - protein, 29 aa, Artificial Sequence
  Description of Artificial Sequence: Synthetic peptide
DEEEIATTNPVATECYGVVSENLQDRGNS

SEQ ID NO: 35728 - protein, 28 aa, Artificial Sequence
  Description of Artificial Sequence: Synthetic peptide
DEEEIRTTNPVATQWYGSVSDNLQVGDQ

SEQ ID NO: 35729 - protein, 31 aa, Artificial Sequence
  Description of Artificial Sequence: Synthetic polypeptide
DEEEIRTTNPTATEQYGSVSTMNEQDQGDNR

SEQ ID NO: 35730 - protein, 28 aa, Artificial Sequence
  Description of Artificial Sequence: Synthetic peptide
DEEEIRTTNPFATEQYGSVDTGLLRGEV

SEQ ID NO: 35731 - protein, 32 aa, Artificial Sequence
  Description of Artificial Sequence: Synthetic polypeptide
DEEEIRTTNPVATEQYGSVSTNLEENEGENDR

SEQ ID NO: 35732 - protein, 28 aa, Artificial Sequence
  Description of Artificial Sequence: Synthetic peptide
MEEEITTTNPVATEQYGTVSTNPEQGNR

SEQ ID NO: 35733 - protein, 28 aa, Artificial Sequence
  Description of Artificial Sequence: Synthetic peptide
RENEITSTNPVATECYGEVSTNLQRGNR

SEQ ID NO: 35734 - protein, 28 aa, Artificial Sequence
  Description of Artificial Sequence: Synthetic peptide
DEEEIRGTNPVATEMYGCVGTNLQHGMR

SEQ ID NO: 35735 - protein, 29 aa, Artificial Sequence
  Description of Artificial Sequence: Synthetic peptide
DDQEIRTTNPIAYEQYGVVSATNLQRGNR

SEQ ID NO: 35736 - protein, 31 aa, Artificial Sequence
  Description of Artificial Sequence: Synthetic polypeptide
DEEEIRTTNPVATEQYGSVSTANEQEIGNTH

SEQ ID NO: 35737 - protein, 28 aa, Artificial Sequence
  Description of Artificial Sequence: Synthetic peptide
REEEITTTNPVSTEQYGSVSTNLQLGDL

SEQ ID NO: 35738 - protein, 30 aa, Artificial Sequence
  Description of Artificial Sequence: Synthetic polypeptide
DEQKIATTNPVATEQYGSVSTNDQTRNGNR

SEQ ID NO: 35739 - protein, 31 aa, Artificial Sequence
  Description of Artificial Sequence: Synthetic polypeptide
DEVEIRTTNPVATEQFGSVSENLQREGDNTR

SEQ ID NO: 35740 - protein, 28 aa, Artificial Sequence
  Description of Artificial Sequence: Synthetic peptide
DEEEIRSTNPCATEVYGSVSSNLERGND

SEQ ID NO: 35741 - protein, 31 aa, Artificial Sequence
  Description of Artificial Sequence: Synthetic polypeptide
DEEEIRTTNPVATEQYGSVSTANEQEQGNTF

SEQ ID NO: 35742 - protein, 29 aa, Artificial Sequence
  Description of Artificial Sequence: Synthetic peptide
DEQEIRTTNPVATECYGSVSTNLQPEGDE

SEQ ID NO: 35743 - protein, 28 aa, Artificial Sequence
  Description of Artificial Sequence: Synthetic peptide
QEMEIRTTNPVATECWGSVSTNDQRGER

SEQ ID NO: 35744 - protein, 28 aa, Artificial Sequence
  Description of Artificial Sequence: Synthetic peptide
DEEEIRTTNPVATEQYGSVDTDDEEGNG

SEQ ID NO: 35745 - protein, 30 aa, Artificial Sequence
  Description of Artificial Sequence: Synthetic polypeptide
DEVEIRTVNPVATEHYGSVSTENLERGNER

SEQ ID NO: 35746 - protein, 28 aa, Artificial Sequence
  Description of Artificial Sequence: Synthetic peptide
DEQEIRTTNPVATEQYGNVSTNDQPGDP

SEQ ID NO: 35747 - protein, 28 aa, Artificial Sequence
  Description of Artificial Sequence: Synthetic peptide
DEQEIRTTNPVASEIYGCVSMNLERGNR

SEQ ID NO: 35748 - protein, 32 aa, Artificial Sequence
  Description of Artificial Sequence: Synthetic polypeptide
DEEEIATTNPVATEQYGSVSTMNPQLREGDNR

SEQ ID NO: 35749 - protein, 29 aa, Artificial Sequence
  Description of Artificial Sequence: Synthetic peptide
DEEEIATTNPVATEQFGDVSTDGLQRGNG

SEQ ID NO: 35750 - protein, 31 aa, Artificial Sequence
  Description of Artificial Sequence: Synthetic polypeptide
DEEEIRTTNPEATEQYGSVSTINLVQEHGNM

SEQ ID NO: 35751 - protein, 29 aa, Artificial Sequence
  Description of Artificial Sequence: Synthetic peptide
SEEEIRTTNPVATEQFGSVSTNPQRGPTQ

SEQ ID NO: 35752 - protein, 30 aa, Artificial Sequence
  Description of Artificial Sequence: Synthetic polypeptide
DEEEIATTNPVATEQYGSVATDLQAEGNDR

SEQ ID NO: 35753 - protein, 30 aa, Artificial Sequence
  Description of Artificial Sequence: Synthetic polypeptide
DEEEIRQTNPVATEQYGDVSTNLQTKGDER

SEQ ID NO: 35754 - protein, 28 aa, Artificial Sequence
  Description of Artificial Sequence: Synthetic peptide
DEEEIATTNPFATEQYGVVSTNQERGND

SEQ ID NO: 35755 - protein, 31 aa, Artificial Sequence
  Description of Artificial Sequence: Synthetic polypeptide
MEEEIRTTNPVATEQYGSVSTNLQDQEGNDN

SEQ ID NO: 35756 - protein, 28 aa, Artificial Sequence
  Description of Artificial Sequence: Synthetic peptide
DEFEICTVNPVATEQYGSVSTNLFEGNH

SEQ ID NO: 35757 - protein, 31 aa, Artificial Sequence
  Description of Artificial Sequence: Synthetic polypeptide
DEEEIRTTNPVATEQYGSVGDQNGAQTRGNR

SEQ ID NO: 35758 - protein, 30 aa, Artificial Sequence
  Description of Artificial Sequence: Synthetic polypeptide
DEEEIRTTNPVATEQYGSVSTEPLQESGDA

SEQ ID NO: 35759 - protein, 30 aa, Artificial Sequence
  Description of Artificial Sequence: Synthetic polypeptide
DTEEIRTTNPVATEQYGSWSTGLIIRGDNR

SEQ ID NO: 35760 - protein, 28 aa, Artificial Sequence
  Description of Artificial Sequence: Synthetic peptide
DENEIATTNPVATEQYGSVSTELQTGEA

SEQ ID NO: 35761 - protein, 30 aa, Artificial Sequence
  Description of Artificial Sequence: Synthetic polypeptide
DEECIRTTNPVATEQYGSVEIHNLILRGNR

SEQ ID NO: 35762 - protein, 31 aa, Artificial Sequence
  Description of Artificial Sequence: Synthetic polypeptide
DEQEIRTTNPVATEQYGSVSTDNLVEDRGNF

SEQ ID NO: 35763 - protein, 32 aa, Artificial Sequence
  Description of Artificial Sequence: Synthetic polypeptide
DEEEIRTTNPVATEIYGSVSTENLQVREGDNN

SEQ ID NO: 35764 - protein, 28 aa, Artificial Sequence
  Description of Artificial Sequence: Synthetic peptide
DEEEIRTTNPVATEIYGSVSTEPQDGDN

SEQ ID NO: 35765 - protein, 30 aa, Artificial Sequence
  Description of Artificial Sequence: Synthetic polypeptide
DEEEIRTTNPVATEQWGSYSTNEQYDGNDR

SEQ ID NO: 35766 - protein, 28 aa, Artificial Sequence
  Description of Artificial Sequence: Synthetic peptide
DENEIETTNPVATEQYGSVATNLQFGDD

SEQ ID NO: 35767 - protein, 28 aa, Artificial Sequence
  Description of Artificial Sequence: Synthetic peptide
DEEEIRTTNPDATQQYGSVSHPLQPGER

SEQ ID NO: 35768 - protein, 28 aa, Artificial Sequence
  Description of Artificial Sequence: Synthetic peptide
DEEEIRCTNPAATEQYGGVSTNLQHEDR

SEQ ID NO: 35769 - protein, 28 aa, Artificial Sequence
  Description of Artificial Sequence: Synthetic peptide
AEEEIRTTNPVATEQYGSVETNENNGNI

SEQ ID NO: 35770 - protein, 28 aa, Artificial Sequence
  Description of Artificial Sequence: Synthetic peptide
DEEEIRTTNPVSTEQYGSVTFNLQGGQT

SEQ ID NO: 35771 - protein, 29 aa, Artificial Sequence
  Description of Artificial Sequence: Synthetic peptide
DEHEIRTTNPVATEQYGSVDTMDLQAGNA

SEQ ID NO: 35772 - protein, 28 aa, Artificial Sequence
  Description of Artificial Sequence: Synthetic peptide
DEEEIRTTNPFATEQYGSVSTPDDQGNA

SEQ ID NO: 35773 - protein, 28 aa, Artificial Sequence
  Description of Artificial Sequence: Synthetic peptide
DEEEIRTTNPVATEQYGCVSNDEERGNQ

SEQ ID NO: 35774 - protein, 30 aa, Artificial Sequence
  Description of Artificial Sequence: Synthetic polypeptide
DEEEIRTTNPFATEQYGSVSTNEQYEGNDY

SEQ ID NO: 35775 - protein, 28 aa, Artificial Sequence
  Description of Artificial Sequence: Synthetic peptide
DEEEITTTNPVATELYGCVSTNWQALNR

SEQ ID NO: 35776 - protein, 28 aa, Artificial Sequence
  Description of Artificial Sequence: Synthetic peptide
DEEEIRTTNPVATEQYGDVSECLQHGEL

SEQ ID NO: 35777 - protein, 28 aa, Artificial Sequence
  Description of Artificial Sequence: Synthetic peptide
VEEEVRTTNPVATEQYGEVSENLQHGLR

SEQ ID NO: 35778 - protein, 29 aa, Artificial Sequence
  Description of Artificial Sequence: Synthetic peptide
DDEEIRTTNPVATEWYGSVGMNLEREGNR

SEQ ID NO: 35779 - protein, 29 aa, Artificial Sequence
  Description of Artificial Sequence: Synthetic peptide
DEDEVRTTNPVCTEIYGCVSTNLQREGNR

SEQ ID NO: 35780 - protein, 30 aa, Artificial Sequence
  Description of Artificial Sequence: Synthetic polypeptide
DEEEIRTTNPVATESYGSVSTINLQYGDMD

SEQ ID NO: 35781 - protein, 29 aa, Artificial Sequence
  Description of Artificial Sequence: Synthetic peptide
MEEEIRTVNPVATEQYGWVSTNLQELGNS

SEQ ID NO: 35782 - protein, 28 aa, Artificial Sequence
  Description of Artificial Sequence: Synthetic peptide
DEFEINTTNPVATEQYGDVSDFLQRGNV

SEQ ID NO: 35783 - protein, 28 aa, Artificial Sequence
  Description of Artificial Sequence: Synthetic peptide
SEYEIRMTNPVATEQYGSVETNLQHGNQ

SEQ ID NO: 35784 - protein, 31 aa, Artificial Sequence
  Description of Artificial Sequence: Synthetic polypeptide
DEEEIRTTNPVATECYGSVSTDLQDTEGENR

SEQ ID NO: 35785 - protein, 28 aa, Artificial Sequence
  Description of Artificial Sequence: Synthetic peptide
YEEEIVTTNPVATEQYGSVSTNPQEPNT

SEQ ID NO: 35786 - protein, 30 aa, Artificial Sequence
  Description of Artificial Sequence: Synthetic polypeptide
DEEEIRTTNPVATEQYGSVETPLQILDGNG

SEQ ID NO: 35787 - protein, 29 aa, Artificial Sequence
  Description of Artificial Sequence: Synthetic peptide
DEEEIATTNPVATEQYGWVSCTNWQIGNT

SEQ ID NO: 35788 - protein, 29 aa, Artificial Sequence
  Description of Artificial Sequence: Synthetic peptide
DEEEIRTVNPVASEQYGVVATNLQDIGNR

SEQ ID NO: 35789 - protein, 30 aa, Artificial Sequence
  Description of Artificial Sequence: Synthetic polypeptide
DEEEIATTNPVATEQFGSVSENGLQRGDTR

SEQ ID NO: 35790 - protein, 32 aa, Artificial Sequence
  Description of Artificial Sequence: Synthetic polypeptide
DEEEIRTTNPVATEQYGSVSETTNLEDDEGNR

SEQ ID NO: 35791 - protein, 30 aa, Artificial Sequence
  Description of Artificial Sequence: Synthetic polypeptide
DEEEIRTTNPVATTQYGSVTGTNLQGGENQ

SEQ ID NO: 35792 - protein, 32 aa, Artificial Sequence
  Description of Artificial Sequence: Synthetic polypeptide
DEEEIRTTNPVATEQYGSVSTLNPLQDVGNDS

SEQ ID NO: 35793 - protein, 29 aa, Artificial Sequence
  Description of Artificial Sequence: Synthetic peptide
DEQEIRTTNPVASEQYGCVSANNLERGNR

SEQ ID NO: 35794 - protein, 28 aa, Artificial Sequence
  Description of Artificial Sequence: Synthetic peptide
HEGEIRTTNPVATEQYGSVSDNGQNGNV

SEQ ID NO: 35795 - protein, 29 aa, Artificial Sequence
  Description of Artificial Sequence: Synthetic peptide
DEEEISATNPVATEQYGWVSENLQRGNDW

SEQ ID NO: 35796 - protein, 30 aa, Artificial Sequence
  Description of Artificial Sequence: Synthetic polypeptide
DEEEIRTTNPVATECYGSVSTDLQDHGEDR

SEQ ID NO: 35797 - protein, 32 aa, Artificial Sequence
  Description of Artificial Sequence: Synthetic polypeptide
DEEEIRTTNPVATEQYGSVESTDPLDDRGDNR

SEQ ID NO: 35798 - protein, 28 aa, Artificial Sequence
  Description of Artificial Sequence: Synthetic peptide
DEVEICTTNPVGTEIYGSVSTNEQIGNR

SEQ ID NO: 35799 - protein, 31 aa, Artificial Sequence
  Description of Artificial Sequence: Synthetic polypeptide
DEEEIVTTNPVATEQYGSVSTNLQDSNGEDR

SEQ ID NO: 35800 - protein, 28 aa, Artificial Sequence
  Description of Artificial Sequence: Synthetic peptide
DENEIRTTNPVATELWGSVSENLMVGNR

SEQ ID NO: 35801 - protein, 28 aa, Artificial Sequence
  Description of Artificial Sequence: Synthetic peptide
DEECIRTTNPVAFQQYGSVSHNLDRGNP

SEQ ID NO: 35802 - protein, 31 aa, Artificial Sequence
  Description of Artificial Sequence: Synthetic polypeptide
DEEEIRTTNPVATEQYGSVDSTDLEEDGNER

SEQ ID NO: 35803 - protein, 30 aa, Artificial Sequence
  Description of Artificial Sequence: Synthetic polypeptide
DEEEIRTTNPVATEQYGSVSTDLEREGEDT

SEQ ID NO: 35804 - protein, 28 aa, Artificial Sequence
  Description of Artificial Sequence: Synthetic peptide
DEEEIRTTNPFATEQYGSVSTGPYNGNF

SEQ ID NO: 35805 - protein, 31 aa, Artificial Sequence
  Description of Artificial Sequence: Synthetic polypeptide
DENEIRTTNPVATEQYGSVSTDLQEREGNDM

SEQ ID NO: 35806 - protein, 28 aa, Artificial Sequence
  Description of Artificial Sequence: Synthetic peptide
MENEIRTTNPVATEQYGSVSDNLQHGDM

SEQ ID NO: 35807 - protein, 28 aa, Artificial Sequence
  Description of Artificial Sequence: Synthetic peptide
DDQEIRTTNPVATEQYGSVSTNDMRGTA

SEQ ID NO: 35808 - protein, 28 aa, Artificial Sequence
  Description of Artificial Sequence: Synthetic peptide
DEEEIRTTNPVATEQYGSVSEDPQLGDS

SEQ ID NO: 35809 - protein, 32 aa, Artificial Sequence
  Description of Artificial Sequence: Synthetic polypeptide
DEEEIRTTNPVATEQYGSVSETNLEERGENDQ

SEQ ID NO: 35810 - protein, 29 aa, Artificial Sequence
  Description of Artificial Sequence: Synthetic peptide
PEEEIRTTNPVAYEQYGSYVSTGLQPGND

SEQ ID NO: 35811 - protein, 29 aa, Artificial Sequence
  Description of Artificial Sequence: Synthetic peptide
DENEIRTTNPVATEQYGWVATELQDGNDR

SEQ ID NO: 35812 - protein, 30 aa, Artificial Sequence
  Description of Artificial Sequence: Synthetic polypeptide
DEEEIRTTNPVATEQYGSVENENSQQTGNR

SEQ ID NO: 35813 - protein, 31 aa, Artificial Sequence
  Description of Artificial Sequence: Synthetic polypeptide
DEEEIRTTNPVATEQYGSVSTDLQDRNGEDA

SEQ ID NO: 35814 - protein, 30 aa, Artificial Sequence
  Description of Artificial Sequence: Synthetic polypeptide
DEEEIRCTNPVATEIYGCVSAMNLQRNGNR

SEQ ID NO: 35815 - protein, 28 aa, Artificial Sequence
  Description of Artificial Sequence: Synthetic peptide
NEEEIRTTNPVCSEGYGSVSTNLQRLTR

SEQ ID NO: 35816 - protein, 31 aa, Artificial Sequence
  Description of Artificial Sequence: Synthetic polypeptide
DEEEIRTTNPVATEQYGSVSTDLQEVKGEDR

SEQ ID NO: 35817 - protein, 28 aa, Artificial Sequence
  Description of Artificial Sequence: Synthetic peptide
DEQEIATTNPVATEQYGSVSTNLEHGEE

SEQ ID NO: 35818 - protein, 28 aa, Artificial Sequence
  Description of Artificial Sequence: Synthetic peptide
DEEEIATTNPVATEMFGSVSTDLQQGDR

SEQ ID NO: 35819 - protein, 31 aa, Artificial Sequence
  Description of Artificial Sequence: Synthetic polypeptide
SEEEIRTTNPTATEQYGSVSTANLQLLGNDR

SEQ ID NO: 35820 - protein, 28 aa, Artificial Sequence
  Description of Artificial Sequence: Synthetic peptide
DENEIRTTNPVATEQYGSYSENEERGNS

SEQ ID NO: 35821 - protein, 32 aa, Artificial Sequence
  Description of Artificial Sequence: Synthetic polypeptide
DEEEIRTTNPVATEQYGSVASTNLTQLRGQGD

SEQ ID NO: 35822 - protein, 28 aa, Artificial Sequence
  Description of Artificial Sequence: Synthetic peptide
DEEEIRATNPVATEQYGVVSTELQQGES

SEQ ID NO: 35823 - protein, 28 aa, Artificial Sequence
  Description of Artificial Sequence: Synthetic peptide
DEQEIRTTNPVATEQYGSVDTLQQWGNH

SEQ ID NO: 35824 - protein, 30 aa, Artificial Sequence
  Description of Artificial Sequence: Synthetic polypeptide
DEQEIRTTNPEATEQYGSVSTENDVQRGER

SEQ ID NO: 35825 - protein, 29 aa, Artificial Sequence
  Description of Artificial Sequence: Synthetic peptide
DEEEIRTTNPVATEQWGSVSTNEMNQGNF

SEQ ID NO: 35826 - protein, 31 aa, Artificial Sequence
  Description of Artificial Sequence: Synthetic polypeptide
DEEEIRTTNPDATEQYGSVSCTNNLDDRENR

SEQ ID NO: 35827 - protein, 28 aa, Artificial Sequence
  Description of Artificial Sequence: Synthetic peptide
KEEEIRTTNPVCTEQYGTVSTELQGGNL

SEQ ID NO: 35828 - protein, 28 aa, Artificial Sequence
  Description of Artificial Sequence: Synthetic peptide
DEMEIRTTNPVATEQYGSVSSNLMRLPI

SEQ ID NO: 35829 - protein, 31 aa, Artificial Sequence
  Description of Artificial Sequence: Synthetic polypeptide
DEEEIRTTNPVATEQYGTVSNMVNLQRGDNQ

SEQ ID NO: 35830 - protein, 31 aa, Artificial Sequence
  Description of Artificial Sequence: Synthetic polypeptide
DEEEIRTTNPVATEQYGSVSTDLQDVNGEDR

SEQ ID NO: 35831 - protein, 28 aa, Artificial Sequence
  Description of Artificial Sequence: Synthetic peptide
DEEEIRTTNPFATEQYGSVSTNQDPGED

SEQ ID NO: 35832 - protein, 29 aa, Artificial Sequence
  Description of Artificial Sequence: Synthetic peptide
DEEEISTTNPVAVEQYGVVSTDLQYGNDR

SEQ ID NO: 35833 - protein, 28 aa, Artificial Sequence
  Description of Artificial Sequence: Synthetic peptide
SEEEIRTTNPTATEQYGSVSTNEQLGTG

SEQ ID NO: 35834 - protein, 32 aa, Artificial Sequence
  Description of Artificial Sequence: Synthetic polypeptide
DEEEIRTTNPVATEQYGSVSDTTGLQLDGENR

SEQ ID NO: 35835 - protein, 30 aa, Artificial Sequence
  Description of Artificial Sequence: Synthetic polypeptide
DEEEIRTTNPVATEQYGSGCSTNLEVQGNI

SEQ ID NO: 35836 - protein, 28 aa, Artificial Sequence
  Description of Artificial Sequence: Synthetic peptide
AEMEIYTTNPVATEQYGACSENLQRGNR

SEQ ID NO: 35837 - protein, 28 aa, Artificial Sequence
  Description of Artificial Sequence: Synthetic peptide
DEGEIRTTNPVATEQYGQVSTCLQIENM

SEQ ID NO: 35838 - protein, 29 aa, Artificial Sequence
  Description of Artificial Sequence: Synthetic peptide
DEEEIATTNPVATEQYGSMSTELQELGNM

SEQ ID NO: 35839 - protein, 28 aa, Artificial Sequence
  Description of Artificial Sequence: Synthetic peptide
DEVEIATTNPTATEQYGSVSTNEQLGNS

SEQ ID NO: 35840 - protein, 31 aa, Artificial Sequence
  Description of Artificial Sequence: Synthetic polypeptide
DEEEIRTTNPVATEQYGSVSTDLQEIKGNDT

SEQ ID NO: 35841 - protein, 28 aa, Artificial Sequence
  Description of Artificial Sequence: Synthetic peptide
DEEEIRTTNPVATEPYGCVSEADQRGNY

SEQ ID NO: 35842 - protein, 28 aa, Artificial Sequence
  Description of Artificial Sequence: Synthetic peptide
DEEEIRTTNPEATEQYGSVSTDEQNGDH

SEQ ID NO: 35843 - protein, 33 aa, Artificial Sequence
  Description of Artificial Sequence: Synthetic polypeptide
DEEEIRTTNPVATEQYGCSVSTNPLQIRKGNDW

SEQ ID NO: 35844 - protein, 28 aa, Artificial Sequence
  Description of Artificial Sequence: Synthetic peptide
DEHEIWTTNPVATEQYGTVSMNLQGENR

SEQ ID NO: 35845 - protein, 30 aa, Artificial Sequence
  Description of Artificial Sequence: Synthetic polypeptide
AEEEIATTNPVATEQYGSVDSTNLQLRGTE

SEQ ID NO: 35846 - protein, 29 aa, Artificial Sequence
  Description of Artificial Sequence: Synthetic peptide
DTEEITTTNPVATETYGSVSDMNLQRGDR

SEQ ID NO: 35847 - protein, 28 aa, Artificial Sequence
  Description of Artificial Sequence: Synthetic peptide
DEQEIRTTNPVATEQWGSYSENEQRGNF

SEQ ID NO: 35848 - protein, 32 aa, Artificial Sequence
  Description of Artificial Sequence: Synthetic polypeptide
DEEEIRTTNPVATEQYGSVSETNLEDDEGENR

SEQ ID NO: 35849 - protein, 32 aa, Artificial Sequence
  Description of Artificial Sequence: Synthetic polypeptide
DEEEIRTTNPVATEQYGSVDSATNQQVGENDR

SEQ ID NO: 35850 - protein, 28 aa, Artificial Sequence
  Description of Artificial Sequence: Synthetic peptide
SENEIRTTNPVATEQYGCVSTNDQVGNF

SEQ ID NO: 35851 - protein, 28 aa, Artificial Sequence
  Description of Artificial Sequence: Synthetic peptide
QEEEIVTTNPVATECYGSVSTNLEVGNI

SEQ ID NO: 35852 - protein, 28 aa, Artificial Sequence
  Description of Artificial Sequence: Synthetic peptide
SEEEICTTNPVATELYGEVSTNLERGNF

SEQ ID NO: 35853 - protein, 29 aa, Artificial Sequence
  Description of Artificial Sequence: Synthetic peptide
DEEEICTTNPVATEWYGSASYDNTQRGNR

SEQ ID NO: 35854 - protein, 31 aa, Artificial Sequence
  Description of Artificial Sequence: Synthetic polypeptide
DEEEIRTTNPVATEQYGSVSTNLQEHDGEDW

SEQ ID NO: 35855 - protein, 28 aa, Artificial Sequence
  Description of Artificial Sequence: Synthetic peptide
DEEEIRCTNPTATEQFGSVSANLQSGNI

SEQ ID NO: 35856 - protein, 32 aa, Artificial Sequence
  Description of Artificial Sequence: Synthetic polypeptide
DEEEIRTTNPVATEQYGSVSTINPLQVADGER

SEQ ID NO: 35857 - protein, 28 aa, Artificial Sequence
  Description of Artificial Sequence: Synthetic peptide
DEQEIRTTNPVATEQYGSVETNDERGDA

SEQ ID NO: 35858 - protein, 28 aa, Artificial Sequence
  Description of Artificial Sequence: Synthetic peptide
DEQEIRTTNPVATEQYGSVETNLDPGES

SEQ ID NO: 35859 - protein, 28 aa, Artificial Sequence
  Description of Artificial Sequence: Synthetic peptide
DEEEIRCTNPVATEQYGAADTNLQTGNG

SEQ ID NO: 35860 - protein, 28 aa, Artificial Sequence
  Description of Artificial Sequence: Synthetic peptide
AEEEIRTTNPVATEQYGSVSTDQEVGND

SEQ ID NO: 35861 - protein, 28 aa, Artificial Sequence
  Description of Artificial Sequence: Synthetic peptide
AEEEIATTNPVATEQYGSVSENLQDGED

SEQ ID NO: 35862 - protein, 28 aa, Artificial Sequence
  Description of Artificial Sequence: Synthetic peptide
DENEIRTTNPVATEQWGSVSENEQIGNL

SEQ ID NO: 35863 - protein, 28 aa, Artificial Sequence
  Description of Artificial Sequence: Synthetic peptide
DEEEIRTTNPEATEQYGSVSTDDEIGNF

SEQ ID NO: 35864 - protein, 29 aa, Artificial Sequence
  Description of Artificial Sequence: Synthetic peptide
AEEEIRTTNPVGTEQYGSVSTDLDLIGNR

SEQ ID NO: 35865 - protein, 28 aa, Artificial Sequence
  Description of Artificial Sequence: Synthetic peptide
DEEEIATTNPVATEVYGIVGDNLQRGMR

SEQ ID NO: 35866 - protein, 30 aa, Artificial Sequence
  Description of Artificial Sequence: Synthetic polypeptide
AEEQIRTVNPVATEQYGSVSATNLETRGNR

SEQ ID NO: 35867 - protein, 32 aa, Artificial Sequence
  Description of Artificial Sequence: Synthetic polypeptide
DEREIRTTNPVATEQYGSVSSPTLNLQRVENR

SEQ ID NO: 35868 - protein, 30 aa, Artificial Sequence
  Description of Artificial Sequence: Synthetic polypeptide
DEEEIVTTNPVATEQYGSVSTNDVQERGES

SEQ ID NO: 35869 - protein, 28 aa, Artificial Sequence
  Description of Artificial Sequence: Synthetic peptide
DEQEVAATNPVATEVYGSVSTNLMRGNR

SEQ ID NO: 35870 - protein, 31 aa, Artificial Sequence
  Description of Artificial Sequence: Synthetic polypeptide
DEEEIRTTNPVATEQYGLVSMTNLQLWGDNM

SEQ ID NO: 35871 - protein, 31 aa, Artificial Sequence
  Description of Artificial Sequence: Synthetic polypeptide
DEEEIRTTNPVATEQYGSYVPTNPVTQTGNR

SEQ ID NO: 35872 - protein, 28 aa, Artificial Sequence
  Description of Artificial Sequence: Synthetic peptide
DEEEIRTTNPVATEQYGSGPELLQVGDR

SEQ ID NO: 35873 - protein, 28 aa, Artificial Sequence
  Description of Artificial Sequence: Synthetic peptide
DEEEIRTTNPYATEQYGSVHTGDIRGNP

SEQ ID NO: 35874 - protein, 28 aa, Artificial Sequence
  Description of Artificial Sequence: Synthetic peptide
DEGEVRTTNPCATEHYGGVSTNLQRGNF

SEQ ID NO: 35875 - protein, 28 aa, Artificial Sequence
  Description of Artificial Sequence: Synthetic peptide
DEEEIRTTNPEATETYGEVSTNLDIGNQ

SEQ ID NO: 35876 - protein, 30 aa, Artificial Sequence
  Description of Artificial Sequence: Synthetic polypeptide
DEEEIRTTNPVATEQYGSVSTDLQDHGEDN

SEQ ID NO: 35877 - protein, 28 aa, Artificial Sequence
  Description of Artificial Sequence: Synthetic peptide
DEEEISCTNPFATEQYGEVSTNDQRGNW

SEQ ID NO: 35878 - protein, 28 aa, Artificial Sequence
  Description of Artificial Sequence: Synthetic peptide
DEEEIRTTNPVATEQFGSVSTEDQGENF

SEQ ID NO: 35879 - protein, 28 aa, Artificial Sequence
  Description of Artificial Sequence: Synthetic peptide
DENEIRQTNPVATEQYGSVSEELQREER

SEQ ID NO: 35880 - protein, 28 aa, Artificial Sequence
  Description of Artificial Sequence: Synthetic peptide
DEEEIRTTNPEATEQYGSVSDNPGQGNL

SEQ ID NO: 35881 - protein, 28 aa, Artificial Sequence
  Description of Artificial Sequence: Synthetic peptide
DEEEIVSTNPVATEVYGSVSTELQVGNS

SEQ ID NO: 35882 - protein, 28 aa, Artificial Sequence
  Description of Artificial Sequence: Synthetic peptide
DEEEISTTNPVATEQYGGVSTNPFGGNG

SEQ ID NO: 35883 - protein, 28 aa, Artificial Sequence
  Description of Artificial Sequence: Synthetic peptide
DEEEINATNPVATEQYGVVGTNLQRGGH

SEQ ID NO: 35884 - protein, 28 aa, Artificial Sequence
  Description of Artificial Sequence: Synthetic peptide
DENEIRTTNPVATEQYGDVSTCLQHGEN

SEQ ID NO: 35885 - protein, 30 aa, Artificial Sequence
  Description of Artificial Sequence: Synthetic polypeptide
DEGEIRTTNPVATEQFGSVSELNGLQRGTR

SEQ ID NO: 35886 - protein, 31 aa, Artificial Sequence
  Description of Artificial Sequence: Synthetic polypeptide
DEEEIRTTNPVATEQYGWVSTTNLQDDGIND

SEQ ID NO: 35887 - protein, 31 aa, Artificial Sequence
  Description of Artificial Sequence: Synthetic polypeptide
DEEEIRTTNPAATEQYGSVSTLNDQLGPNWR

SEQ ID NO: 35888 - protein, 31 aa, Artificial Sequence
  Description of Artificial Sequence: Synthetic polypeptide
DEEEITTTNPVATEQYGSVSCTNDCCRGENR

SEQ ID NO: 35889 - protein, 28 aa, Artificial Sequence
  Description of Artificial Sequence: Synthetic peptide
DEEEIRTTNPVATEQYGSVDTPEEPGNS

SEQ ID NO: 35890 - protein, 30 aa, Artificial Sequence
  Description of Artificial Sequence: Synthetic polypeptide
QEEEIRTTNPVATEQYGSVSTELQVVEGNG

SEQ ID NO: 35891 - protein, 31 aa, Artificial Sequence
  Description of Artificial Sequence: Synthetic polypeptide
DEEEIRTTNPVATEQYGSVSATNLELVGNDD

SEQ ID NO: 35892 - protein, 30 aa, Artificial Sequence
  Description of Artificial Sequence: Synthetic polypeptide
DENEIRTTNPVATECYGSVSTNLQDRGEDL

SEQ ID NO: 35893 - protein, 31 aa, Artificial Sequence
  Description of Artificial Sequence: Synthetic polypeptide
DEEEIRTTNPVATEQYGSVSTTNLQYEGEPF

SEQ ID NO: 35894 - protein, 28 aa, Artificial Sequence
  Description of Artificial Sequence: Synthetic peptide
DEEEIRTTNPVSTEQWGSVDTNDMGGNR

SEQ ID NO: 35895 - protein, 29 aa, Artificial Sequence
  Description of Artificial Sequence: Synthetic peptide
DEEEIRTTNPVASEQYGSMATELQESGNR

SEQ ID NO: 35896 - protein, 31 aa, Artificial Sequence
  Description of Artificial Sequence: Synthetic polypeptide
DEEEIRTTNPVATEQYGESVSETNEVDQGNR

SEQ ID NO: 35897 - protein, 28 aa, Artificial Sequence
  Description of Artificial Sequence: Synthetic peptide
DENEIRTTNPVATEQYGSMSTDLEQGNM

SEQ ID NO: 35898 - protein, 31 aa, Artificial Sequence
  Description of Artificial Sequence: Synthetic polypeptide
DEEEIRTTNPVATEQYGSVSCTMDLQQGNDA

SEQ ID NO: 35899 - protein, 28 aa, Artificial Sequence
  Description of Artificial Sequence: Synthetic peptide
DEEEIRATNPTATEQYGSVSENEQQENR

SEQ ID NO: 35900 - protein, 31 aa, Artificial Sequence
  Description of Artificial Sequence: Synthetic polypeptide
DEEEIRTTNPVATEQFGSVSTNPQDRGVNDH

SEQ ID NO: 35901 - protein, 28 aa, Artificial Sequence
  Description of Artificial Sequence: Synthetic peptide
HEEEIRTVNCVATEQWGAVSTNLQRGNT

SEQ ID NO: 35902 - protein, 30 aa, Artificial Sequence
  Description of Artificial Sequence: Synthetic polypeptide
DEEEIRTTNPVATEQYGSASTNLQHFGEDA

SEQ ID NO: 35903 - protein, 28 aa, Artificial Sequence
  Description of Artificial Sequence: Synthetic peptide
DEEEIRTTNPVATECWGSVDENLMRGNF

SEQ ID NO: 35904 - protein, 32 aa, Artificial Sequence
  Description of Artificial Sequence: Synthetic polypeptide
DEEEIRTTNPFATEQYGSVSETLNLDLRGNPR

SEQ ID NO: 35905 - protein, 28 aa, Artificial Sequence
  Description of Artificial Sequence: Synthetic peptide
KEEEIRAVNPVATEQYGVVSTNLQQGNA

SEQ ID NO: 35906 - protein, 28 aa, Artificial Sequence
  Description of Artificial Sequence: Synthetic peptide
DEEEIAATNPVATEQYGSVSTNLQQETY

SEQ ID NO: 35907 - protein, 31 aa, Artificial Sequence
  Description of Artificial Sequence: Synthetic polypeptide
DEEEIRTTNPVATEQYGSVSTNLEEVGENDF

SEQ ID NO: 35908 - protein, 31 aa, Artificial Sequence
  Description of Artificial Sequence: Synthetic polypeptide
DEEEIRTTNPVATEQYGSVSETNLEDHGNDV

SEQ ID NO: 35909 - protein, 28 aa, Artificial Sequence
  Description of Artificial Sequence: Synthetic peptide
DTQEIRTTNPVATEQWGSVSEGLQRGNW

SEQ ID NO: 35910 - protein, 31 aa, Artificial Sequence
  Description of Artificial Sequence: Synthetic polypeptide
DEEEIATTNPTATEQYGSVSTNLQLQEGDNR

SEQ ID NO: 35911 - protein, 31 aa, Artificial Sequence
  Description of Artificial Sequence: Synthetic polypeptide
DEEEIMTTNPVCTEQYGSVSTMNLQERGENL

SEQ ID NO: 35912 - protein, 28 aa, Artificial Sequence
  Description of Artificial Sequence: Synthetic peptide
DENEIRTTNPVATEQYGIVSENEMRGNF

SEQ ID NO: 35913 - protein, 30 aa, Artificial Sequence
  Description of Artificial Sequence: Synthetic polypeptide
DEQEIRSTNPVATEIYGSVSATNLQVNGNR

SEQ ID NO: 35914 - protein, 29 aa, Artificial Sequence
  Description of Artificial Sequence: Synthetic peptide
DEEEIRTTNPDATQIYGSVHSTNDQRGND

SEQ ID NO: 35915 - protein, 28 aa, Artificial Sequence
  Description of Artificial Sequence: Synthetic peptide
DEEEIRTVNPEATEQYGSVSTEGQYGNM

SEQ ID NO: 35916 - protein, 30 aa, Artificial Sequence
  Description of Artificial Sequence: Synthetic polypeptide
DEEEIRTTNPVATEQYGSVSTNLEDHEGEF

SEQ ID NO: 35917 - protein, 28 aa, Artificial Sequence
  Description of Artificial Sequence: Synthetic peptide
KEEEIRTTNPVATEQYGSASENLQNGES

SEQ ID NO: 35918 - protein, 28 aa, Artificial Sequence
  Description of Artificial Sequence: Synthetic peptide
GEEEINATNPVATEQYGAVSTNVQRGQR

SEQ ID NO: 35919 - protein, 29 aa, Artificial Sequence
  Description of Artificial Sequence: Synthetic peptide
DEEEIRTTNPDATEQYGSVSETPEQIGER

SEQ ID NO: 35920 - protein, 30 aa, Artificial Sequence
  Description of Artificial Sequence: Synthetic polypeptide
DEEEIRTTNPVATEQYGSVDTNGDQPGEDR

SEQ ID NO: 35921 - protein, 32 aa, Artificial Sequence
  Description of Artificial Sequence: Synthetic polypeptide
DEEEIRTTNPVATEQYGSVSDTPNLQPEGDNP

SEQ ID NO: 35922 - protein, 31 aa, Artificial Sequence
  Description of Artificial Sequence: Synthetic polypeptide
DEEEIRTTNPVATEQYGSVSTANEQNEGDNF

SEQ ID NO: 35923 - protein, 28 aa, Artificial Sequence
  Description of Artificial Sequence: Synthetic peptide
MENEIRTTNPVATECYGSVSTELQIGNL

SEQ ID NO: 35924 - protein, 31 aa, Artificial Sequence
  Description of Artificial Sequence: Synthetic polypeptide
DEEEIRTTNPVATEQYGESVSEDLQTGLNPR

SEQ ID NO: 35925 - protein, 28 aa, Artificial Sequence
  Description of Artificial Sequence: Synthetic peptide
DMEEIGQTNPVATEQYGEVSTNLQRPNL

SEQ ID NO: 35926 - protein, 30 aa, Artificial Sequence
  Description of Artificial Sequence: Synthetic polypeptide
DEEEIRTTNPVATEQYGSVSTIELQVYGDS

SEQ ID NO: 35927 - protein, 29 aa, Artificial Sequence
  Description of Artificial Sequence: Synthetic peptide
DEEEIRTTNPVATEFYGSVSTDIQHFGNQ

SEQ ID NO: 35928 - protein, 30 aa, Artificial Sequence
  Description of Artificial Sequence: Synthetic polypeptide
DEEEITTTNPVATEQYGSASENLQHGGNDR

SEQ ID NO: 35929 - protein, 28 aa, Artificial Sequence
  Description of Artificial Sequence: Synthetic peptide
DENEIAQTNPVATEQYGSVSTCPQHGNR

SEQ ID NO: 35930 - protein, 31 aa, Artificial Sequence
  Description of Artificial Sequence: Synthetic polypeptide
DENEIRQTNPVATEQYGSVSTNLVEDRGNDR

SEQ ID NO: 35931 - protein, 28 aa, Artificial Sequence
  Description of Artificial Sequence: Synthetic peptide
DEEEITTTNPVAYEQYGEVSTDLQPGNF

SEQ ID NO: 35932 - protein, 29 aa, Artificial Sequence
  Description of Artificial Sequence: Synthetic peptide
DEEEIRTTNPVATEQYGSVDTNEMLGENF

SEQ ID NO: 35933 - protein, 28 aa, Artificial Sequence
  Description of Artificial Sequence: Synthetic peptide
MENEIRTTNPVATEQYGSVSEDLQAGNV

SEQ ID NO: 35934 - protein, 32 aa, Artificial Sequence
  Description of Artificial Sequence: Synthetic polypeptide
DEEEIRTTNPVATEQYGSVSDTENLERNGNDQ

SEQ ID NO: 35935 - protein, 28 aa, Artificial Sequence
  Description of Artificial Sequence: Synthetic peptide
DEEELRATNPCATESYGSVPTNVQRGNR

SEQ ID NO: 35936 - protein, 28 aa, Artificial Sequence
  Description of Artificial Sequence: Synthetic peptide
KEEEIRATNPVATECYGSMSTNLQWGNE

SEQ ID NO: 35937 - protein, 28 aa, Artificial Sequence
  Description of Artificial Sequence: Synthetic peptide
DENEIATTNPVATECYGSVSTNLQHGEL

SEQ ID NO: 35938 - protein, 28 aa, Artificial Sequence
  Description of Artificial Sequence: Synthetic peptide
DEEEIRTTNPDATEIYGSVSHNDDPGNR

SEQ ID NO: 35939 - protein, 30 aa, Artificial Sequence
  Description of Artificial Sequence: Synthetic polypeptide
DDEEISTTNPVATEQYGSIVSTNLPARGNN

SEQ ID NO: 35940 - protein, 28 aa, Artificial Sequence
  Description of Artificial Sequence: Synthetic peptide
DEEEIRTTNPEATEQYGSVSTEEQTGEW

SEQ ID NO: 35941 - protein, 28 aa, Artificial Sequence
  Description of Artificial Sequence: Synthetic peptide
DETEIRSTNPVATEQYGDVSTVIQRGNA

SEQ ID NO: 35942 - protein, 28 aa, Artificial Sequence
  Description of Artificial Sequence: Synthetic peptide
QEEEIRTTNPVATECYGSVSECLQRGEN

SEQ ID NO: 35943 - protein, 32 aa, Artificial Sequence
  Description of Artificial Sequence: Synthetic polypeptide
DEEEIRTTNPVATEQYGYSVSLTGNLQAKGNN

SEQ ID NO: 35944 - protein, 32 aa, Artificial Sequence
  Description of Artificial Sequence: Synthetic polypeptide
DEEEIRTTNPVATEQYGSVSCTMELQCRGNDS

SEQ ID NO: 35945 - protein, 29 aa, Artificial Sequence
  Description of Artificial Sequence: Synthetic peptide
QEEEIRATNPVATEVYGEASATNLQRGNR

SEQ ID NO: 35946 - protein, 32 aa, Artificial Sequence
  Description of Artificial Sequence: Synthetic polypeptide
DEEEIRTTNPVATECYGSVSATNLQDRNGNDL

SEQ ID NO: 35947 - protein, 31 aa, Artificial Sequence
  Description of Artificial Sequence: Synthetic polypeptide
DEEEIRTTNPVATEQYGSVDTMELQDRGNDE

SEQ ID NO: 35948 - protein, 29 aa, Artificial Sequence
  Description of Artificial Sequence: Synthetic peptide
DEEEIRTTNPVATEQWGSVSENEMMQGNR

SEQ ID NO: 35949 - protein, 29 aa, Artificial Sequence
  Description of Artificial Sequence: Synthetic peptide
DEAEIRPTNPVATEQYGSVSTNLQEFPNV

SEQ ID NO: 35950 - protein, 30 aa, Artificial Sequence
  Description of Artificial Sequence: Synthetic polypeptide
DMEEIATTNPVATEQYGCTSTNLQFRNGNR

SEQ ID NO: 35951 - protein, 31 aa, Artificial Sequence
  Description of Artificial Sequence: Synthetic polypeptide
DEGEIRTTNPVATEQYGSVEESNLEQRTGNR

SEQ ID NO: 35952 - protein, 28 aa, Artificial Sequence
  Description of Artificial Sequence: Synthetic peptide
DEVEIRTTNPTATECFGSVSTNLQQGDR

SEQ ID NO: 35953 - protein, 28 aa, Artificial Sequence
  Description of Artificial Sequence: Synthetic peptide
GENEIRTTNPVATECYGSVSTNLQLGDQ

SEQ ID NO: 35954 - protein, 28 aa, Artificial Sequence
  Description of Artificial Sequence: Synthetic peptide
DEEEIATTNPVATEQYGSVDTDLQSENE

SEQ ID NO: 35955 - protein, 32 aa, Artificial Sequence
  Description of Artificial Sequence: Synthetic polypeptide
DEEEIRTTNPVATEQYGSVSTANEQEFGDNDR

SEQ ID NO: 35956 - protein, 31 aa, Artificial Sequence
  Description of Artificial Sequence: Synthetic polypeptide
DEEEIRTTNPVATEQYGSVSETELQERNGEW

SEQ ID NO: 35957 - protein, 31 aa, Artificial Sequence
  Description of Artificial Sequence: Synthetic polypeptide
DEEEIRTTNPVATEQYGSVDSTEDDQRGEER

SEQ ID NO: 35958 - protein, 30 aa, Artificial Sequence
  Description of Artificial Sequence: Synthetic polypeptide
MENEIRTTNPVATEQYGSVSTNLQENEGNM

SEQ ID NO: 35959 - protein, 29 aa, Artificial Sequence
  Description of Artificial Sequence: Synthetic peptide
DEEEIRTTNPVATEQYGDVSEMDLQVGNI

SEQ ID NO: 35960 - protein, 29 aa, Artificial Sequence
  Description of Artificial Sequence: Synthetic peptide
DEQEIRTTNPVATEQWGSVSENEQMRGNA

SEQ ID NO: 35961 - protein, 30 aa, Artificial Sequence
  Description of Artificial Sequence: Synthetic polypeptide
DEEEIRTTNPVATECYGSVSTDLEERKGNV

SEQ ID NO: 35962 - protein, 28 aa, Artificial Sequence
  Description of Artificial Sequence: Synthetic peptide
DEEEIRTTNPDATEQYGSVSTCEDPGNG

SEQ ID NO: 35963 - protein, 28 aa, Artificial Sequence
  Description of Artificial Sequence: Synthetic peptide
SEEEIRTTNPVATEQFGSVSENEQLGDR

SEQ ID NO: 35964 - protein, 30 aa, Artificial Sequence
  Description of Artificial Sequence: Synthetic polypeptide
SEEEIRTTNPVATEIYGSVSTNPQRSGINF

SEQ ID NO: 35965 - protein, 32 aa, Artificial Sequence
  Description of Artificial Sequence: Synthetic polypeptide
DEEEIATTNPVATEQYGSVDSENLVQRGENDR

SEQ ID NO: 35966 - protein, 28 aa, Artificial Sequence
  Description of Artificial Sequence: Synthetic peptide
DEEEICQTNPVATEQYGSVAMNLQRGGM

SEQ ID NO: 35967 - protein, 31 aa, Artificial Sequence
  Description of Artificial Sequence: Synthetic polypeptide
DEEEIRTTNPVATEQYGSVSTMNEQDIGDNG

SEQ ID NO: 35968 - protein, 30 aa, Artificial Sequence
  Description of Artificial Sequence: Synthetic polypeptide
QEDEIRTTNPVGTEQYGSVSTNLQREINDR

SEQ ID NO: 35969 - protein, 29 aa, Artificial Sequence
  Description of Artificial Sequence: Synthetic peptide
GEEEIRATNPVATECYGSVSETNLQRGEN

SEQ ID NO: 35970 - protein, 32 aa, Artificial Sequence
  Description of Artificial Sequence: Synthetic polypeptide
DEEEIRTTNPVATEQYGSYVSLTGPLVERGNR

SEQ ID NO: 35971 - protein, 30 aa, Artificial Sequence
  Description of Artificial Sequence: Synthetic polypeptide
DEEEIRTTNPVATEKWGSVLSTGLQTGLNR

SEQ ID NO: 35972 - protein, 30 aa, Artificial Sequence
  Description of Artificial Sequence: Synthetic polypeptide
SEQEIRTTNPCATEQYGSVSATNLQFRGNF

SEQ ID NO: 35973 - protein, 28 aa, Artificial Sequence
  Description of Artificial Sequence: Synthetic peptide
DEEEIRTTNPVATEQYGDVSENEQQGDF

SEQ ID NO: 35974 - protein, 28 aa, Artificial Sequence
  Description of Artificial Sequence: Synthetic peptide
DENEISTTNPVATECYGSASTDLQRGNA

SEQ ID NO: 35975 - protein, 32 aa, Artificial Sequence
  Description of Artificial Sequence: Synthetic polypeptide
DEEEIRTTNPVATEQYGYSVTSTLNLQEPGNN

SEQ ID NO: 35976 - protein, 28 aa, Artificial Sequence
  Description of Artificial Sequence: Synthetic peptide
DEGEVATTNPVATEMYGWVSNNLQRGNR

SEQ ID NO: 35977 - protein, 29 aa, Artificial Sequence
  Description of Artificial Sequence: Synthetic peptide
DEEEIRTTNPVATEQWGIVSENEQWRGTR

SEQ ID NO: 35978 - protein, 28 aa, Artificial Sequence
  Description of Artificial Sequence: Synthetic peptide
DEQEVRTTNPVATEQYGAVASNLERGNR

SEQ ID NO: 35979 - protein, 32 aa, Artificial Sequence
  Description of Artificial Sequence: Synthetic polypeptide
DEEEIRTTNPVATEQYGSVSETNLQVMEGENQ

SEQ ID NO: 35980 - protein, 32 aa, Artificial Sequence
  Description of Artificial Sequence: Synthetic polypeptide
DEEEIRTTNPVATEQYGSVSETNLQPDGDNEE

SEQ ID NO: 35981 - protein, 28 aa, Artificial Sequence
  Description of Artificial Sequence: Synthetic peptide
DEEEIATTNPVATEMYGGVSENPQRGTR

SEQ ID NO: 35982 - protein, 30 aa, Artificial Sequence
  Description of Artificial Sequence: Synthetic polypeptide
DENEIATTNPVADEQYGSVSATNLMRGPNR

SEQ ID NO: 35983 - protein, 28 aa, Artificial Sequence
  Description of Artificial Sequence: Synthetic peptide
SEEEIRATNPVCTEQFGEVSTCLQRGNR

SEQ ID NO: 35984 - protein, 30 aa, Artificial Sequence
  Description of Artificial Sequence: Synthetic polypeptide
DEEEIRTTNPVATEQYGSVDTELQQLVGNY

SEQ ID NO: 35985 - protein, 28 aa, Artificial Sequence
  Description of Artificial Sequence: Synthetic peptide
DEAEIRTTNPVCTEQYGSVDTPLQHGNI

SEQ ID NO: 35986 - protein, 28 aa, Artificial Sequence
  Description of Artificial Sequence: Synthetic peptide
DPEEIRTTNPVAYECYGSVSTPDQRGER

SEQ ID NO: 35987 - protein, 29 aa, Artificial Sequence
  Description of Artificial Sequence: Synthetic peptide
DEQEIRTTNPVATECYGSVSTELQRGEDM

SEQ ID NO: 35988 - protein, 31 aa, Artificial Sequence
  Description of Artificial Sequence: Synthetic polypeptide
DEEEIRTTNPVATEQYGSVSPTYNAPERGNI

SEQ ID NO: 35989 - protein, 29 aa, Artificial Sequence
  Description of Artificial Sequence: Synthetic peptide
SEEEICTTNCVATEQYGSVSTNLDREGPR

SEQ ID NO: 35990 - protein, 31 aa, Artificial Sequence
  Description of Artificial Sequence: Synthetic polypeptide
DEEEIATTNPVATECYGSVSTNLQETNGNDR

SEQ ID NO: 35991 - protein, 28 aa, Artificial Sequence
  Description of Artificial Sequence: Synthetic peptide
DEEEIRTTNPVSYELYGIVSTNLQNGNQ

SEQ ID NO: 35992 - protein, 31 aa, Artificial Sequence
  Description of Artificial Sequence: Synthetic polypeptide
VEEEIRTTNPVATEQYGSVSLTNLQEGENFF

SEQ ID NO: 35993 - protein, 30 aa, Artificial Sequence
  Description of Artificial Sequence: Synthetic polypeptide
DEEEIRATNPVATECYGSVSTNLQDFGNDS

SEQ ID NO: 35994 - protein, 28 aa, Artificial Sequence
  Description of Artificial Sequence: Synthetic peptide
DGEEIRCTNPVATEIYGVVSTNLQVGNT

SEQ ID NO: 35995 - protein, 32 aa, Artificial Sequence
  Description of Artificial Sequence: Synthetic polypeptide
DEEEIRATNPVATEQYGSVSDTNLQVRKGNDS

SEQ ID NO: 35996 - protein, 30 aa, Artificial Sequence
  Description of Artificial Sequence: Synthetic polypeptide
DEEEIRTTNPVATELYGSVATPNEVQRLNR

SEQ ID NO: 35997 - protein, 28 aa, Artificial Sequence
  Description of Artificial Sequence: Synthetic peptide
DEEEVRTTNPVSSEQYGVVSTNLQRGTQ

SEQ ID NO: 35998 - protein, 31 aa, Artificial Sequence
  Description of Artificial Sequence: Synthetic polypeptide
DEEEIRTTNPVATEQYGSVSTGNDEYNGENR

SEQ ID NO: 35999 - protein, 28 aa, Artificial Sequence
  Description of Artificial Sequence: Synthetic peptide
DEEEIATTNPVATEQYGSVSTDQEDGNA

SEQ ID NO: 36000 - protein, 29 aa, Artificial Sequence
  Description of Artificial Sequence: Synthetic peptide
DEEEIRQTNPVATEGYGSCSTQLQRAGTR

SEQ ID NO: 36001 - protein, 28 aa, Artificial Sequence
  Description of Artificial Sequence: Synthetic peptide
DEEEIRTTNPVSTEQYGSVSENEMQGNQ

SEQ ID NO: 36002 - protein, 28 aa, Artificial Sequence
  Description of Artificial Sequence: Synthetic peptide
SEEEIRTTNPVATELWGSVSTNEMRGDR

SEQ ID NO: 36003 - protein, 29 aa, Artificial Sequence
  Description of Artificial Sequence: Synthetic peptide
DETEIRTTNPVATEQYGSVSDELQMNGNQ

SEQ ID NO: 36004 - protein, 30 aa, Artificial Sequence
  Description of Artificial Sequence: Synthetic polypeptide
QEEEIRTTNPVATEQYGSVSTDLQLDNGND

SEQ ID NO: 36005 - protein, 28 aa, Artificial Sequence
  Description of Artificial Sequence: Synthetic peptide
DEEEIATTNPTATEQYGGVSTNEQQGTR

SEQ ID NO: 36006 - protein, 28 aa, Artificial Sequence
  Description of Artificial Sequence: Synthetic peptide
SEEEIRTTNPTATEQFGSVSTNPQLGNA

SEQ ID NO: 36007 - protein, 31 aa, Artificial Sequence
  Description of Artificial Sequence: Synthetic polypeptide
DEEEIRTTNPVATEQYGSVSTTGLDQGVNDR

SEQ ID NO: 36008 - protein, 31 aa, Artificial Sequence
  Description of Artificial Sequence: Synthetic polypeptide
DEEEIRTTNPVATEQYGSVSTNLERDGDEEF

SEQ ID NO: 36009 - protein, 29 aa, Artificial Sequence
  Description of Artificial Sequence: Synthetic peptide
QEGEISTTNPVATEQYGSVSTNQFERGNR

SEQ ID NO: 36010 - protein, 31 aa, Artificial Sequence
  Description of Artificial Sequence: Synthetic polypeptide
DEEEIRTTNPVATEQYGSVSTDLQDQEGEDR

SEQ ID NO: 36011 - protein, 30 aa, Artificial Sequence
  Description of Artificial Sequence: Synthetic polypeptide
KEEEIRTTNPVATEQYGSASTELQERQGNN

SEQ ID NO: 36012 - protein, 28 aa, Artificial Sequence
  Description of Artificial Sequence: Synthetic peptide
DEEEIATTNPVATECYGSVSTDLQVGEL

SEQ ID NO: 36013 - protein, 31 aa, Artificial Sequence
  Description of Artificial Sequence: Synthetic polypeptide
DEEEIATTNPVATEIYGSVISTNLQIGINDR

SEQ ID NO: 36014 - protein, 31 aa, Artificial Sequence
  Description of Artificial Sequence: Synthetic polypeptide
DEEEIRTTNPVATEQYGSVSTNLQENEGEEI

SEQ ID NO: 36015 - protein, 31 aa, Artificial Sequence
  Description of Artificial Sequence: Synthetic polypeptide
MEEEIRTTNPVATEQYGSVSTNLQDAEGNDN

SEQ ID NO: 36016 - protein, 31 aa, Artificial Sequence
  Description of Artificial Sequence: Synthetic polypeptide
DENEIATTNPVATEQYGSVSTNLQEREGNDM

SEQ ID NO: 36017 - protein, 28 aa, Artificial Sequence
  Description of Artificial Sequence: Synthetic peptide
DEEEIRTTNPVATEQYGSYSTEEEIGNY

SEQ ID NO: 36018 - protein, 28 aa, Artificial Sequence
  Description of Artificial Sequence: Synthetic peptide
SEEEIATTNPVATEQYGSVNTNEQREDR

SEQ ID NO: 36019 - protein, 28 aa, Artificial Sequence
  Description of Artificial Sequence: Synthetic peptide
ADEEIRTTNPVATEQWGGVSTNLQIGNY

SEQ ID NO: 36020 - protein, 28 aa, Artificial Sequence
  Description of Artificial Sequence: Synthetic peptide
DEEEIRTTNPEATEQYGSVSTDLDQEDR

SEQ ID NO: 36021 - protein, 28 aa, Artificial Sequence
  Description of Artificial Sequence: Synthetic peptide
DEEEIRTTNPDATEQYGSVSTEEDRGEP

SEQ ID NO: 36022 - protein, 28 aa, Artificial Sequence
  Description of Artificial Sequence: Synthetic peptide
DENEIRTTNPVATEQWGSVSTNLMQEDR

SEQ ID NO: 36023 - protein, 29 aa, Artificial Sequence
  Description of Artificial Sequence: Synthetic peptide
DEEEIATTNPVATECYGSVSTDLQHEGNL

SEQ ID NO: 36024 - protein, 29 aa, Artificial Sequence
  Description of Artificial Sequence: Synthetic peptide
DENEIVTTNPVATEQYGSASENLMRAGNR

SEQ ID NO: 36025 - protein, 31 aa, Artificial Sequence
  Description of Artificial Sequence: Synthetic polypeptide
DEEEIRTTNPVATEQYGSVSCTMDLQYGNDD

SEQ ID NO: 36026 - protein, 31 aa, Artificial Sequence
  Description of Artificial Sequence: Synthetic polypeptide
DENEIRTTNPVATEQYGSVISFTNLQERGDF

SEQ ID NO: 36027 - protein, 30 aa, Artificial Sequence
  Description of Artificial Sequence: Synthetic polypeptide
DEEEIRTTNPVATEQYGSVSCEDLQCHGND

SEQ ID NO: 36028 - protein, 28 aa, Artificial Sequence
  Description of Artificial Sequence: Synthetic peptide
DEEEIRSTNPVATEAYGSASELLQRGNN

SEQ ID NO: 36029 - protein, 30 aa, Artificial Sequence
  Description of Artificial Sequence: Synthetic polypeptide
DEEEIRTTNPTATEQYGSVSTMNEQQGDNS

SEQ ID NO: 36030 - protein, 29 aa, Artificial Sequence
  Description of Artificial Sequence: Synthetic peptide
DEQEIRTTNPVATELYGSVSTNLQVGDDT

SEQ ID NO: 36031 - protein, 31 aa, Artificial Sequence
  Description of Artificial Sequence: Synthetic polypeptide
DEEEIRTTNPVATEQYGSVSDTNLELPKGND

SEQ ID NO: 36032 - protein, 28 aa, Artificial Sequence
  Description of Artificial Sequence: Synthetic peptide
DEEEIRTTNPMATDQYGSVATNLDHGER

SEQ ID NO: 36033 - protein, 29 aa, Artificial Sequence
  Description of Artificial Sequence: Synthetic peptide
DEEEIRTTNPVATEQYGSAPENCMRAGNR

SEQ ID NO: 36034 - protein, 30 aa, Artificial Sequence
  Description of Artificial Sequence: Synthetic polypeptide
DEEEIGTVNPEATECYGSVSTNLQRGLNTR

SEQ ID NO: 36035 - protein, 28 aa, Artificial Sequence
  Description of Artificial Sequence: Synthetic peptide
DEEEIRTTNPVATEQYGSVFTPDDDGND

SEQ ID NO: 36036 - protein, 29 aa, Artificial Sequence
  Description of Artificial Sequence: Synthetic peptide
DEEEIRTTNPTATEMYGSVSENEQQGNTR

SEQ ID NO: 36037 - protein, 32 aa, Artificial Sequence
  Description of Artificial Sequence: Synthetic polypeptide
DEEEIRTTNPVATEQYGSVDCTMDLQCRGNDR

SEQ ID NO: 36038 - protein, 31 aa, Artificial Sequence
  Description of Artificial Sequence: Synthetic polypeptide
DEEEIRTTNPVATEQYGSVSTNLEDRGEEDH

SEQ ID NO: 36039 - protein, 29 aa, Artificial Sequence
  Description of Artificial Sequence: Synthetic peptide
DEEEIRTTNPVATEWWGSVDTNEQWVGNR

SEQ ID NO: 36040 - protein, 28 aa, Artificial Sequence
  Description of Artificial Sequence: Synthetic peptide
DEQEIVATNPVATEIYGVVGTNLQRGNR

SEQ ID NO: 36041 - protein, 28 aa, Artificial Sequence
  Description of Artificial Sequence: Synthetic peptide
DEEEIRCTNPVATEQYGSVSDNLQLLDF

SEQ ID NO: 36042 - protein, 31 aa, Artificial Sequence
  Description of Artificial Sequence: Synthetic polypeptide
DEEEIRTTNPVATEQYGSVDSATNQQDGEDR

SEQ ID NO: 36043 - protein, 28 aa, Artificial Sequence
  Description of Artificial Sequence: Synthetic peptide
DEVEIRCTNPVATELYGSVSENWQRGNQ

SEQ ID NO: 36044 - protein, 29 aa, Artificial Sequence
  Description of Artificial Sequence: Synthetic peptide
DEEEIKTTNPVATEQFGSVSTNWQRLENF

SEQ ID NO: 36045 - protein, 28 aa, Artificial Sequence
  Description of Artificial Sequence: Synthetic peptide
QESEIRTTNPVATEQFGSVSDNLQRGMI

SEQ ID NO: 36046 - protein, 28 aa, Artificial Sequence
  Description of Artificial Sequence: Synthetic peptide
DEEEIVSTNPVATEQYGLVSTNWQSGNF

SEQ ID NO: 36047 - protein, 28 aa, Artificial Sequence
  Description of Artificial Sequence: Synthetic peptide
DEEEITATNPVATEIYGVVATNLQRGTR

SEQ ID NO: 36048 - protein, 29 aa, Artificial Sequence
  Description of Artificial Sequence: Synthetic peptide
DEQEIRTTNPVATEMYGSVSTELQDIGNM

SEQ ID NO: 36049 - protein, 32 aa, Artificial Sequence
  Description of Artificial Sequence: Synthetic polypeptide
DEEEIRTTNPVATEQYGSVSNTHNLNDRNGNS

SEQ ID NO: 36050 - protein, 28 aa, Artificial Sequence
  Description of Artificial Sequence: Synthetic peptide
DEEEIRTTNPVATEQYGSYDTALQTGTS

SEQ ID NO: 36051 - protein, 28 aa, Artificial Sequence
  Description of Artificial Sequence: Synthetic peptide
DEEEIRTVNPVGTEWYGSNSTNLQNGER

SEQ ID NO: 36052 - protein, 28 aa, Artificial Sequence
  Description of Artificial Sequence: Synthetic peptide
DEQEIRTTNPVATEQYGSVSTELDQGDN

SEQ ID NO: 36053 - protein, 28 aa, Artificial Sequence
  Description of Artificial Sequence: Synthetic peptide
DEEEIVTTNPVATECYGSVSTDLESGNL

SEQ ID NO: 36054 - protein, 28 aa, Artificial Sequence
  Description of Artificial Sequence: Synthetic peptide
DENEIASVNPVAYEMYGSVSTNLQRGNR

SEQ ID NO: 36055 - protein, 28 aa, Artificial Sequence
  Description of Artificial Sequence: Synthetic peptide
DEEEIRTTNPDATEQYGSVSTPDDPGNG

SEQ ID NO: 36056 - protein, 28 aa, Artificial Sequence
  Description of Artificial Sequence: Synthetic peptide
DEEEIRTTNPVATEQYWSVETDLERGEN

SEQ ID NO: 36057 - protein, 30 aa, Artificial Sequence
  Description of Artificial Sequence: Synthetic polypeptide
CEEEIRTTNPVATEQYGNVSTNLVQFDGNY

SEQ ID NO: 36058 - protein, 28 aa, Artificial Sequence
  Description of Artificial Sequence: Synthetic peptide
SEEEISCTNPTATEQYGQVSTNLQLGNR

SEQ ID NO: 36059 - protein, 28 aa, Artificial Sequence
  Description of Artificial Sequence: Synthetic peptide
SEAEIRATNPVATEQYGEVSTNDQRGNE

SEQ ID NO: 36060 - protein, 28 aa, Artificial Sequence
  Description of Artificial Sequence: Synthetic peptide
QEQEIVTTNPVATEQYGEASENLQRGNR

SEQ ID NO: 36061 - protein, 29 aa, Artificial Sequence
  Description of Artificial Sequence: Synthetic peptide
DEEEIRTTNPVATEQYGEVSEVLQHAGER

SEQ ID NO: 36062 - protein, 28 aa, Artificial Sequence
  Description of Artificial Sequence: Synthetic peptide
DEEEIATTNPVATEQYGVVSEDLQLGNS

SEQ ID NO: 36063 - protein, 30 aa, Artificial Sequence
  Description of Artificial Sequence: Synthetic polypeptide
DEEEIRTTNPVATECYGSVSDTNLQQNGET

SEQ ID NO: 36064 - protein, 29 aa, Artificial Sequence
  Description of Artificial Sequence: Synthetic peptide
DEEEIGTTNPVATEQYGCVSTNGGQIGNF

SEQ ID NO: 36065 - protein, 30 aa, Artificial Sequence
  Description of Artificial Sequence: Synthetic polypeptide
SEEEIATTNPVATEQYGSVSTMNEQNGNTR

SEQ ID NO: 36066 - protein, 28 aa, Artificial Sequence
  Description of Artificial Sequence: Synthetic peptide
DEENIRTTNPVATYQYGVVSTNLQVENP

SEQ ID NO: 36067 - protein, 28 aa, Artificial Sequence
  Description of Artificial Sequence: Synthetic peptide
DEQEIRTTNPVATEQWGSVSTNEELGNF

SEQ ID NO: 36068 - protein, 29 aa, Artificial Sequence
  Description of Artificial Sequence: Synthetic peptide
DEEEICATNPVATELYGSVSTMNLQRLDR

SEQ ID NO: 36069 - protein, 31 aa, Artificial Sequence
  Description of Artificial Sequence: Synthetic polypeptide
DEEEIRTTNPVATEQYGSVSITNLEIIGNDN

SEQ ID NO: 36070 - protein, 30 aa, Artificial Sequence
  Description of Artificial Sequence: Synthetic polypeptide
VEEEIRTTNPIATEQYGCVSAMNLQRGENR

SEQ ID NO: 36071 - protein, 28 aa, Artificial Sequence
  Description of Artificial Sequence: Synthetic peptide
VEEEIRTTNPVATEIYGTVSENLQAGNY

SEQ ID NO: 36072 - protein, 28 aa, Artificial Sequence
  Description of Artificial Sequence: Synthetic peptide
LESEIQTTNPVATGQYGSVSENLQRENR

SEQ ID NO: 36073 - protein, 29 aa, Artificial Sequence
  Description of Artificial Sequence: Synthetic peptide
DEEEIRTTNPVATEQWGSYSEAQQQRGNR

SEQ ID NO: 36074 - protein, 31 aa, Artificial Sequence
  Description of Artificial Sequence: Synthetic polypeptide
DEEEIRTTNPVATEQYGESVSTEDPQRGDNT

SEQ ID NO: 36075 - protein, 30 aa, Artificial Sequence
  Description of Artificial Sequence: Synthetic polypeptide
DEECIRTTNPVAFEQYGDVSQTPLQRGNNR

SEQ ID NO: 36076 - protein, 32 aa, Artificial Sequence
  Description of Artificial Sequence: Synthetic polypeptide
DEEEIRTTNPVATEQYGSVESITMPLQERGNF

SEQ ID NO: 36077 - protein, 30 aa, Artificial Sequence
  Description of Artificial Sequence: Synthetic polypeptide
QEEEIRTTNPVATEQYGWVSATNLEMRGMR

SEQ ID NO: 36078 - protein, 33 aa, Artificial Sequence
  Description of Artificial Sequence: Synthetic polypeptide
DEEEIRTTNPVATEQYGSVSDTENLQERGDNDI

SEQ ID NO: 36079 - protein, 30 aa, Artificial Sequence
  Description of Artificial Sequence: Synthetic polypeptide
DEEEIRTTNPVATEQWGSVSTNLQNQGTDM

SEQ ID NO: 36080 - protein, 28 aa, Artificial Sequence
  Description of Artificial Sequence: Synthetic peptide
DENEIRTTNPVATEQYGSVAANLQNDNM

SEQ ID NO: 36081 - protein, 29 aa, Artificial Sequence
  Description of Artificial Sequence: Synthetic peptide
DEEEIRTTNPCATELYGVVSSGNLQRGNV

SEQ ID NO: 36082 - protein, 31 aa, Artificial Sequence
  Description of Artificial Sequence: Synthetic polypeptide
DEEEIRTTNPVATEQYGDVSCTELQCRGNDA

SEQ ID NO: 36083 - protein, 28 aa, Artificial Sequence
  Description of Artificial Sequence: Synthetic peptide
DEEEIRTTNPVATEQYGSVETNEEREDS

SEQ ID NO: 36084 - protein, 29 aa, Artificial Sequence
  Description of Artificial Sequence: Synthetic peptide
DEHEIACTNPVATEQYGSVSENLQCAGNR

SEQ ID NO: 36085 - protein, 31 aa, Artificial Sequence
  Description of Artificial Sequence: Synthetic polypeptide
DEEEIRTTNPVATEQYGSVSTNLQDIKGEDN

SEQ ID NO: 36086 - protein, 31 aa, Artificial Sequence
  Description of Artificial Sequence: Synthetic polypeptide
DEEEIRTTNPTATEQYGSVSTGNLQENGDNQ

SEQ ID NO: 36087 - protein, 28 aa, Artificial Sequence
  Description of Artificial Sequence: Synthetic peptide
DENEIATTNPVATEQYGSVSTELQDGEF

SEQ ID NO: 36088 - protein, 28 aa, Artificial Sequence
  Description of Artificial Sequence: Synthetic peptide
DEEEIRTTNPVSTEQYGSVDTNDQTGDY

SEQ ID NO: 36089 - protein, 29 aa, Artificial Sequence
  Description of Artificial Sequence: Synthetic peptide
KEEEIRTTNPVATEQYGVVSTELQHGNDD

SEQ ID NO: 36090 - protein, 28 aa, Artificial Sequence
  Description of Artificial Sequence: Synthetic peptide
DEEEIATTNPVATECYGSVSTDLERGEL

SEQ ID NO: 36091 - protein, 29 aa, Artificial Sequence
  Description of Artificial Sequence: Synthetic peptide
DEQEIRTTNPVATEWYGSVSTNLQEVGDN

SEQ ID NO: 36092 - protein, 32 aa, Artificial Sequence
  Description of Artificial Sequence: Synthetic polypeptide
DEEEIRTTNPVATEQYGESVTETNLVQRGTNQ

SEQ ID NO: 36093 - protein, 31 aa, Artificial Sequence
  Description of Artificial Sequence: Synthetic polypeptide
DEEEIRTTNPVATEQYGSVSETNLEPDGNED

SEQ ID NO: 36094 - protein, 28 aa, Artificial Sequence
  Description of Artificial Sequence: Synthetic peptide
DEEEIRTTNPFATEQYGSVSAGPQNGLR

SEQ ID NO: 36095 - protein, 33 aa, Artificial Sequence
  Description of Artificial Sequence: Synthetic polypeptide
DEEEIRTTNPVATEQYGSVCSTEDLQRKGENDR

SEQ ID NO: 36096 - protein, 30 aa, Artificial Sequence
  Description of Artificial Sequence: Synthetic polypeptide
DEEEIRTTNPVATEQYGSVSTELEEYEGNS

SEQ ID NO: 36097 - protein, 29 aa, Artificial Sequence
  Description of Artificial Sequence: Synthetic peptide
DEEEIRTTNPVATEQWGDHVSTNEQRENA

SEQ ID NO: 36098 - protein, 28 aa, Artificial Sequence
  Description of Artificial Sequence: Synthetic peptide
AEEELRTTNPVYYEQFGTVSTNLQRGNR

SEQ ID NO: 36099 - protein, 28 aa, Artificial Sequence
  Description of Artificial Sequence: Synthetic peptide
DEEEIRTTNPVAFQQYGSVSHPDQRGNP

SEQ ID NO: 36100 - protein, 28 aa, Artificial Sequence
  Description of Artificial Sequence: Synthetic peptide
DEEEIRTTNPEATEQYGSVSTPDQEGEQ

SEQ ID NO: 36101 - protein, 28 aa, Artificial Sequence
  Description of Artificial Sequence: Synthetic peptide
MENEIATTNPVATEQYGSVSTELQVGNY

SEQ ID NO: 36102 - protein, 31 aa, Artificial Sequence
  Description of Artificial Sequence: Synthetic polypeptide
DEEEIRTTNPVATEQYGSVSTNGLPNFGYNT

SEQ ID NO: 36103 - protein, 28 aa, Artificial Sequence
  Description of Artificial Sequence: Synthetic peptide
HEEEIRTTNPVCTEQWGSVSTDLQRGTA

SEQ ID NO: 36104 - protein, 28 aa, Artificial Sequence
  Description of Artificial Sequence: Synthetic peptide
DEEMIRTTNPVAWESYGSVSTGLQPGLR

SEQ ID NO: 36105 - protein, 28 aa, Artificial Sequence
  Description of Artificial Sequence: Synthetic peptide
SEEEIATTNPTATAQYGSVSTNLQRGLG

SEQ ID NO: 36106 - protein, 32 aa, Artificial Sequence
  Description of Artificial Sequence: Synthetic polypeptide
DEEEIRTTNPVATEQYGCVSDTTNPLQREGNA

SEQ ID NO: 36107 - protein, 29 aa, Artificial Sequence
  Description of Artificial Sequence: Synthetic peptide
DEEEIRTTNPVATEQYGSVSMDLQDNGDS

SEQ ID NO: 36108 - protein, 28 aa, Artificial Sequence
  Description of Artificial Sequence: Synthetic peptide
DPEEIRTTNPVATEQYGSVFTPDDDGNR

SEQ ID NO: 36109 - protein, 29 aa, Artificial Sequence
  Description of Artificial Sequence: Synthetic peptide
DENEIRTTNPVATEQYGDASCTNLQRENN

SEQ ID NO: 36110 - protein, 28 aa, Artificial Sequence
  Description of Artificial Sequence: Synthetic peptide
DEEEIRTTNPDATEQYGSVSTPDDRGET

SEQ ID NO: 36111 - protein, 28 aa, Artificial Sequence
  Description of Artificial Sequence: Synthetic peptide
DEEEIRTTNPDATEQYGSVSTELQMDEE

SEQ ID NO: 36112 - protein, 29 aa, Artificial Sequence
  Description of Artificial Sequence: Synthetic peptide
DEEEIRTTNPVATEQYGVVSENLQNGEDL

SEQ ID NO: 36113 - protein, 28 aa, Artificial Sequence
  Description of Artificial Sequence: Synthetic peptide
DEQEIATTNPVATECYGSVSTNLQHGEL

SEQ ID NO: 36114 - protein, 28 aa, Artificial Sequence
  Description of Artificial Sequence: Synthetic peptide
DEHEIRTTNPVATEMYGSAACNLQRGNA

SEQ ID NO: 36115 - protein, 31 aa, Artificial Sequence
  Description of Artificial Sequence: Synthetic polypeptide
DEEEIRCTNPVATEQYGVSVFSTNLQHGNME

SEQ ID NO: 36116 - protein, 30 aa, Artificial Sequence
  Description of Artificial Sequence: Synthetic polypeptide
DENEIRTTNPVATEQYGSVSCTCNDQHENR

SEQ ID NO: 36117 - protein, 29 aa, Artificial Sequence
  Description of Artificial Sequence: Synthetic peptide
DEEEIVTTNPVATEQYGIVSTVNDQEGER

SEQ ID NO: 36118 - protein, 29 aa, Artificial Sequence
  Description of Artificial Sequence: Synthetic peptide
DEEEIRCTNPVATEQYGTVSADNLQWGNE

SEQ ID NO: 36119 - protein, 31 aa, Artificial Sequence
  Description of Artificial Sequence: Synthetic polypeptide
DEEEIRTTNPVATEQYGSVSTNLEEDGENDD

SEQ ID NO: 36120 - protein, 28 aa, Artificial Sequence
  Description of Artificial Sequence: Synthetic peptide
DEEEISATNPEATEQYGTVSENLQEGNR

SEQ ID NO: 36121 - protein, 28 aa, Artificial Sequence
  Description of Artificial Sequence: Synthetic peptide
DEQEIYTTNPVATEQYGDVSTNPARGER

SEQ ID NO: 36122 - protein, 28 aa, Artificial Sequence
  Description of Artificial Sequence: Synthetic peptide
DENEIRTTNPVATEQYGTVDTELCNGNT

SEQ ID NO: 36123 - protein, 32 aa, Artificial Sequence
  Description of Artificial Sequence: Synthetic polypeptide
DEEEIRTTNPVATEQYGSVSCTMELCDYGNDR

SEQ ID NO: 36124 - protein, 30 aa, Artificial Sequence
  Description of Artificial Sequence: Synthetic polypeptide
DEEEIATTNPVATEQYGSVSTDLQINGEDL

SEQ ID NO: 36125 - protein, 28 aa, Artificial Sequence
  Description of Artificial Sequence: Synthetic peptide
DEVEIATTNPVATECYGTVSTDWQHGNR

SEQ ID NO: 36126 - protein, 29 aa, Artificial Sequence
  Description of Artificial Sequence: Synthetic peptide
DEREIVATNPVSTEQYGSVSENLQRGADR

SEQ ID NO: 36127 - protein, 28 aa, Artificial Sequence
  Description of Artificial Sequence: Synthetic peptide
DEVEIRTTNPVATEVYGSVSEALETGNG

SEQ ID NO: 36128 - protein, 32 aa, Artificial Sequence
  Description of Artificial Sequence: Synthetic polypeptide
DEEEIRTTNPVATEQYGSVSCTMDLQCGGNDF

SEQ ID NO: 36129 - protein, 34 aa, Artificial Sequence
  Description of Artificial Sequence: Synthetic polypeptide
DEEEIRTTNPVATEQYGSVISTMNLPQLREGDNF

SEQ ID NO: 36130 - protein, 30 aa, Artificial Sequence
  Description of Artificial Sequence: Synthetic polypeptide
DEVEIATTNPAATEQYGSVSTCNLQNGPNE

SEQ ID NO: 36131 - protein, 31 aa, Artificial Sequence
  Description of Artificial Sequence: Synthetic polypeptide
DEEEIRTTNPVATEQYGSVSTDLEDVNGNDN

SEQ ID NO: 36132 - protein, 30 aa, Artificial Sequence
  Description of Artificial Sequence: Synthetic polypeptide
SEEEITTTNPEATEQYGSVSTMNLEQRGDF

SEQ ID NO: 36133 - protein, 31 aa, Artificial Sequence
  Description of Artificial Sequence: Synthetic polypeptide
QEEEIRTTNPVATEQYGSVSTCDLQERDPMR

SEQ ID NO: 36134 - protein, 28 aa, Artificial Sequence
  Description of Artificial Sequence: Synthetic peptide
DEEEIRTVNIVATENYGEVGTVIQRGNR

SEQ ID NO: 36135 - protein, 29 aa, Artificial Sequence
  Description of Artificial Sequence: Synthetic peptide
DENEIRTTNPVATEQWGSVSENEMMRGNA

SEQ ID NO: 36136 - protein, 28 aa, Artificial Sequence
  Description of Artificial Sequence: Synthetic peptide
QEEEISQTNPVATEQYGWVSTNLQNGEG

SEQ ID NO: 36137 - protein, 29 aa, Artificial Sequence
  Description of Artificial Sequence: Synthetic peptide
DEEEIRTTNPVATEQYGDVSECLQCHGEQ

SEQ ID NO: 36138 - protein, 30 aa, Artificial Sequence
  Description of Artificial Sequence: Synthetic polypeptide
DEEEIRTTNPVATECYGSVSTELQETEGEM

SEQ ID NO: 36139 - protein, 29 aa, Artificial Sequence
  Description of Artificial Sequence: Synthetic peptide
DEEEIRTTNPVATEQWGIVSENEQWRGTL

SEQ ID NO: 36140 - protein, 28 aa, Artificial Sequence
  Description of Artificial Sequence: Synthetic peptide
DEEEIRQTNPVATEQYGDVSTEPQIGEY

SEQ ID NO: 36141 - protein, 31 aa, Artificial Sequence
  Description of Artificial Sequence: Synthetic polypeptide
DEEEIRTTNPIATEQYGSVATNLPQMRKELR

SEQ ID NO: 36142 - protein, 28 aa, Artificial Sequence
  Description of Artificial Sequence: Synthetic peptide
AEEEIVTTNPVATEQYGEVSTDPQGGDR

SEQ ID NO: 36143 - protein, 32 aa, Artificial Sequence
  Description of Artificial Sequence: Synthetic polypeptide
DEEEIRTTNPVATEQWGSVSTINEPQDRGENG

SEQ ID NO: 36144 - protein, 31 aa, Artificial Sequence
  Description of Artificial Sequence: Synthetic polypeptide
DEEEIRTTNPVATECYGSVSTDLQDTKGEDR

SEQ ID NO: 36145 - protein, 28 aa, Artificial Sequence
  Description of Artificial Sequence: Synthetic peptide
MEEEIRTTNPVATEQYGWVSEDEQNGNM

SEQ ID NO: 36146 - protein, 29 aa, Artificial Sequence
  Description of Artificial Sequence: Synthetic peptide
DEEEIRTTNPVATEQYGSVSCEDWCHGNA

SEQ ID NO: 36147 - protein, 28 aa, Artificial Sequence
  Description of Artificial Sequence: Synthetic peptide
DEEEIRTTNPDATQQYGSVSTPDDDGNF

SEQ ID NO: 36148 - protein, 30 aa, Artificial Sequence
  Description of Artificial Sequence: Synthetic polypeptide
DEQEIATTNPVATEQYGSVSTNLENGENDI

SEQ ID NO: 36149 - protein, 28 aa, Artificial Sequence
  Description of Artificial Sequence: Synthetic peptide
DDEEIRTTNPVATEQYGSVSTADFQDNV

SEQ ID NO: 36150 - protein, 30 aa, Artificial Sequence
  Description of Artificial Sequence: Synthetic polypeptide
DEEEIRTTNPEATEQYGSVSTENLEDEGDF

SEQ ID NO: 36151 - protein, 28 aa, Artificial Sequence
  Description of Artificial Sequence: Synthetic peptide
VEEEIRATNPVCTEQYGSVSDNLQYGQV

SEQ ID NO: 36152 - protein, 28 aa, Artificial Sequence
  Description of Artificial Sequence: Synthetic peptide
DEEEIRTTNEVRTDQQGSTSTNLRRMNR

SEQ ID NO: 36153 - protein, 28 aa, Artificial Sequence
  Description of Artificial Sequence: Synthetic peptide
NEEEIRTTNPVATEQYGSADTDWQQGNS

SEQ ID NO: 36154 - protein, 29 aa, Artificial Sequence
  Description of Artificial Sequence: Synthetic peptide
DEEEIRTTNPVATEQYGDVSENLQEHEEM

SEQ ID NO: 36155 - protein, 28 aa, Artificial Sequence
  Description of Artificial Sequence: Synthetic peptide
DEEEIRTTNPVATEQYGTTSTEDETGNI

SEQ ID NO: 36156 - protein, 28 aa, Artificial Sequence
  Description of Artificial Sequence: Synthetic peptide
KENEIAATNPVATECYGSVSTELQRGNY

SEQ ID NO: 36157 - protein, 28 aa, Artificial Sequence
  Description of Artificial Sequence: Synthetic peptide
DEETIATTNPEATECYGSVSTNEQHGNF

SEQ ID NO: 36158 - protein, 28 aa, Artificial Sequence
  Description of Artificial Sequence: Synthetic peptide
DEEEIRTTNPVATECWGSVSENLMTGTF

SEQ ID NO: 36159 - protein, 28 aa, Artificial Sequence
  Description of Artificial Sequence: Synthetic peptide
YEEEIATTNPVCTEQYGVVSDNLQSGNQ

SEQ ID NO: 36160 - protein, 30 aa, Artificial Sequence
  Description of Artificial Sequence: Synthetic polypeptide
DEEEIRTTNPVATEQYGSVSDNLQEHEEDN

SEQ ID NO: 36161 - protein, 28 aa, Artificial Sequence
  Description of Artificial Sequence: Synthetic peptide
DEQEIATVNPVSTEQYGSVSENLQHGGR

SEQ ID NO: 36162 - protein, 28 aa, Artificial Sequence
  Description of Artificial Sequence: Synthetic peptide
DEEEIRTTNPVSTEWWGSVSTALMRGTM

SEQ ID NO: 36163 - protein, 28 aa, Artificial Sequence
  Description of Artificial Sequence: Synthetic peptide
DEEEIVTTNPVATEQFGSVSTSLQCPEI

SEQ ID NO: 36164 - protein, 29 aa, Artificial Sequence
  Description of Artificial Sequence: Synthetic peptide
DEEEIRTTNPVASEQYGTVSTDWQESGNT

SEQ ID NO: 36165 - protein, 29 aa, Artificial Sequence
  Description of Artificial Sequence: Synthetic peptide
DEQEIRTTNPVATECWGSVSENLMMQGNR

SEQ ID NO: 36166 - protein, 28 aa, Artificial Sequence
  Description of Artificial Sequence: Synthetic peptide
DEEEIATTNPTATEQYGGVSENPQVGNA

SEQ ID NO: 36167 - protein, 29 aa, Artificial Sequence
  Description of Artificial Sequence: Synthetic peptide
DENEIGCTNPVATEQYGSASATVLQRGGR

SEQ ID NO: 36168 - protein, 28 aa, Artificial Sequence
  Description of Artificial Sequence: Synthetic peptide
DEQEIRATNPVASEIYGCVATNLERGNR

SEQ ID NO: 36169 - protein, 28 aa, Artificial Sequence
  Description of Artificial Sequence: Synthetic peptide
DEQEIRTTNPVATEQYGSVDTDEDRGEP

SEQ ID NO: 36170 - protein, 32 aa, Artificial Sequence
  Description of Artificial Sequence: Synthetic polypeptide
DEEEIATTNPTATEQYGSVSTGNPQLQEGDNR

SEQ ID NO: 36171 - protein, 29 aa, Artificial Sequence
  Description of Artificial Sequence: Synthetic peptide
DEEEIRTVNPVATECYGSVSTEPDERGMR

SEQ ID NO: 36172 - protein, 28 aa, Artificial Sequence
  Description of Artificial Sequence: Synthetic peptide
DEEEVRATNPVATEQYGCVATNLQRLPQ

SEQ ID NO: 36173 - protein, 29 aa, Artificial Sequence
  Description of Artificial Sequence: Synthetic peptide
DEQEIATTNPVATECYGSVSTDLQHEGNL

SEQ ID NO: 36174 - protein, 30 aa, Artificial Sequence
  Description of Artificial Sequence: Synthetic polypeptide
DEEEIRTTNPVATEQYGSVSENPQEFGPDI

SEQ ID NO: 36175 - protein, 31 aa, Artificial Sequence
  Description of Artificial Sequence: Synthetic polypeptide
DEEEIRTTNPVATEQYGSVSTNLEEVEGEDF

SEQ ID NO: 36176 - protein, 30 aa, Artificial Sequence
  Description of Artificial Sequence: Synthetic polypeptide
DEGEIRTTNPVATECYGWVSTNLQVNGNDT

SEQ ID NO: 36177 - protein, 32 aa, Artificial Sequence
  Description of Artificial Sequence: Synthetic polypeptide
DEEEIRTTNPVATEQYGSVSATNLELDNGNDD

SEQ ID NO: 36178 - protein, 32 aa, Artificial Sequence
  Description of Artificial Sequence: Synthetic polypeptide
DEEEIRTTNPVATEQYGSVDCTMNLQCVGNDN

SEQ ID NO: 36179 - protein, 33 aa, Artificial Sequence
  Description of Artificial Sequence: Synthetic polypeptide
DEEEIRTTNPDATEQYGSVSTNPLVEDREGENR

SEQ ID NO: 36180 - protein, 29 aa, Artificial Sequence
  Description of Artificial Sequence: Synthetic peptide
DEEEIRTTNPVATEQYGSVSDNEQNEEPS

SEQ ID NO: 36181 - protein, 28 aa, Artificial Sequence
  Description of Artificial Sequence: Synthetic peptide
QEEEIRTTNPVATYQYGSVSEVLYGGNN

SEQ ID NO: 36182 - protein, 30 aa, Artificial Sequence
  Description of Artificial Sequence: Synthetic polypeptide
MENEIRTTNPVATEQYGSVSTDLQENGNDM

SEQ ID NO: 36183 - protein, 30 aa, Artificial Sequence
  Description of Artificial Sequence: Synthetic polypeptide
DENEIRQTNPVSTEQYGEVSAENLQRAGNR

SEQ ID NO: 36184 - protein, 28 aa, Artificial Sequence
  Description of Artificial Sequence: Synthetic peptide
DEQEIATTNPVATECYGSVSTDLQHGEN

SEQ ID NO: 36185 - protein, 28 aa, Artificial Sequence
  Description of Artificial Sequence: Synthetic peptide
DEQEIRTTNPEATEQYGSVSTDLEMEER

SEQ ID NO: 36186 - protein, 28 aa, Artificial Sequence
  Description of Artificial Sequence: Synthetic peptide
DEEEITATNPAATEQFGEVSTNPQRGNA

SEQ ID NO: 36187 - protein, 32 aa, Artificial Sequence
  Description of Artificial Sequence: Synthetic polypeptide
DEEEIRTTNPVATEIYGSVSETDLQVRGENDN

SEQ ID NO: 36188 - protein, 28 aa, Artificial Sequence
  Description of Artificial Sequence: Synthetic peptide
DEEEIATTNIVATEQYGSVSTELEYGED

SEQ ID NO: 36189 - protein, 31 aa, Artificial Sequence
  Description of Artificial Sequence: Synthetic polypeptide
DEEEIATTNPVATECYGSVSTNLQHEGEEDR

SEQ ID NO: 36190 - protein, 28 aa, Artificial Sequence
  Description of Artificial Sequence: Synthetic peptide
DENEISTTNPVATEQYGWVSDNLQEGEA

SEQ ID NO: 36191 - protein, 32 aa, Artificial Sequence
  Description of Artificial Sequence: Synthetic polypeptide
DEEEIRTTNPVATEQYGSVDCTMNLQHAGNDD

SEQ ID NO: 36192 - protein, 33 aa, Artificial Sequence
  Description of Artificial Sequence: Synthetic polypeptide
DEEEIRTTNPVATEQYGSVISTCNGPQNGINTR

SEQ ID NO: 36193 - protein, 28 aa, Artificial Sequence
  Description of Artificial Sequence: Synthetic peptide
DEQEIRTTNPVATEQYGDVSEDDQHGNA

SEQ ID NO: 36194 - protein, 29 aa, Artificial Sequence
  Description of Artificial Sequence: Synthetic peptide
DEEEIRTTNPVATEQYGDVSENLQTEEDN

SEQ ID NO: 36195 - protein, 28 aa, Artificial Sequence
  Description of Artificial Sequence: Synthetic peptide
DEEEIATTNPVATECYGSVSTDLEYGED

SEQ ID NO: 36196 - protein, 31 aa, Artificial Sequence
  Description of Artificial Sequence: Synthetic polypeptide
DEGEIRTTNPVATEMYGCVSTGNLQRGENQF

SEQ ID NO: 36197 - protein, 28 aa, Artificial Sequence
  Description of Artificial Sequence: Synthetic peptide
DEEEIRTTNPVATEQYGSVFEDDCHGNC

SEQ ID NO: 36198 - protein, 28 aa, Artificial Sequence
  Description of Artificial Sequence: Synthetic peptide
DEQEISTTNPDATEQYGGVSTNLETGNQ

SEQ ID NO: 36199 - protein, 28 aa, Artificial Sequence
  Description of Artificial Sequence: Synthetic peptide
SEEEIRTTNPEATETYGCVSTNLQGGPI

SEQ ID NO: 36200 - protein, 34 aa, Artificial Sequence
  Description of Artificial Sequence: Synthetic polypeptide
DEEEIRTTNPVATEQYGSVISTANLQDREGVNTF

SEQ ID NO: 36201 - protein, 28 aa, Artificial Sequence
  Description of Artificial Sequence: Synthetic peptide
GEEEIRTTNPVATEQYGWVATDDDRGNI

SEQ ID NO: 36202 - protein, 30 aa, Artificial Sequence
  Description of Artificial Sequence: Synthetic polypeptide
DEEEIATTNPVATEQYGSVISENEQRGDTF

SEQ ID NO: 36203 - protein, 28 aa, Artificial Sequence
  Description of Artificial Sequence: Synthetic peptide
DEAEIATTNPVATEQYGDVSDNIQFGNF

SEQ ID NO: 36204 - protein, 30 aa, Artificial Sequence
  Description of Artificial Sequence: Synthetic polypeptide
DEQEIRTTNPVATEWYGSVSTNLQEVEGDN

SEQ ID NO: 36205 - protein, 30 aa, Artificial Sequence
  Description of Artificial Sequence: Synthetic polypeptide
DEEEIRTTNPVATEQYGDVSTANEQNLEPR

SEQ ID NO: 36206 - protein, 28 aa, Artificial Sequence
  Description of Artificial Sequence: Synthetic peptide
SENEIASTNPVAYEQYGSVSTNLQRPNF

SEQ ID NO: 36207 - protein, 30 aa, Artificial Sequence
  Description of Artificial Sequence: Synthetic polypeptide
DEEEIRTTNPVASEQYGSCAENLQERGDDR

SEQ ID NO: 36208 - protein, 31 aa, Artificial Sequence
  Description of Artificial Sequence: Synthetic polypeptide
DEEEIATTNPVATEQYGSVSTMNEQLNEGNV

SEQ ID NO: 36209 - protein, 30 aa, Artificial Sequence
  Description of Artificial Sequence: Synthetic polypeptide
SEEEIRTTNPTATEMYGSVSEMNLQQGNTR

SEQ ID NO: 36210 - protein, 28 aa, Artificial Sequence
  Description of Artificial Sequence: Synthetic peptide
DEEEIRTVNPIASEQYGNVSSNLQRLND

SEQ ID NO: 36211 - protein, 28 aa, Artificial Sequence
  Description of Artificial Sequence: Synthetic peptide
QEQEITTTNPVATEQYGSVSTELEDGNL

SEQ ID NO: 36212 - protein, 28 aa, Artificial Sequence
  Description of Artificial Sequence: Synthetic peptide
SEEEIRTTNPTATEQFGSVSTNPQFGTE

SEQ ID NO: 36213 - protein, 28 aa, Artificial Sequence
  Description of Artificial Sequence: Synthetic peptide
DEEEIRTTNPVATEQYGSHNQNDSRGEM

SEQ ID NO: 36214 - protein, 31 aa, Artificial Sequence
  Description of Artificial Sequence: Synthetic polypeptide
DEEEIRTTNPVATEQYGSVSTDLQDTDGDDE

SEQ ID NO: 36215 - protein, 31 aa, Artificial Sequence
  Description of Artificial Sequence: Synthetic polypeptide
DEEEIRTTNPVATEQYGSVSTEGDQQDGNDC

SEQ ID NO: 36216 - protein, 28 aa, Artificial Sequence
  Description of Artificial Sequence: Synthetic peptide
DEEEIRTTNPVATEQYGSVETPDEDGEW

SEQ ID NO: 36217 - protein, 28 aa, Artificial Sequence
  Description of Artificial Sequence: Synthetic peptide
QEEEIRTTNPEATQQYGSVSTEDQDGNS

SEQ ID NO: 36218 - protein, 29 aa, Artificial Sequence
  Description of Artificial Sequence: Synthetic peptide
DEEEIAATNPVATECYGSVSTNLETGDNI

SEQ ID NO: 36219 - protein, 28 aa, Artificial Sequence
  Description of Artificial Sequence: Synthetic peptide
DEEEIRTTNPVSTEQYGCVSVALQLGPH

SEQ ID NO: 36220 - protein, 31 aa, Artificial Sequence
  Description of Artificial Sequence: Synthetic polypeptide
DEQEIRTTNPVATEQYGSVSATDLQDREGEL

SEQ ID NO: 36221 - protein, 28 aa, Artificial Sequence
  Description of Artificial Sequence: Synthetic peptide
DDSEIRSTNPVSTEQYGNVATNLQRGQR

SEQ ID NO: 36222 - protein, 29 aa, Artificial Sequence
  Description of Artificial Sequence: Synthetic peptide
DENEIRTTNPVATEIWGSVSTNEQMTGNF

SEQ ID NO: 36223 - protein, 28 aa, Artificial Sequence
  Description of Artificial Sequence: Synthetic peptide
DEQEIATTNPVATECYGSVSTNLQEEEL

SEQ ID NO: 36224 - protein, 29 aa, Artificial Sequence
  Description of Artificial Sequence: Synthetic peptide
DEEEIRTTNPVATEQYGWASDVLQHAGGR

SEQ ID NO: 36225 - protein, 31 aa, Artificial Sequence
  Description of Artificial Sequence: Synthetic polypeptide
DEEEIRTTNPVATEQYGSVSCEMDLQQGNDA

SEQ ID NO: 36226 - protein, 28 aa, Artificial Sequence
  Description of Artificial Sequence: Synthetic peptide
DEEEIKTTNIVATEQYGQVITNLQNSNE

SEQ ID NO: 36227 - protein, 28 aa, Artificial Sequence
  Description of Artificial Sequence: Synthetic peptide
DEEEICTTNPVATEQYGSAPTVLQGGTI

SEQ ID NO: 36228 - protein, 33 aa, Artificial Sequence
  Description of Artificial Sequence: Synthetic polypeptide
DEEEIRTTNPVATEQWYGSVSTNPDDLREGENR

SEQ ID NO: 36229 - protein, 29 aa, Artificial Sequence
  Description of Artificial Sequence: Synthetic peptide
DEEEIRTTNPVATEQYGEVSDDLQDQGEV

SEQ ID NO: 36230 - protein, 28 aa, Artificial Sequence
  Description of Artificial Sequence: Synthetic peptide
DEEEIRSTNPVSYEQYGSVSTALMPGTR

SEQ ID NO: 36231 - protein, 28 aa, Artificial Sequence
  Description of Artificial Sequence: Synthetic peptide
DEEEIRTTNPVASEQYGECSEQLQNGNQ

SEQ ID NO: 36232 - protein, 31 aa, Artificial Sequence
  Description of Artificial Sequence: Synthetic polypeptide
EEEEIRTTNPVATEQYGIVISDNLQNIGQNR

SEQ ID NO: 36233 - protein, 29 aa, Artificial Sequence
  Description of Artificial Sequence: Synthetic peptide
AETEIRTVNPVATEQYGWVSENLQRAGGR

SEQ ID NO: 36234 - protein, 28 aa, Artificial Sequence
  Description of Artificial Sequence: Synthetic peptide
DEEEIRTTNPVATEQYGIASTALEVGDL

SEQ ID NO: 36235 - protein, 28 aa, Artificial Sequence
  Description of Artificial Sequence: Synthetic peptide
DENEIAQTNPCATEQYGSVSEDLQRGNA

SEQ ID NO: 36236 - protein, 30 aa, Artificial Sequence
  Description of Artificial Sequence: Synthetic polypeptide
DEEEIRTTNPVATEQYGDVSENLQIHEEDR

SEQ ID NO: 36237 - protein, 28 aa, Artificial Sequence
  Description of Artificial Sequence: Synthetic peptide
DEEEVKTVNIVASENYGSVATNLQRGNR

SEQ ID NO: 36238 - protein, 32 aa, Artificial Sequence
  Description of Artificial Sequence: Synthetic polypeptide
DEEEIRTTNPVATEQYGSVSATENLQINGTHG

SEQ ID NO: 36239 - protein, 28 aa, Artificial Sequence
  Description of Artificial Sequence: Synthetic peptide
DEMEITTTNPVATEQYGSVVHNLQRMHN

SEQ ID NO: 36240 - protein, 28 aa, Artificial Sequence
  Description of Artificial Sequence: Synthetic peptide
DWQEINFTNPVATEQYGSPSDPLQRGNR

SEQ ID NO: 36241 - protein, 28 aa, Artificial Sequence
  Description of Artificial Sequence: Synthetic peptide
DEEEIRTTNPYATEQYGSVHEGEMRGNP

SEQ ID NO: 36242 - protein, 31 aa, Artificial Sequence
  Description of Artificial Sequence: Synthetic polypeptide
DEEEIRTTNPVATEQWGSYSTNEQDYDGNDR

SEQ ID NO: 36243 - protein, 31 aa, Artificial Sequence
  Description of Artificial Sequence: Synthetic polypeptide
DEEEIRTTNPVATEQYGDVSCENLQCTGNDV

SEQ ID NO: 36244 - protein, 31 aa, Artificial Sequence
  Description of Artificial Sequence: Synthetic polypeptide
DEEEIRTTNPVATEQYGSVSEENLQDEDGDH

SEQ ID NO: 36245 - protein, 28 aa, Artificial Sequence
  Description of Artificial Sequence: Synthetic peptide
DEEEIRCTNPVASELYGTVAMNLQRGNQ

SEQ ID NO: 36246 - protein, 28 aa, Artificial Sequence
  Description of Artificial Sequence: Synthetic peptide
DEEEIRTTNPVATEQYGSVSEELEHEEN

SEQ ID NO: 36247 - protein, 28 aa, Artificial Sequence
  Description of Artificial Sequence: Synthetic peptide
DEQEIMTTNPVATEQYGEVSENLQQLNA

SEQ ID NO: 36248 - protein, 30 aa, Artificial Sequence
  Description of Artificial Sequence: Synthetic polypeptide
MENEIRTTNPVATEQYGSVSTNLEDRGTDM

SEQ ID NO: 36249 - protein, 34 aa, Artificial Sequence
  Description of Artificial Sequence: Synthetic polypeptide
DEEEIRTTNPVATEQYGSVISTMNLPQLREGDNG

SEQ ID NO: 36250 - protein, 30 aa, Artificial Sequence
  Description of Artificial Sequence: Synthetic polypeptide
DEEEIRTTNPVATEQYGEVSEELQIRSQND

SEQ ID NO: 36251 - protein, 28 aa, Artificial Sequence
  Description of Artificial Sequence: Synthetic peptide
QEPEIRTTNPVATEQYGWASENLQMGNT

SEQ ID NO: 36252 - protein, 31 aa, Artificial Sequence
  Description of Artificial Sequence: Synthetic polypeptide
DEEEITTTNPVATEQYGSVSTANWPQLFGNI

SEQ ID NO: 36253 - protein, 30 aa, Artificial Sequence
  Description of Artificial Sequence: Synthetic polypeptide
QEEEIATTNPVATEQYGWVSTNLQDFKGDR

SEQ ID NO: 36254 - protein, 28 aa, Artificial Sequence
  Description of Artificial Sequence: Synthetic peptide
MENEIRTTNPVATECYGSVSTNEQHGEQ

SEQ ID NO: 36255 - protein, 28 aa, Artificial Sequence
  Description of Artificial Sequence: Synthetic peptide
DEMEIRTTNPVATEQYGQVSTPDQMGDQ

SEQ ID NO: 36256 - protein, 31 aa, Artificial Sequence
  Description of Artificial Sequence: Synthetic polypeptide
DEEEIATTNPVATEQYGSVSTELQIDKGNDD

SEQ ID NO: 36257 - protein, 30 aa, Artificial Sequence
  Description of Artificial Sequence: Synthetic polypeptide
DEDEVKTTNPVATEPYGSVSATNLQRGPQR

SEQ ID NO: 36258 - protein, 28 aa, Artificial Sequence
  Description of Artificial Sequence: Synthetic peptide
DEEEIAQTNPVATEQYGSVSTDQENGND

SEQ ID NO: 36259 - protein, 28 aa, Artificial Sequence
  Description of Artificial Sequence: Synthetic peptide
DEEEIRTTNPVATEQYGFASTGQQHGME

SEQ ID NO: 36260 - protein, 28 aa, Artificial Sequence
  Description of Artificial Sequence: Synthetic peptide
DEQEIRTTNPVATEQYGSVSTEDETGEL

SEQ ID NO: 36261 - protein, 31 aa, Artificial Sequence
  Description of Artificial Sequence: Synthetic polypeptide
DEEEIRTTNPVATEQYGSVSTGNGPQVGETL

SEQ ID NO: 36262 - protein, 28 aa, Artificial Sequence
  Description of Artificial Sequence: Synthetic peptide
NDAEIAATNPVATEQYGSVSNNLQRGTR

SEQ ID NO: 36263 - protein, 29 aa, Artificial Sequence
  Description of Artificial Sequence: Synthetic peptide
DEEEIRTTNPVATEWWGSVDTNLEMRGTQ

SEQ ID NO: 36264 - protein, 28 aa, Artificial Sequence
  Description of Artificial Sequence: Synthetic peptide
DENEIRATNPVATECYGSVSTDLQQGEM

SEQ ID NO: 36265 - protein, 30 aa, Artificial Sequence
  Description of Artificial Sequence: Synthetic polypeptide
DEEEIRTTNPVATEQYGSVDTMDLCDTGNC

SEQ ID NO: 36266 - protein, 28 aa, Artificial Sequence
  Description of Artificial Sequence: Synthetic peptide
KEQEIRQTNPVATECYGSVSTELQNGNT

SEQ ID NO: 36267 - protein, 28 aa, Artificial Sequence
  Description of Artificial Sequence: Synthetic peptide
MEQEIRTTNPVATECYGSVSTDLQNGDD

SEQ ID NO: 36268 - protein, 29 aa, Artificial Sequence
  Description of Artificial Sequence: Synthetic peptide
DENEIRTTNPVATECWGSVSENEQNRGNF

SEQ ID NO: 36269 - protein, 29 aa, Artificial Sequence
  Description of Artificial Sequence: Synthetic peptide
DENEIVTTNPVATECYGSVSTELQTGENQ

SEQ ID NO: 36270 - protein, 32 aa, Artificial Sequence
  Description of Artificial Sequence: Synthetic polypeptide
DEEEIRTTNPVATEQYGSVSTTDNGLEYEENR

SEQ ID NO: 36271 - protein, 28 aa, Artificial Sequence
  Description of Artificial Sequence: Synthetic peptide
DEEEIRTTNPVATEQYGSVETPDEIGEQ

SEQ ID NO: 36272 - protein, 32 aa, Artificial Sequence
  Description of Artificial Sequence: Synthetic polypeptide
DEEEIRTTNPVATEQYGSVSITGDLENNGNDR

SEQ ID NO: 36273 - protein, 28 aa, Artificial Sequence
  Description of Artificial Sequence: Synthetic peptide
DENEIKTTNPVATEQYGSVSENEQLGTF

SEQ ID NO: 36274 - protein, 33 aa, Artificial Sequence
  Description of Artificial Sequence: Synthetic polypeptide
DEEEIRTTNPFATEQYGSVSTNGLVDLRGENPR

SEQ ID NO: 36275 - protein, 28 aa, Artificial Sequence
  Description of Artificial Sequence: Synthetic peptide
DEETIRYTNIGATNQYGSASTNVQRGNR

SEQ ID NO: 36276 - protein, 28 aa, Artificial Sequence
  Description of Artificial Sequence: Synthetic peptide
DEEEIRTTNPVATEQWGIVSTNEMTGTQ

SEQ ID NO: 36277 - protein, 32 aa, Artificial Sequence
  Description of Artificial Sequence: Synthetic polypeptide
DEEEIRTTNPVATEQYGSVSTNLEENEGENDV

SEQ ID NO: 36278 - protein, 28 aa, Artificial Sequence
  Description of Artificial Sequence: Synthetic peptide
DEQELRTTNIVASEIYGTVGTNLQRGNR

SEQ ID NO: 36279 - protein, 28 aa, Artificial Sequence
  Description of Artificial Sequence: Synthetic peptide
DEEEIRTTNPDATEQYGVVATCPIRGNS

SEQ ID NO: 36280 - protein, 31 aa, Artificial Sequence
  Description of Artificial Sequence: Synthetic polypeptide
DEQEIATTNPVATEQYGSVSATNLEREGNDI

SEQ ID NO: 36281 - protein, 33 aa, Artificial Sequence
  Description of Artificial Sequence: Synthetic polypeptide
DEEEIRTTNPVATEQYGSVSTANEQEREGDNTV

SEQ ID NO: 36282 - protein, 31 aa, Artificial Sequence
  Description of Artificial Sequence: Synthetic polypeptide
DEEEIRTTNPVATECYGSVSATNLQHNGEDD

SEQ ID NO: 36283 - protein, 28 aa, Artificial Sequence
  Description of Artificial Sequence: Synthetic peptide
DEEEIRTTNPVATECYGSYSTEEEIGNY

SEQ ID NO: 36284 - protein, 28 aa, Artificial Sequence
  Description of Artificial Sequence: Synthetic peptide
DEEEIVTTNPVATEQYGDVSENLMHGQQ

SEQ ID NO: 36285 - protein, 29 aa, Artificial Sequence
  Description of Artificial Sequence: Synthetic peptide
DEGEIRMTNPVATEQYGCVSTQLQQGLNN

SEQ ID NO: 36286 - protein, 28 aa, Artificial Sequence
  Description of Artificial Sequence: Synthetic peptide
DEEEIRTTNPVATEQYGDVSECLQHEEN

SEQ ID NO: 36287 - protein, 29 aa, Artificial Sequence
  Description of Artificial Sequence: Synthetic peptide
DEEEIRTTNPVATEQYGDVSEDLQDGEDA

SEQ ID NO: 36288 - protein, 31 aa, Artificial Sequence
  Description of Artificial Sequence: Synthetic polypeptide
DEEEIRTTNPDATEQYGSVSETYQQTRGENV

SEQ ID NO: 36289 - protein, 28 aa, Artificial Sequence
  Description of Artificial Sequence: Synthetic peptide
DEQEVRCTNPVASEIYGCVATNLQRGNR

SEQ ID NO: 36290 - protein, 29 aa, Artificial Sequence
  Description of Artificial Sequence: Synthetic peptide
DEQEIRTTNPVATEQYGDVDTNLMIQGNL

SEQ ID NO: 36291 - protein, 28 aa, Artificial Sequence
  Description of Artificial Sequence: Synthetic peptide
DEEEIRTTNPTATEQYGEVSENEQNGTE

SEQ ID NO: 36292 - protein, 28 aa, Artificial Sequence
  Description of Artificial Sequence: Synthetic peptide
DEEEIATVNPVCTETYGSVVTNLQSGNQ

SEQ ID NO: 36293 - protein, 28 aa, Artificial Sequence
  Description of Artificial Sequence: Synthetic peptide
DEEEIRTTNPFATEQYGSVDTGDDPGND

SEQ ID NO: 36294 - protein, 31 aa, Artificial Sequence
  Description of Artificial Sequence: Synthetic polypeptide
DEQEIRTTNPVATEQYGSVSCEMNLQQGNDY

SEQ ID NO: 36295 - protein, 28 aa, Artificial Sequence
  Description of Artificial Sequence: Synthetic peptide
DEEEIRTTNIVATEVLGSVTVNMQRGNI

SEQ ID NO: 36296 - protein, 33 aa, Artificial Sequence
  Description of Artificial Sequence: Synthetic polypeptide
DEEEIRTTNPVATEQYGSVSETNLEEREGENEE

SEQ ID NO: 36297 - protein, 31 aa, Artificial Sequence
  Description of Artificial Sequence: Synthetic polypeptide
DEEEIRTTNPVATEQYGSVNDCNLQAEGYNW

SEQ ID NO: 36298 - protein, 31 aa, Artificial Sequence
  Description of Artificial Sequence: Synthetic polypeptide
DEEEIRTTNPVATEQYGSVSTELQETDGDDY

SEQ ID NO: 36299 - protein, 32 aa, Artificial Sequence
  Description of Artificial Sequence: Synthetic polypeptide
DEEEIRTTNPVATEQYGSVDCTMNGLCCRGND

SEQ ID NO: 36300 - protein, 31 aa, Artificial Sequence
  Description of Artificial Sequence: Synthetic polypeptide
DEEEIRTTNPVATEQYGSVSTNLEEHEGEDF

SEQ ID NO: 36301 - protein, 32 aa, Artificial Sequence
  Description of Artificial Sequence: Synthetic polypeptide
DEEEIRTTNPVATEQYGSVETNPLPQEGDEPR

SEQ ID NO: 36302 - protein, 28 aa, Artificial Sequence
  Description of Artificial Sequence: Synthetic peptide
HELEIATTNPVATEQYGSASTNIQTGMR

SEQ ID NO: 36303 - protein, 31 aa, Artificial Sequence
  Description of Artificial Sequence: Synthetic polypeptide
DEEEIATTNPVATEQYGSVSTGLEDRGDNDI

SEQ ID NO: 36304 - protein, 28 aa, Artificial Sequence
  Description of Artificial Sequence: Synthetic peptide
DEEEIRTTNPYATEQYGSVHEGEMRGNA

SEQ ID NO: 36305 - protein, 28 aa, Artificial Sequence
  Description of Artificial Sequence: Synthetic peptide
FEEEIRTVNPVATEPWGSVSENVQRGNT

SEQ ID NO: 36306 - protein, 28 aa, Artificial Sequence
  Description of Artificial Sequence: Synthetic peptide
DDLEIRTTNIVATEQYGAESFNLQCGNR

SEQ ID NO: 36307 - protein, 29 aa, Artificial Sequence
  Description of Artificial Sequence: Synthetic peptide
DEEEICTTNPVATEQYGSVSDVLQHAGPM

SEQ ID NO: 36308 - protein, 28 aa, Artificial Sequence
  Description of Artificial Sequence: Synthetic peptide
QEEEIATTNCVATEQYGVVSTNWQPGND

SEQ ID NO: 36309 - protein, 34 aa, Artificial Sequence
  Description of Artificial Sequence: Synthetic polypeptide
DEEEIRTTNPVATEQYGSVDCTMNLQDREGENDR

SEQ ID NO: 36310 - protein, 28 aa, Artificial Sequence
  Description of Artificial Sequence: Synthetic peptide
DENEIRCTNPDATEQYGVVSEEGQRGNR

SEQ ID NO: 36311 - protein, 32 aa, Artificial Sequence
  Description of Artificial Sequence: Synthetic polypeptide
DEEEIRTTNPVATEQYGSVSTNLQEIEGEEEH

SEQ ID NO: 36312 - protein, 30 aa, Artificial Sequence
  Description of Artificial Sequence: Synthetic polypeptide
DEEEIATTNPTATEQYGSVSTMNEQNGDNL

SEQ ID NO: 36313 - protein, 28 aa, Artificial Sequence
  Description of Artificial Sequence: Synthetic peptide
EEEEISGTNPVATEQYGSVTDNLQHGER

SEQ ID NO: 36314 - protein, 28 aa, Artificial Sequence
  Description of Artificial Sequence: Synthetic peptide
YDEEIRTTNPVSTESYGSVCTNWQRENR

SEQ ID NO: 36315 - protein, 28 aa, Artificial Sequence
  Description of Artificial Sequence: Synthetic peptide
DEEEIRTTNSFATEQYGQVATNLQRITT

SEQ ID NO: 36316 - protein, 33 aa, Artificial Sequence
  Description of Artificial Sequence: Synthetic polypeptide
DEEEIRTTNPVATEQYGSYVSLTGPLVERKGNR

SEQ ID NO: 36317 - protein, 32 aa, Artificial Sequence
  Description of Artificial Sequence: Synthetic polypeptide
DEEEIRTTNPVATEQYGSVESDTPNLDPNGNP

SEQ ID NO: 36318 - protein, 30 aa, Artificial Sequence
  Description of Artificial Sequence: Synthetic polypeptide
DEEEIRTTNPVSTEQYGTVSTENIQQNGNH

SEQ ID NO: 36319 - protein, 31 aa, Artificial Sequence
  Description of Artificial Sequence: Synthetic polypeptide
DEEEIRTTNPVATECYGHVSTGNLQRKENEL

SEQ ID NO: 36320 - protein, 28 aa, Artificial Sequence
  Description of Artificial Sequence: Synthetic peptide
SEEEIRTTNPEATETYGEVSTNLDIGNQ

SEQ ID NO: 36321 - protein, 32 aa, Artificial Sequence
  Description of Artificial Sequence: Synthetic polypeptide
DEEEIRTTNPVATEQYGSVSVENEGGQRGINH

SEQ ID NO: 36322 - protein, 28 aa, Artificial Sequence
  Description of Artificial Sequence: Synthetic peptide
VEEEIRATNPVASEQYGCVSMNLQRGTQ

SEQ ID NO: 36323 - protein, 31 aa, Artificial Sequence
  Description of Artificial Sequence: Synthetic polypeptide
DEVEIRTTNPVATEQYGSVSTMNEQIEGDNE

SEQ ID NO: 36324 - protein, 29 aa, Artificial Sequence
  Description of Artificial Sequence: Synthetic peptide
DEEEIRTTNPVATEQWGSVDTNDMVGNDF

SEQ ID NO: 36325 - protein, 28 aa, Artificial Sequence
  Description of Artificial Sequence: Synthetic peptide
DEGEIRTTNPVATECYGSVSTDLEPGEN

SEQ ID NO: 36326 - protein, 28 aa, Artificial Sequence
  Description of Artificial Sequence: Synthetic peptide
HEEEIRTTNPIATEAYGSVSTTPQGGNH

SEQ ID NO: 36327 - protein, 33 aa, Artificial Sequence
  Description of Artificial Sequence: Synthetic polypeptide
DEEEIRTTNPVATEQYGSVSTTNLELREGENDT

SEQ ID NO: 36328 - protein, 30 aa, Artificial Sequence
  Description of Artificial Sequence: Synthetic polypeptide
DEQEIRTTNPVATEQYGSVSEMDLQTGNDM

SEQ ID NO: 36329 - protein, 30 aa, Artificial Sequence
  Description of Artificial Sequence: Synthetic polypeptide
DENEINTTNPVATEQYGSVSTNLQDMNGEA

SEQ ID NO: 36330 - protein, 34 aa, Artificial Sequence
  Description of Artificial Sequence: Synthetic polypeptide
DEEEIRTTNPVATEQYGSVCSSTENGLVDRGMNR

SEQ ID NO: 36331 - protein, 32 aa, Artificial Sequence
  Description of Artificial Sequence: Synthetic polypeptide
DEEEIATTNPVATEQYGSVDSTNGLERGEEDR

SEQ ID NO: 36332 - protein, 29 aa, Artificial Sequence
  Description of Artificial Sequence: Synthetic peptide
DEEEIRTTNPVATEQYGDVSENLQIHEEN

SEQ ID NO: 36333 - protein, 34 aa, Artificial Sequence
  Description of Artificial Sequence: Synthetic polypeptide
DEEEIRTTNPVATEQYGSVSITCNDVQDRKGDNR

SEQ ID NO: 36334 - protein, 31 aa, Artificial Sequence
  Description of Artificial Sequence: Synthetic polypeptide
DEEEIRTTNPVATEQYGVVSCENLQQEGNDL

SEQ ID NO: 36335 - protein, 28 aa, Artificial Sequence
  Description of Artificial Sequence: Synthetic peptide
DEDEIRTTNPVSTEQFGDVSTNLQFGDF

SEQ ID NO: 36336 - protein, 28 aa, Artificial Sequence
  Description of Artificial Sequence: Synthetic peptide
DEEEIRTTNPVATEQYGVTATNLQNSTT

SEQ ID NO: 36337 - protein, 33 aa, Artificial Sequence
  Description of Artificial Sequence: Synthetic polypeptide
DEEEIRTTNPTATEQYGSVSTANLQLIEGENDR

SEQ ID NO: 36338 - protein, 28 aa, Artificial Sequence
  Description of Artificial Sequence: Synthetic peptide
DEAEIAATNPVATENYGSVATNLQRGTQ

SEQ ID NO: 36339 - protein, 31 aa, Artificial Sequence
  Description of Artificial Sequence: Synthetic polypeptide
DEEEIRTTNPVATECYGSVSATNLQQNGEDL

SEQ ID NO: 36340 - protein, 29 aa, Artificial Sequence
  Description of Artificial Sequence: Synthetic peptide
DEEEIATTNPVATECYGSVSTDLEDRGEL

SEQ ID NO: 36341 - protein, 29 aa, Artificial Sequence
  Description of Artificial Sequence: Synthetic peptide
DEQEIWTTNPVATESYGVASENLQRIGNR

SEQ ID NO: 36342 - protein, 28 aa, Artificial Sequence
  Description of Artificial Sequence: Synthetic peptide
DEQEIRTTNPVATEQYGSVETDLEMGEG

SEQ ID NO: 36343 - protein, 28 aa, Artificial Sequence
  Description of Artificial Sequence: Synthetic peptide
DEEEIRTTNPVATECWGIVDENLQVGNS

SEQ ID NO: 36344 - protein, 28 aa, Artificial Sequence
  Description of Artificial Sequence: Synthetic peptide
QEVEIYTTNPVATEQFGSVSTNLQGGDN

SEQ ID NO: 36345 - protein, 31 aa, Artificial Sequence
  Description of Artificial Sequence: Synthetic polypeptide
MEEEIRTTNPVATEQYGSVSTDLQDNEGNDM

SEQ ID NO: 36346 - protein, 31 aa, Artificial Sequence
  Description of Artificial Sequence: Synthetic polypeptide
DEEEIRQTNPVATEQYGSVSITNLEINGNDQ

SEQ ID NO: 36347 - protein, 32 aa, Artificial Sequence
  Description of Artificial Sequence: Synthetic polypeptide
DEEEITTTNPVATEQYGSVSETNLQVQNGNDH

SEQ ID NO: 36348 - protein, 31 aa, Artificial Sequence
  Description of Artificial Sequence: Synthetic polypeptide
DEEEIRTTNPDATEQYGSVSTDNDVEGDGNR

SEQ ID NO: 36349 - protein, 28 aa, Artificial Sequence
  Description of Artificial Sequence: Synthetic peptide
DENEIRTTNPVGTEQYGNVSENLMRGDA

SEQ ID NO: 36350 - protein, 28 aa, Artificial Sequence
  Description of Artificial Sequence: Synthetic peptide
GEEEIVTTNPVATECYGSVSTNLETGEA

SEQ ID NO: 36351 - protein, 32 aa, Artificial Sequence
  Description of Artificial Sequence: Synthetic polypeptide
DEEEIRTTNPVATEQYGSVSLTNTLQIQENNI

SEQ ID NO: 36352 - protein, 28 aa, Artificial Sequence
  Description of Artificial Sequence: Synthetic peptide
DENEIATTNPVATECYGSVSTNLEHGEL

SEQ ID NO: 36353 - protein, 32 aa, Artificial Sequence
  Description of Artificial Sequence: Synthetic polypeptide
DEEEIRTTNPVATEQYGSVDCTMNLCDRGNDC

SEQ ID NO: 36354 - protein, 31 aa, Artificial Sequence
  Description of Artificial Sequence: Synthetic polypeptide
DEEEIRTTNPVATEQYGSVSCTEDLEEWGNE

SEQ ID NO: 36355 - protein, 31 aa, Artificial Sequence
  Description of Artificial Sequence: Synthetic polypeptide
DEEEIRTTNPVATEQYGSVSTDLEENNGNDS

SEQ ID NO: 36356 - protein, 28 aa, Artificial Sequence
  Description of Artificial Sequence: Synthetic peptide
DEEGIRTTNIVITEQYGQVDDNNQRGNR

SEQ ID NO: 36357 - protein, 29 aa, Artificial Sequence
  Description of Artificial Sequence: Synthetic peptide
DENEIGTTNPVATEQYGTASCVLQRAGNR

SEQ ID NO: 36358 - protein, 28 aa, Artificial Sequence
  Description of Artificial Sequence: Synthetic peptide
DEQEIATTNPVATECYGSVSTDLQHGEL

SEQ ID NO: 36359 - protein, 28 aa, Artificial Sequence
  Description of Artificial Sequence: Synthetic peptide
SEEEIRTTNPAATECFGSVSTNEQRGTS

SEQ ID NO: 36360 - protein, 30 aa, Artificial Sequence
  Description of Artificial Sequence: Synthetic polypeptide
SEVEIACTNPVATEQYGSVSENLQREGNDR

SEQ ID NO: 36361 - protein, 31 aa, Artificial Sequence
  Description of Artificial Sequence: Synthetic polypeptide
DEHEIRTTNPVATEQYGSVSCEMNLQHNGNA

SEQ ID NO: 36362 - protein, 28 aa, Artificial Sequence
  Description of Artificial Sequence: Synthetic peptide
DEEEIRTTNPDATEQYGSVFENLDNGEN

SEQ ID NO: 36363 - protein, 28 aa, Artificial Sequence
  Description of Artificial Sequence: Synthetic peptide
YSEEVRTTNPMATMQYGSVSTNLQAGNV

SEQ ID NO: 36364 - protein, 28 aa, Artificial Sequence
  Description of Artificial Sequence: Synthetic peptide
QEEEIRATNPVATEMYGSVSTDLQSGDD

SEQ ID NO: 36365 - protein, 28 aa, Artificial Sequence
  Description of Artificial Sequence: Synthetic peptide
DEEEIASTNPVATEQYGEVACILQRGGR

SEQ ID NO: 36366 - protein, 28 aa, Artificial Sequence
  Description of Artificial Sequence: Synthetic peptide
DEEEIRTTNPYATEQYGSVSTGDTWENT

SEQ ID NO: 36367 - protein, 29 aa, Artificial Sequence
  Description of Artificial Sequence: Synthetic peptide
DENEIRTTNPVATEQWGSVSTEDENRGNT

SEQ ID NO: 36368 - protein, 28 aa, Artificial Sequence
  Description of Artificial Sequence: Synthetic peptide
DEEEIKTTNIVATEEYGSVSTNLQYADT

SEQ ID NO: 36369 - protein, 28 aa, Artificial Sequence
  Description of Artificial Sequence: Synthetic peptide
AEEEISTTNPVATECYGNVGTNLQRGTQ

SEQ ID NO: 36370 - protein, 28 aa, Artificial Sequence
  Description of Artificial Sequence: Synthetic peptide
QENEIGTTNPVATEIYGDVSTNLQNGNH

SEQ ID NO: 36371 - protein, 28 aa, Artificial Sequence
  Description of Artificial Sequence: Synthetic peptide
DEEEIRTTNPVATEQYGSVETDDEDGEW

SEQ ID NO: 36372 - protein, 31 aa, Artificial Sequence
  Description of Artificial Sequence: Synthetic polypeptide
DEEEIRTTNPVATEQYGSVSTDLQEVEGEDD

SEQ ID NO: 36373 - protein, 28 aa, Artificial Sequence
  Description of Artificial Sequence: Synthetic peptide
DEVEIRTTNPVATECYGSASTDLQTGEI

SEQ ID NO: 36374 - protein, 28 aa, Artificial Sequence
  Description of Artificial Sequence: Synthetic peptide
AESEIASTNPVSTELYGSVATNLQRGNR

SEQ ID NO: 36375 - protein, 33 aa, Artificial Sequence
  Description of Artificial Sequence: Synthetic polypeptide
DEEEIRTTNPVATEQYGSVSETNGLQLDGENEL

SEQ ID NO: 36376 - protein, 28 aa, Artificial Sequence
  Description of Artificial Sequence: Synthetic peptide
DEYEISTTNIVATEQYGNVATNLTDGNR

SEQ ID NO: 36377 - protein, 28 aa, Artificial Sequence
  Description of Artificial Sequence: Synthetic peptide
DEEEIRTTNPTATEQYGSVETGPYQGNF

SEQ ID NO: 36378 - protein, 28 aa, Artificial Sequence
  Description of Artificial Sequence: Synthetic peptide
DEEEIRTTNPVATERYGTTATNLQSSNT

SEQ ID NO: 36379 - protein, 33 aa, Artificial Sequence
  Description of Artificial Sequence: Synthetic polypeptide
DEEEIRTTNPVATEQYGSVESTYPGLQIYGENR

SEQ ID NO: 36380 - protein, 33 aa, Artificial Sequence
  Description of Artificial Sequence: Synthetic polypeptide
DEEEIRTTNPVATEQYGSVASTTDPLLRNGDNR

SEQ ID NO: 36381 - protein, 28 aa, Artificial Sequence
  Description of Artificial Sequence: Synthetic peptide
DEEEIRTTNPVATELYGIVSTNDMLGDY

SEQ ID NO: 36382 - protein, 31 aa, Artificial Sequence
  Description of Artificial Sequence: Synthetic polypeptide
DEEEIRTTNPVATEQYGSVETELQEIEGEER

SEQ ID NO: 36383 - protein, 28 aa, Artificial Sequence
  Description of Artificial Sequence: Synthetic peptide
DEEEIRCTNPVATEQYGSSSTPPQQGPS

SEQ ID NO: 36384 - protein, 28 aa, Artificial Sequence
  Description of Artificial Sequence: Synthetic peptide
SEGEIRTTNPVATEQFGGVSTNPQHGNG

SEQ ID NO: 36385 - protein, 30 aa, Artificial Sequence
  Description of Artificial Sequence: Synthetic polypeptide
DEEEIMTTNPVATEQYGGVNTGNLQMQGNE

SEQ ID NO: 36386 - protein, 28 aa, Artificial Sequence
  Description of Artificial Sequence: Synthetic peptide
DEEEIRTTNPFATEQYGSVSTDQITGEN

SEQ ID NO: 36387 - protein, 28 aa, Artificial Sequence
  Description of Artificial Sequence: Synthetic peptide
DEEEIRTTNPVATEQYGDVSENEMQGDA

SEQ ID NO: 36388 - protein, 28 aa, Artificial Sequence
  Description of Artificial Sequence: Synthetic peptide
DEDEIATTNPVSTEQYGIVGTNLQRLTR

SEQ ID NO: 36389 - protein, 29 aa, Artificial Sequence
  Description of Artificial Sequence: Synthetic peptide
DENEIRTVNPVATEQYGSMSTDLQDLGNF

SEQ ID NO: 36390 - protein, 28 aa, Artificial Sequence
  Description of Artificial Sequence: Synthetic peptide
DEEEIRTTNPLATQQYGSVSTDDDNGNG

SEQ ID NO: 36391 - protein, 30 aa, Artificial Sequence
  Description of Artificial Sequence: Synthetic polypeptide
DEEEIRTTNPVAYEQYGSVSEHLQIGDNDS

SEQ ID NO: 36392 - protein, 33 aa, Artificial Sequence
  Description of Artificial Sequence: Synthetic polypeptide
DEEEIRTTNPVATEQYGSVISTCNGLQIGDNTV

SEQ ID NO: 36393 - protein, 28 aa, Artificial Sequence
  Description of Artificial Sequence: Synthetic peptide
DEVEIRCTNPVATEQYGDVSTDPQPGNY

SEQ ID NO: 36394 - protein, 32 aa, Artificial Sequence
  Description of Artificial Sequence: Synthetic polypeptide
DEEEIRTTNPVATEQYGVVDSVTIDLQRKGNS

SEQ ID NO: 36395 - protein, 28 aa, Artificial Sequence
  Description of Artificial Sequence: Synthetic peptide
DEEEIRTTNPDATEQYGSVSDPDQNDNI

SEQ ID NO: 36396 - protein, 28 aa, Artificial Sequence
  Description of Artificial Sequence: Synthetic peptide
DEEEIATTNPVATEQYGEVSEVLQHEER

SEQ ID NO: 36397 - protein, 32 aa, Artificial Sequence
  Description of Artificial Sequence: Synthetic polypeptide
DEEEIRTTNPVATEQYGSVSCTNPLDERDGES

SEQ ID NO: 36398 - protein, 31 aa, Artificial Sequence
  Description of Artificial Sequence: Synthetic polypeptide
DEEEIRTTNPVATEQYGSVSTCDQQCNGFNF

SEQ ID NO: 36399 - protein, 28 aa, Artificial Sequence
  Description of Artificial Sequence: Synthetic peptide
DEVEIATTNPVATELYGSVSENEQQGNF

SEQ ID NO: 36400 - protein, 30 aa, Artificial Sequence
  Description of Artificial Sequence: Synthetic polypeptide
DEEEIRTTNPVATECYGSVSTDLEEHKGNV

SEQ ID NO: 36401 - protein, 28 aa, Artificial Sequence
  Description of Artificial Sequence: Synthetic peptide
DEEEIRTTNPVATEQYGSVSEDLEHEEA

SEQ ID NO: 36402 - protein, 30 aa, Artificial Sequence
  Description of Artificial Sequence: Synthetic polypeptide
DEEEIRTTNPVATEQYGSVSCDMDLCNGNC

SEQ ID NO: 36403 - protein, 29 aa, Artificial Sequence
  Description of Artificial Sequence: Synthetic peptide
DEQEIVTTNPVATEMYGSVSENLTHGDNR

SEQ ID NO: 36404 - protein, 28 aa, Artificial Sequence
  Description of Artificial Sequence: Synthetic peptide
SEEEIRCTNPEATELYGSVSTNLQGGDL

SEQ ID NO: 36405 - protein, 28 aa, Artificial Sequence
  Description of Artificial Sequence: Synthetic peptide
DEEEIRTTNPTATEQYGEVSENPQLGDH

SEQ ID NO: 36406 - protein, 31 aa, Artificial Sequence
  Description of Artificial Sequence: Synthetic polypeptide
DEEEIRTTNPVATEQYGSVSTGNDEYNGENS

SEQ ID NO: 36407 - protein, 28 aa, Artificial Sequence
  Description of Artificial Sequence: Synthetic peptide
SEEEIRTTNIVATEQYGSVVSNEQQGNT

SEQ ID NO: 36408 - protein, 30 aa, Artificial Sequence
  Description of Artificial Sequence: Synthetic polypeptide
YEHEIRTTNPVATEQYGSVSTMNLQTNGTQ

SEQ ID NO: 36409 - protein, 28 aa, Artificial Sequence
  Description of Artificial Sequence: Synthetic peptide
DEWTICTTNIVATEQYGCVSNNEQRGNR

SEQ ID NO: 36410 - protein, 31 aa, Artificial Sequence
  Description of Artificial Sequence: Synthetic polypeptide
QENEIRTTNPVATECYGSVSDTDLQRNGENR

SEQ ID NO: 36411 - protein, 28 aa, Artificial Sequence
  Description of Artificial Sequence: Synthetic peptide
VEEEIRTTNPVATEQYGEAGDNLQQQNR

SEQ ID NO: 36412 - protein, 28 aa, Artificial Sequence
  Description of Artificial Sequence: Synthetic peptide
SEEEIRTTNPEATEMFGSVSTNLQLGTI

SEQ ID NO: 36413 - protein, 28 aa, Artificial Sequence
  Description of Artificial Sequence: Synthetic peptide
DEEEITTTNPVATECYGWVSTDLEQGNA

SEQ ID NO: 36414 - protein, 32 aa, Artificial Sequence
  Description of Artificial Sequence: Synthetic polypeptide
DEEEIRTTNPVATEQYGSVSTCCLQLFKGNDN

SEQ ID NO: 36415 - protein, 28 aa, Artificial Sequence
  Description of Artificial Sequence: Synthetic peptide
DENEIRTTNPVATEQWGSVSTNEMIGDQ

SEQ ID NO: 36416 - protein, 28 aa, Artificial Sequence
  Description of Artificial Sequence: Synthetic peptide
MEEEIRTTNPVATEQYGIVSENLDFGMS

SEQ ID NO: 36417 - protein, 28 aa, Artificial Sequence
  Description of Artificial Sequence: Synthetic peptide
MEEEIDTTNPVATECYGAVSTNLQHGEE

SEQ ID NO: 36418 - protein, 29 aa, Artificial Sequence
  Description of Artificial Sequence: Synthetic peptide
DEEEIAATNPTATEQFGSVSTNPQREGTR

SEQ ID NO: 36419 - protein, 28 aa, Artificial Sequence
  Description of Artificial Sequence: Synthetic peptide
DENEIAQTNPVATEQYGVVDTNLEVGNR

SEQ ID NO: 36420 - protein, 28 aa, Artificial Sequence
  Description of Artificial Sequence: Synthetic peptide
DEEEIRTTNPCATEPYGTVSTAEQWGNE

SEQ ID NO: 36421 - protein, 29 aa, Artificial Sequence
  Description of Artificial Sequence: Synthetic peptide
DEEEIRTTNPVATECYGIVSTVPQSRGDL

SEQ ID NO: 36422 - protein, 30 aa, Artificial Sequence
  Description of Artificial Sequence: Synthetic polypeptide
NEHEIRTTNPCATEVYGSVSEMNLQRGNDR

SEQ ID NO: 36423 - protein, 28 aa, Artificial Sequence
  Description of Artificial Sequence: Synthetic peptide
LEEEIDTTNIVATEQYGSVSSNLIRLNS

SEQ ID NO: 36424 - protein, 28 aa, Artificial Sequence
  Description of Artificial Sequence: Synthetic peptide
AEVEIAATNPVATENYGWVATNLQRGNR

SEQ ID NO: 36425 - protein, 28 aa, Artificial Sequence
  Description of Artificial Sequence: Synthetic peptide
GEEEIRTVNPVATECYGSVSTDLQNGES

SEQ ID NO: 36426 - protein, 32 aa, Artificial Sequence
  Description of Artificial Sequence: Synthetic polypeptide
DEEEIRTTNPFATEQYGSVSITPGLVDLRGNR

SEQ ID NO: 36427 - protein, 29 aa, Artificial Sequence
  Description of Artificial Sequence: Synthetic peptide
QEQEIATTNPVATEQYGEASAENLQRGNR

SEQ ID NO: 36428 - protein, 29 aa, Artificial Sequence
  Description of Artificial Sequence: Synthetic peptide
DEEEIRTTNPVATECYGSMSTELQDAGES

SEQ ID NO: 36429 - protein, 28 aa, Artificial Sequence
  Description of Artificial Sequence: Synthetic peptide
DEEEIRTTNITATEIYGMVATNLQDGDR

SEQ ID NO: 36430 - protein, 28 aa, Artificial Sequence
  Description of Artificial Sequence: Synthetic peptide
DENEIAQTNPVATEQYGSVSTDLEVGNL

SEQ ID NO: 36431 - protein, 28 aa, Artificial Sequence
  Description of Artificial Sequence: Synthetic peptide
SEVEIRTTNPTATEQYGSVSENEQNGNF

SEQ ID NO: 36432 - protein, 31 aa, Artificial Sequence
  Description of Artificial Sequence: Synthetic polypeptide
DEEEIRTTNPVATEQYGSVSTNPLQVTEEDV

SEQ ID NO: 36433 - protein, 30 aa, Artificial Sequence
  Description of Artificial Sequence: Synthetic polypeptide
GEEEIRTTNPVATEMYGVVSTNLQETEGNF

SEQ ID NO: 36434 - protein, 28 aa, Artificial Sequence
  Description of Artificial Sequence: Synthetic peptide
DEQEIRTTNPVASEIYGCVANNLERGNR

SEQ ID NO: 36435 - protein, 31 aa, Artificial Sequence
  Description of Artificial Sequence: Synthetic polypeptide
DEEEIRTTNPVATEQYGVVSTNLESNGENDV

SEQ ID NO: 36436 - protein, 30 aa, Artificial Sequence
  Description of Artificial Sequence: Synthetic polypeptide
DEEEIRTTNPVATEQYGSVSDALCTGGNDE

SEQ ID NO: 36437 - protein, 33 aa, Artificial Sequence
  Description of Artificial Sequence: Synthetic polypeptide
DEEEIRTTNPVATEQYGSVSDTEALQQEGENDR

SEQ ID NO: 36438 - protein, 28 aa, Artificial Sequence
  Description of Artificial Sequence: Synthetic peptide
DENEIRTTNPVSTEQWGSVSEAEQRGNM

SEQ ID NO: 36439 - protein, 32 aa, Artificial Sequence
  Description of Artificial Sequence: Synthetic polypeptide
DEEEIRTTNPVAYEQYGQSVSQNDLLQRGIRR

SEQ ID NO: 36440 - protein, 28 aa, Artificial Sequence
  Description of Artificial Sequence: Synthetic peptide
DEEEIRTTNPVATEQYGSVSECLEHEEQ

SEQ ID NO: 36441 - protein, 32 aa, Artificial Sequence
  Description of Artificial Sequence: Synthetic polypeptide
DEEEIRTTNPVATEQYGSVDCTMDLQCAGNDR

SEQ ID NO: 36442 - protein, 28 aa, Artificial Sequence
  Description of Artificial Sequence: Synthetic peptide
DEEEIRTTNPFATEQYGSVHTPLFDGEP

SEQ ID NO: 36443 - protein, 28 aa, Artificial Sequence
  Description of Artificial Sequence: Synthetic peptide
DEEEIRSTNPVATEQYGNVSDCLQGFNL

SEQ ID NO: 36444 - protein, 28 aa, Artificial Sequence
  Description of Artificial Sequence: Synthetic peptide
DEEEIRTTNPVAHMFYGSVSTGLDIGNE

SEQ ID NO: 36445 - protein, 28 aa, Artificial Sequence
  Description of Artificial Sequence: Synthetic peptide
DEQEIRTTNPVATEQYGSVETDDEGGER

SEQ ID NO: 36446 - protein, 28 aa, Artificial Sequence
  Description of Artificial Sequence: Synthetic peptide
MEEEISTTNPVATEQYGSVSDDLQNGEY

SEQ ID NO: 36447 - protein, 28 aa, Artificial Sequence
  Description of Artificial Sequence: Synthetic peptide
DEEEIRTTNPVATEQYGDVSECLCHGEL

SEQ ID NO: 36448 - protein, 28 aa, Artificial Sequence
  Description of Artificial Sequence: Synthetic peptide
DEEEIRTTNPHATEQYGSVHTGEMEGNA

SEQ ID NO: 36449 - protein, 28 aa, Artificial Sequence
  Description of Artificial Sequence: Synthetic peptide
AEEEIAQTNPVATEQYGVVSTNQERGDR

SEQ ID NO: 36450 - protein, 30 aa, Artificial Sequence
  Description of Artificial Sequence: Synthetic polypeptide
DEHEICTTNPVATECYGSVSTNLQETNGNM

SEQ ID NO: 36451 - protein, 28 aa, Artificial Sequence
  Description of Artificial Sequence: Synthetic peptide
DEEEIRTTNIVATECYGSVETDLQQGEN

SEQ ID NO: 36452 - protein, 29 aa, Artificial Sequence
  Description of Artificial Sequence: Synthetic peptide
VEEEIRTTNPVATECYGSVSTELEIHGNH

SEQ ID NO: 36453 - protein, 29 aa, Artificial Sequence
  Description of Artificial Sequence: Synthetic peptide
QEEEIATTNPVATEVYGSVSEVLQHAGNR

SEQ ID NO: 36454 - protein, 28 aa, Artificial Sequence
  Description of Artificial Sequence: Synthetic peptide
DEEQIRTTNPVAFEQYGSVSDNLHPGSG

SEQ ID NO: 36455 - protein, 31 aa, Artificial Sequence
  Description of Artificial Sequence: Synthetic polypeptide
DEEEIRTTNPVATEQYGSVSATDLQDHEGEL

SEQ ID NO: 36456 - protein, 29 aa, Artificial Sequence
  Description of Artificial Sequence: Synthetic peptide
DEEEIATTNPVATELYGSVSDDLQYAGNI

SEQ ID NO: 36457 - protein, 32 aa, Artificial Sequence
  Description of Artificial Sequence: Synthetic polypeptide
DEEEIRTTNPVATEQYGSVSETNLEDREGEDD

SEQ ID NO: 36458 - protein, 33 aa, Artificial Sequence
  Description of Artificial Sequence: Synthetic polypeptide
DEEEIRTTNPVATEQYGSVTSETNLTEIRGENP

SEQ ID NO: 36459 - protein, 28 aa, Artificial Sequence
  Description of Artificial Sequence: Synthetic peptide
DEEQIITTNNYATEHYGSVSTVLQNGNR

SEQ ID NO: 36460 - protein, 28 aa, Artificial Sequence
  Description of Artificial Sequence: Synthetic peptide
SEEEIRTTNPTATEQFGSVSTNPQLGTA

SEQ ID NO: 36461 - protein, 28 aa, Artificial Sequence
  Description of Artificial Sequence: Synthetic peptide
DEQEIRTTNPVATEQYGSVSTEDEREDI

SEQ ID NO: 36462 - protein, 32 aa, Artificial Sequence
  Description of Artificial Sequence: Synthetic polypeptide
DEEEIRTTNPVATEQYGSVSTNLELVNGENDC

SEQ ID NO: 36463 - protein, 28 aa, Artificial Sequence
  Description of Artificial Sequence: Synthetic peptide
DEEEIRSTNPVATEVYGGVSTELNVGPR

SEQ ID NO: 36464 - protein, 32 aa, Artificial Sequence
  Description of Artificial Sequence: Synthetic polypeptide
DEEEIRTTNPVATEQYGSVSATNLELVNGNDD

SEQ ID NO: 36465 - protein, 28 aa, Artificial Sequence
  Description of Artificial Sequence: Synthetic peptide
DEVEIATTNPTATEMFGSVSENLQRGNF

SEQ ID NO: 36466 - protein, 28 aa, Artificial Sequence
  Description of Artificial Sequence: Synthetic peptide
QEEEIRTVNPVATEQYGSVAEVLQHGNM

SEQ ID NO: 36467 - protein, 28 aa, Artificial Sequence
  Description of Artificial Sequence: Synthetic peptide
DEEEIAATNPVATEMFGSVSTNEQIGTR

SEQ ID NO: 36468 - protein, 28 aa, Artificial Sequence
  Description of Artificial Sequence: Synthetic peptide
DEEEIRTTNPTATEQYGEVSENEQQGDF

SEQ ID NO: 36469 - protein, 31 aa, Artificial Sequence
  Description of Artificial Sequence: Synthetic polypeptide
DEEEIRTTNPVATEAYGNVPSTNNLQLDGNW

SEQ ID NO: 36470 - protein, 28 aa, Artificial Sequence
  Description of Artificial Sequence: Synthetic peptide
DEEEIATTNPVATEMFGGVSTNLQQGTF

SEQ ID NO: 36471 - protein, 32 aa, Artificial Sequence
  Description of Artificial Sequence: Synthetic polypeptide
DEEEIRTTNPVATEQYGSVSTNLQENEGDEEI

SEQ ID NO: 36472 - protein, 28 aa, Artificial Sequence
  Description of Artificial Sequence: Synthetic peptide
DEEEIRTTNPIATEQYGSVSTADFLGLM

SEQ ID NO: 36473 - protein, 30 aa, Artificial Sequence
  Description of Artificial Sequence: Synthetic polypeptide
DEEEIRTTNPVATEQYGDVSENLMNQAGDA

SEQ ID NO: 36474 - protein, 28 aa, Artificial Sequence
  Description of Artificial Sequence: Synthetic peptide
DEEEIRCTNPVASELYGVVSMNLQRGTQ

SEQ ID NO: 36475 - protein, 28 aa, Artificial Sequence
  Description of Artificial Sequence: Synthetic peptide
DEEEITCTNPVATEQYGSVSEALQWGDL

SEQ ID NO: 36476 - protein, 31 aa, Artificial Sequence
  Description of Artificial Sequence: Synthetic polypeptide
DEEEIRTTNPVATEQYGSVDTNGDPQPGEDR

SEQ ID NO: 36477 - protein, 31 aa, Artificial Sequence
  Description of Artificial Sequence: Synthetic polypeptide
DEEEIRTTNPVATEQYGSVDTELMMINGENR

SEQ ID NO: 36478 - protein, 28 aa, Artificial Sequence
  Description of Artificial Sequence: Synthetic peptide
QEVEIATTNPVSTEQYGDVSENLQRGNY

SEQ ID NO: 36479 - protein, 28 aa, Artificial Sequence
  Description of Artificial Sequence: Synthetic peptide
DEEEIRTTNIVATEQYGSVETGDWMGNI

SEQ ID NO: 36480 - protein, 30 aa, Artificial Sequence
  Description of Artificial Sequence: Synthetic polypeptide
MENEIRTTNPVATEQYGSVSTDLQNEGNDS

SEQ ID NO: 36481 - protein, 28 aa, Artificial Sequence
  Description of Artificial Sequence: Synthetic peptide
VEEEIRTTNPCATEQYGSVGYNLMRGPI

SEQ ID NO: 36482 - protein, 28 aa, Artificial Sequence
  Description of Artificial Sequence: Synthetic peptide
DEVEISTTNPEATFQYGSVSANLQQGNF

SEQ ID NO: 36483 - protein, 32 aa, Artificial Sequence
  Description of Artificial Sequence: Synthetic polypeptide
DEEEIRTTNPVATEQYGECVSTCNLQLMGDNW

SEQ ID NO: 36484 - protein, 28 aa, Artificial Sequence
  Description of Artificial Sequence: Synthetic peptide
YEQEIRTTNPVATEQYGSASSNLCHGNG

SEQ ID NO: 36485 - protein, 30 aa, Artificial Sequence
  Description of Artificial Sequence: Synthetic polypeptide
DEQEIRCTNPVASEQYGSVSANNLERNGNR

SEQ ID NO: 36486 - protein, 28 aa, Artificial Sequence
  Description of Artificial Sequence: Synthetic peptide
DEQEIRTTNIVATEQYGSVETIDDRGTR

SEQ ID NO: 36487 - protein, 28 aa, Artificial Sequence
  Description of Artificial Sequence: Synthetic peptide
DEEEIRTTNNVAESQYGQVSTNSQGGND

SEQ ID NO: 36488 - protein, 28 aa, Artificial Sequence
  Description of Artificial Sequence: Synthetic peptide
DEEEINTTNINANEQYGSVSNNLQRGAT

SEQ ID NO: 36489 - protein, 31 aa, Artificial Sequence
  Description of Artificial Sequence: Synthetic polypeptide
DEEEIRTTNPVATEQYGSHVSEALQQYGANP

SEQ ID NO: 36490 - protein, 28 aa, Artificial Sequence
  Description of Artificial Sequence: Synthetic peptide
DENEIRTTNPCATEQYGDVSTGLQRPTD

SEQ ID NO: 36491 - protein, 32 aa, Artificial Sequence
  Description of Artificial Sequence: Synthetic polypeptide
DEEEIRTTNPVATEQYGSVSTCNEQEIGDNTQ

SEQ ID NO: 36492 - protein, 28 aa, Artificial Sequence
  Description of Artificial Sequence: Synthetic peptide
QEQEIVATNPVATEQYGEASENLQRGNR

SEQ ID NO: 36493 - protein, 32 aa, Artificial Sequence
  Description of Artificial Sequence: Synthetic polypeptide
DEEEIRTTNPVATEQYGSVSETNLEDRDGEEL

SEQ ID NO: 36494 - protein, 30 aa, Artificial Sequence
  Description of Artificial Sequence: Synthetic polypeptide
DEEEIRTTNPVATEQYGSVSENLQEHEEDN

SEQ ID NO: 36495 - protein, 33 aa, Artificial Sequence
  Description of Artificial Sequence: Synthetic polypeptide
DEEEIRTTNPVATEQYGSVCSDTGNLQDQGDER

SEQ ID NO: 36496 - protein, 28 aa, Artificial Sequence
  Description of Artificial Sequence: Synthetic peptide
DEQEVATTNPIAYEMYGSVSTNLERGNR

SEQ ID NO: 36497 - protein, 28 aa, Artificial Sequence
  Description of Artificial Sequence: Synthetic peptide
DEDEISTTNPVATEMWGSISENLQHGNR

SEQ ID NO: 36498 - protein, 32 aa, Artificial Sequence
  Description of Artificial Sequence: Synthetic polypeptide
DEEEIRTTNPVATEQYGSVSTMNPQLNEGDNF

SEQ ID NO: 36499 - protein, 28 aa, Artificial Sequence
  Description of Artificial Sequence: Synthetic peptide
DEQEIRCTNPVASEIYGCVATNLERGNR

SEQ ID NO: 36500 - protein, 28 aa, Artificial Sequence
  Description of Artificial Sequence: Synthetic peptide
DEQEIAATNPVSTENYGWVATNLQRGNR

SEQ ID NO: 36501 - protein, 28 aa, Artificial Sequence
  Description of Artificial Sequence: Synthetic peptide
DEEEIRQTNIVATLRYGSVSTNLGEGNT

SEQ ID NO: 36502 - protein, 30 aa, Artificial Sequence
  Description of Artificial Sequence: Synthetic polypeptide
DEQEIRTTNPVATEVYGCVAATNLEREGNR

SEQ ID NO: 36503 - protein, 32 aa, Artificial Sequence
  Description of Artificial Sequence: Synthetic polypeptide
DEEEIRTTNPVATEQYGSVSETVGLTDERGER

SEQ ID NO: 36504 - protein, 29 aa, Artificial Sequence
  Description of Artificial Sequence: Synthetic peptide
NEEEIRTTNPIATEWYGCVSMNLQFRGND

SEQ ID NO: 36505 - protein, 31 aa, Artificial Sequence
  Description of Artificial Sequence: Synthetic polypeptide
DEEEIRTTNPVATEQYGSVSTNLEEIEGEDF

SEQ ID NO: 36506 - protein, 28 aa, Artificial Sequence
  Description of Artificial Sequence: Synthetic peptide
DEEEIRTTNPVATEQYGSVSEDLEHEEN

SEQ ID NO: 36507 - protein, 28 aa, Artificial Sequence
  Description of Artificial Sequence: Synthetic peptide
DEEEVRTNLLVATEQLGTVSTNKQRGNR

SEQ ID NO: 36508 - protein, 28 aa, Artificial Sequence
  Description of Artificial Sequence: Synthetic peptide
DEEEIRTTNPDATEQYWSVETPLDPGNP

SEQ ID NO: 36509 - protein, 28 aa, Artificial Sequence
  Description of Artificial Sequence: Synthetic peptide
DEQEIAATNPVSTEIYGWVATNLQRGNR

SEQ ID NO: 36510 - protein, 32 aa, Artificial Sequence
  Description of Artificial Sequence: Synthetic polypeptide
DEEEIRTTNPDATEQYGSVSDTPNLQDNGDNP

SEQ ID NO: 36511 - protein, 31 aa, Artificial Sequence
  Description of Artificial Sequence: Synthetic polypeptide
MEEEIRTTNPVATECYGSVSTNLQDNEGNDM

SEQ ID NO: 36512 - protein, 31 aa, Artificial Sequence
  Description of Artificial Sequence: Synthetic polypeptide
DEEEIRTTNPVATEQYGSVDSTNPDQDAGED

SEQ ID NO: 36513 - protein, 33 aa, Artificial Sequence
  Description of Artificial Sequence: Synthetic polypeptide
DEEEIRTTNPVATEQYGSVDSETNLEEDDGENR

SEQ ID NO: 36514 - protein, 28 aa, Artificial Sequence
  Description of Artificial Sequence: Synthetic peptide
DEEEIRTTNPCASEHYGCVSTNLEPPNR

SEQ ID NO: 36515 - protein, 28 aa, Artificial Sequence
  Description of Artificial Sequence: Synthetic peptide
CEQEINTTNPVATEGFGSISENLQRGNR

SEQ ID NO: 36516 - protein, 28 aa, Artificial Sequence
  Description of Artificial Sequence: Synthetic peptide
DENEIRQTNPVATEQYGVVSTDDQHGNL

SEQ ID NO: 36517 - protein, 28 aa, Artificial Sequence
  Description of Artificial Sequence: Synthetic peptide
DEEEICCTNPEATEQYGSVSTNDQLGPH

SEQ ID NO: 36518 - protein, 28 aa, Artificial Sequence
  Description of Artificial Sequence: Synthetic peptide
DEEEIASTNIVSTEQYGWVATNLQRGNT

SEQ ID NO: 36519 - protein, 32 aa, Artificial Sequence
  Description of Artificial Sequence: Synthetic polypeptide
DEEEIRTTNPVATEQYGSVSITENLEDNDGNL

SEQ ID NO: 36520 - protein, 31 aa, Artificial Sequence
  Description of Artificial Sequence: Synthetic polypeptide
DEEEIRTTNPEATEQYGSVSTNGDQIEGENF

SEQ ID NO: 36521 - protein, 32 aa, Artificial Sequence
  Description of Artificial Sequence: Synthetic polypeptide
DEEEIRTTNPDATEQYGSVASTGLVIREGVNR

SEQ ID NO: 36522 - protein, 30 aa, Artificial Sequence
  Description of Artificial Sequence: Synthetic polypeptide
DEEEIRTTNPVATEQYGSWCSTNLNEGEEN

SEQ ID NO: 36523 - protein, 30 aa, Artificial Sequence
  Description of Artificial Sequence: Synthetic polypeptide
DEEEIRTTNPVASEQYGCVGAMNLERNGNR

SEQ ID NO: 36524 - protein, 28 aa, Artificial Sequence
  Description of Artificial Sequence: Synthetic peptide
QETEIRATNPVSTEMYGVVSTNLQRGGR

SEQ ID NO: 36525 - protein, 30 aa, Artificial Sequence
  Description of Artificial Sequence: Synthetic polypeptide
DEQEIRCTNPVASEIYGCVSATNLQRNGNR

SEQ ID NO: 36526 - protein, 28 aa, Artificial Sequence
  Description of Artificial Sequence: Synthetic peptide
DEEEIRTTNPVATEQYGDVSEELQHEEM

SEQ ID NO: 36527 - protein, 28 aa, Artificial Sequence
  Description of Artificial Sequence: Synthetic peptide
DEEEIRTVNPVATEMYGSVSEDLQAGDD

SEQ ID NO: 36528 - protein, 31 aa, Artificial Sequence
  Description of Artificial Sequence: Synthetic polypeptide
DEEEIATTNPTATEQYGSVSTMNEQIEGDNR

SEQ ID NO: 36529 - protein, 30 aa, Artificial Sequence
  Description of Artificial Sequence: Synthetic polypeptide
DEQEVRTTNPVATEIYGCVSATNLERNGNR

SEQ ID NO: 36530 - protein, 28 aa, Artificial Sequence
  Description of Artificial Sequence: Synthetic peptide
AENEIRQTNPVATEQYGVVSTDLQRGED

SEQ ID NO: 36531 - protein, 28 aa, Artificial Sequence
  Description of Artificial Sequence: Synthetic peptide
DEQEIRTTNPVATEQYGSVSTDDEGGEN

SEQ ID NO: 36532 - protein, 31 aa, Artificial Sequence
  Description of Artificial Sequence: Synthetic polypeptide
DEEEIRTTNPIATFQYGSVSDTDLQLPNGNR

SEQ ID NO: 36533 - protein, 28 aa, Artificial Sequence
  Description of Artificial Sequence: Synthetic peptide
DEEEIRTTNPVATEQYGEVSEVLQHEEK

SEQ ID NO: 36534 - protein, 28 aa, Artificial Sequence
  Description of Artificial Sequence: Synthetic peptide
DEVEIAATNPTATEQYGSVSTNEQQGNF

SEQ ID NO: 36535 - protein, 28 aa, Artificial Sequence
  Description of Artificial Sequence: Synthetic peptide
DEGEIVATNPVATEVYGDVSTNIQRGNF

SEQ ID NO: 36536 - protein, 33 aa, Artificial Sequence
  Description of Artificial Sequence: Synthetic polypeptide
DEEEIRTTNPVATEQYGSVSETVGNLTDERGER

SEQ ID NO: 36537 - protein, 30 aa, Artificial Sequence
  Description of Artificial Sequence: Synthetic polypeptide
DEEEISSTNPVATEQYGDVISTNLQLNGNA

SEQ ID NO: 36538 - protein, 32 aa, Artificial Sequence
  Description of Artificial Sequence: Synthetic polypeptide
DEEEIRTTNPVATEQYGSVSTANEQEFGDNTG

SEQ ID NO: 36539 - protein, 29 aa, Artificial Sequence
  Description of Artificial Sequence: Synthetic peptide
DEEEINSVNPVATEQYGTVSTNLQHAGMR

SEQ ID NO: 36540 - protein, 28 aa, Artificial Sequence
  Description of Artificial Sequence: Synthetic peptide
DEEEIRSTNIVSSEIYGVVGTNLQRGNR

SEQ ID NO: 36541 - protein, 28 aa, Artificial Sequence
  Description of Artificial Sequence: Synthetic peptide
TEQEIATTNPVATEQYGMTSTNLLHGNR

SEQ ID NO: 36542 - protein, 31 aa, Artificial Sequence
  Description of Artificial Sequence: Synthetic polypeptide
DEEEIRTTNPVATEQYGSVSETNLEDSGDEI

SEQ ID NO: 36543 - protein, 28 aa, Artificial Sequence
  Description of Artificial Sequence: Synthetic peptide
DEQEIRTTNPVATEQYGSVSTDDEIGEF

SEQ ID NO: 36544 - protein, 29 aa, Artificial Sequence
  Description of Artificial Sequence: Synthetic peptide
VEEEIRTTNPVATEQYGCVGMNLQRLTER

SEQ ID NO: 36545 - protein, 28 aa, Artificial Sequence
  Description of Artificial Sequence: Synthetic peptide
DEEEIRTTNPFATEQYGSVSTGQELGEH

SEQ ID NO: 36546 - protein, 29 aa, Artificial Sequence
  Description of Artificial Sequence: Synthetic peptide
DEEEIRTTNPCATEQYGDASMNWQRGNDI

SEQ ID NO: 36547 - protein, 28 aa, Artificial Sequence
  Description of Artificial Sequence: Synthetic peptide
QEEEIRTTNPVSTEQYGEVSTLVQHGNI

SEQ ID NO: 36548 - protein, 30 aa, Artificial Sequence
  Description of Artificial Sequence: Synthetic polypeptide
DEEEIRATNPVATETYGSASMMDNLQAGNR

SEQ ID NO: 36549 - protein, 31 aa, Artificial Sequence
  Description of Artificial Sequence: Synthetic polypeptide
DEEEIRTTNPVATEQYGSVSTEPLQEFDGEY

SEQ ID NO: 36550 - protein, 29 aa, Artificial Sequence
  Description of Artificial Sequence: Synthetic peptide
DEEEIRTTNPVATELWGSVSTNEMMIGNM

SEQ ID NO: 36551 - protein, 28 aa, Artificial Sequence
  Description of Artificial Sequence: Synthetic peptide
NEEEIRTTNPVATEQYGTTATNLQSSNT

SEQ ID NO: 36552 - protein, 28 aa, Artificial Sequence
  Description of Artificial Sequence: Synthetic peptide
SEEEIRTTNPEATEQYGSVSTGPQHGTV

SEQ ID NO: 36553 - protein, 28 aa, Artificial Sequence
  Description of Artificial Sequence: Synthetic peptide
DEGEIATTNPVATENYGEVSTNLIQGNQ

SEQ ID NO: 36554 - protein, 31 aa, Artificial Sequence
  Description of Artificial Sequence: Synthetic polypeptide
DEEEIRTTNPVATEQYGSVSTNLEDHEGEDF

SEQ ID NO: 36555 - protein, 29 aa, Artificial Sequence
  Description of Artificial Sequence: Synthetic peptide
SEEEIAATNPVATEQFGSVDSTNLQQGTR

SEQ ID NO: 36556 - protein, 28 aa, Artificial Sequence
  Description of Artificial Sequence: Synthetic peptide
SEEEIMTTNPAATEQYGSVSVNLQVGDA

SEQ ID NO: 36557 - protein, 28 aa, Artificial Sequence
  Description of Artificial Sequence: Synthetic peptide
DENEIATTNPVATEQYGVVSTELQIGEY

SEQ ID NO: 36558 - protein, 28 aa, Artificial Sequence
  Description of Artificial Sequence: Synthetic peptide
NEEEIQTTNIVAYEQYGQVSTNLQNGNT

SEQ ID NO: 36559 - protein, 29 aa, Artificial Sequence
  Description of Artificial Sequence: Synthetic peptide
QEQEIVTTNPVATEQYGDVSAENLQRGGR

SEQ ID NO: 36560 - protein, 30 aa, Artificial Sequence
  Description of Artificial Sequence: Synthetic polypeptide
DEGEIRATNPVATEQFGSVSTGNLQQGDDR

SEQ ID NO: 36561 - protein, 30 aa, Artificial Sequence
  Description of Artificial Sequence: Synthetic polypeptide
QEEEIRTTNPVATECYGSVSANNLERNGER

SEQ ID NO: 36562 - protein, 28 aa, Artificial Sequence
  Description of Artificial Sequence: Synthetic peptide
DEEEIRPTNPDATEQYGSVSTCEDPGNG

SEQ ID NO: 36563 - protein, 32 aa, Artificial Sequence
  Description of Artificial Sequence: Synthetic polypeptide
DEEEIRTTNPVATEQYGSVSTNLEDHEGEEDR

SEQ ID NO: 36564 - protein, 30 aa, Artificial Sequence
  Description of Artificial Sequence: Synthetic polypeptide
DDDEIRTTNPVATELYGSVSTEDFQREGNR

SEQ ID NO: 36565 - protein, 28 aa, Artificial Sequence
  Description of Artificial Sequence: Synthetic peptide
DDEEIRTTNPCAYEQYGVVASNLERGNR

SEQ ID NO: 36566 - protein, 31 aa, Artificial Sequence
  Description of Artificial Sequence: Synthetic polypeptide
DEEEIRTTNPVATEQYGSVASMELCVDGENR

SEQ ID NO: 36567 - protein, 30 aa, Artificial Sequence
  Description of Artificial Sequence: Synthetic polypeptide
DEEEIRTTNPEATEGYGSVSTNPLGSGENH

SEQ ID NO: 36568 - protein, 28 aa, Artificial Sequence
  Description of Artificial Sequence: Synthetic peptide
DETEICTTNIVATEQYGEASTILQRGNK

SEQ ID NO: 36569 - protein, 28 aa, Artificial Sequence
  Description of Artificial Sequence: Synthetic peptide
DEQEIRTTNPVATEQWGSVSENEMIGNW

SEQ ID NO: 36570 - protein, 31 aa, Artificial Sequence
  Description of Artificial Sequence: Synthetic polypeptide
DEEEIRTTNPVATEQYGSVISDNLPQVGPTI

SEQ ID NO: 36571 - protein, 32 aa, Artificial Sequence
  Description of Artificial Sequence: Synthetic polypeptide
DEEEIRTTNPVATEQYGSVSCTMDLQCVGNDD

SEQ ID NO: 36572 - protein, 28 aa, Artificial Sequence
  Description of Artificial Sequence: Synthetic peptide
QEEEIATTNPCASEQYGIVSTNLQSGTR

SEQ ID NO: 36573 - protein, 30 aa, Artificial Sequence
  Description of Artificial Sequence: Synthetic polypeptide
DNEEIRSTNPVATEQYGSVNTNEQREGDPR

SEQ ID NO: 36574 - protein, 30 aa, Artificial Sequence
  Description of Artificial Sequence: Synthetic polypeptide
DEEEIRTTNPVATEQYGDVSEANLQHGPDI

SEQ ID NO: 36575 - protein, 30 aa, Artificial Sequence
  Description of Artificial Sequence: Synthetic polypeptide
DEEEIRTTNPVATECYGSVSTELEERKGEI

SEQ ID NO: 36576 - protein, 28 aa, Artificial Sequence
  Description of Artificial Sequence: Synthetic peptide
DEEEIRATNPVATEQYGDVSTQEQLNNE

SEQ ID NO: 36577 - protein, 34 aa, Artificial Sequence
  Description of Artificial Sequence: Synthetic polypeptide
DEEEIRTTNPVATEQYGSVSSTTPNLPNRNGNPR

SEQ ID NO: 36578 - protein, 28 aa, Artificial Sequence
  Description of Artificial Sequence: Synthetic peptide
DEEEIAQTNPVATEQYGSVSTDQEVGND

SEQ ID NO: 36579 - protein, 33 aa, Artificial Sequence
  Description of Artificial Sequence: Synthetic polypeptide
DEEEIRTTNPVATEQYGSVSTCNEQDREGDNTE

SEQ ID NO: 36580 - protein, 30 aa, Artificial Sequence
  Description of Artificial Sequence: Synthetic polypeptide
DEEEIRTTNPVATEHFGGVSTANLPQIGNQ

SEQ ID NO: 36581 - protein, 29 aa, Artificial Sequence
  Description of Artificial Sequence: Synthetic peptide
DEAEIRTTNPIATEQFGSVSEIVLQRGNH

SEQ ID NO: 36582 - protein, 28 aa, Artificial Sequence
  Description of Artificial Sequence: Synthetic peptide
TEEEIRTTNPVGTEQYGNVSENLMRGDA

SEQ ID NO: 36583 - protein, 28 aa, Artificial Sequence
  Description of Artificial Sequence: Synthetic peptide
DEEEICTTNPTATEQFGGVSENWQQGNR

SEQ ID NO: 36584 - protein, 28 aa, Artificial Sequence
  Description of Artificial Sequence: Synthetic peptide
DTEEIRTTNPYATEQYGSVHTGDIRGNP

SEQ ID NO: 36585 - protein, 31 aa, Artificial Sequence
  Description of Artificial Sequence: Synthetic polypeptide
DEEEIRTTNPVATECYGSVSTEELQEINGNE

SEQ ID NO: 36586 - protein, 28 aa, Artificial Sequence
  Description of Artificial Sequence: Synthetic peptide
DNEEIDTTNITATEQYDSVSTNLQQQNR

SEQ ID NO: 36587 - protein, 28 aa, Artificial Sequence
  Description of Artificial Sequence: Synthetic peptide
DENEIATTNPVATECYGSVSTDLEHGNL

SEQ ID NO: 36588 - protein, 28 aa, Artificial Sequence
  Description of Artificial Sequence: Synthetic peptide
AEEEIGTTNPVATEIYGDCSTNLQMGQR

SEQ ID NO: 36589 - protein, 28 aa, Artificial Sequence
  Description of Artificial Sequence: Synthetic peptide
DEEEIRTTNIVATEQYGSVDTIDDLGER

SEQ ID NO: 36590 - protein, 32 aa, Artificial Sequence
  Description of Artificial Sequence: Synthetic polypeptide
DEQEIRTTNPVATEQYGSVDSTINDQERNGDR

SEQ ID NO: 36591 - protein, 32 aa, Artificial Sequence
  Description of Artificial Sequence: Synthetic polypeptide
DEEEIRTTNPVATEQYGSVSTLNPDQDHGEDR

SEQ ID NO: 36592 - protein, 32 aa, Artificial Sequence
  Description of Artificial Sequence: Synthetic polypeptide
DEEEIRTTNPVATEQYGSVSDTLADQRKGEER

SEQ ID NO: 36593 - protein, 28 aa, Artificial Sequence
  Description of Artificial Sequence: Synthetic peptide
DEEEIATTNIVGTSQYGCVSDNLQRGNT

SEQ ID NO: 36594 - protein, 28 aa, Artificial Sequence
  Description of Artificial Sequence: Synthetic peptide
DEDSILTTNIVADEQYGSLSTNIQRGNR

SEQ ID NO: 36595 - protein, 28 aa, Artificial Sequence
  Description of Artificial Sequence: Synthetic peptide
DEQEIRTTNPVATEQYGSVSTDDEHGEF

SEQ ID NO: 36596 - protein, 31 aa, Artificial Sequence
  Description of Artificial Sequence: Synthetic polypeptide
DEEEIRTTNPVATEQYGSVSTDLELNNGNDT

SEQ ID NO: 36597 - protein, 28 aa, Artificial Sequence
  Description of Artificial Sequence: Synthetic peptide
DEEEIASTNIVSTEMYGSASTNLQRGGR

SEQ ID NO: 36598 - protein, 30 aa, Artificial Sequence
  Description of Artificial Sequence: Synthetic polypeptide
QENEIRTTNPVATECYGVVSTNLQMREGND

SEQ ID NO: 36599 - protein, 28 aa, Artificial Sequence
  Description of Artificial Sequence: Synthetic peptide
DEVEIATTNPTATEQYGGVSTNEQQGNF

SEQ ID NO: 36600 - protein, 28 aa, Artificial Sequence
  Description of Artificial Sequence: Synthetic peptide
DEEEIRTTNPVATEQYGDVWTTDQSGEA

SEQ ID NO: 36601 - protein, 29 aa, Artificial Sequence
  Description of Artificial Sequence: Synthetic peptide
DEEEIRTTNPVATEQYGEVSENLQEAEEM

SEQ ID NO: 36602 - protein, 28 aa, Artificial Sequence
  Description of Artificial Sequence: Synthetic peptide
DENEIAQTNPVATEQYGSVSTGLEHGNQ

SEQ ID NO: 36603 - protein, 29 aa, Artificial Sequence
  Description of Artificial Sequence: Synthetic peptide
DEEEIRTTNPVATEQYGSASDDDQMGNDN

SEQ ID NO: 36604 - protein, 29 aa, Artificial Sequence
  Description of Artificial Sequence: Synthetic peptide
DEEEINATNPVATEQYGVVGTNLQSRGGH

SEQ ID NO: 36605 - protein, 33 aa, Artificial Sequence
  Description of Artificial Sequence: Synthetic polypeptide
DEEEIRTTNPVATEQYGSVDSTNLVEDHEGNDR

SEQ ID NO: 36606 - protein, 31 aa, Artificial Sequence
  Description of Artificial Sequence: Synthetic polypeptide
DEGEIRTTNPVATEQYGSVEESNLEQRTGNM

SEQ ID NO: 36607 - protein, 28 aa, Artificial Sequence
  Description of Artificial Sequence: Synthetic peptide
DENEIATTNPVATECYGSVSTDLQHGEL

SEQ ID NO: 36608 - protein, 28 aa, Artificial Sequence
  Description of Artificial Sequence: Synthetic peptide
DEEEIRQTNPVATEQYGVVSTEDQAGET

SEQ ID NO: 36609 - protein, 28 aa, Artificial Sequence
  Description of Artificial Sequence: Synthetic peptide
DEEEIADTNIVATETYGAVGTNLERGNR

SEQ ID NO: 36610 - protein, 28 aa, Artificial Sequence
  Description of Artificial Sequence: Synthetic peptide
DEEELRATNPCATESFGSVPTNVQRGNR

SEQ ID NO: 36611 - protein, 28 aa, Artificial Sequence
  Description of Artificial Sequence: Synthetic peptide
DESEIKATNIVATENYGVVATNLQRGNR

SEQ ID NO: 36612 - protein, 30 aa, Artificial Sequence
  Description of Artificial Sequence: Synthetic polypeptide
DEVEISTTNPVATEQYGSVSATADQRGENF

SEQ ID NO: 36613 - protein, 29 aa, Artificial Sequence
  Description of Artificial Sequence: Synthetic peptide
DEEEIRTTNPVATEQYGSVGTNEPVEEDR

SEQ ID NO: 36614 - protein, 29 aa, Artificial Sequence
  Description of Artificial Sequence: Synthetic peptide
DEEEIRTTNPVATEQYGDVSECLQCHGEL

SEQ ID NO: 36615 - protein, 33 aa, Artificial Sequence
  Description of Artificial Sequence: Synthetic polypeptide
DEEEIRTTNPVATEQYGSVSCTGNLQVDGENDC

SEQ ID NO: 36616 - protein, 31 aa, Artificial Sequence
  Description of Artificial Sequence: Synthetic polypeptide
DDEEIRTTNPVATECYGSVSTNGLQERKGET

SEQ ID NO: 36617 - protein, 29 aa, Artificial Sequence
  Description of Artificial Sequence: Synthetic peptide
DEQEIRTTNPVATECWGSVSENLMIQGNR

SEQ ID NO: 36618 - protein, 31 aa, Artificial Sequence
  Description of Artificial Sequence: Synthetic polypeptide
MEEEIRTTNPVATEQYGSVSTDLQENEGNDM

SEQ ID NO: 36619 - protein, 28 aa, Artificial Sequence
  Description of Artificial Sequence: Synthetic peptide
DEQEIRTTNPVATEQWGSVDTNEELGNF

SEQ ID NO: 36620 - protein, 31 aa, Artificial Sequence
  Description of Artificial Sequence: Synthetic polypeptide
AEQEIVTTNPVATEQYGSVSTGNLERNGVNR

SEQ ID NO: 36621 - protein, 29 aa, Artificial Sequence
  Description of Artificial Sequence: Synthetic peptide
DENEIRTTNPVATEQWGSVSENEMMRGNF

SEQ ID NO: 36622 - protein, 28 aa, Artificial Sequence
  Description of Artificial Sequence: Synthetic peptide
DEENIRTTNNTATEQYDSTSDNLLRGNR

SEQ ID NO: 36623 - protein, 33 aa, Artificial Sequence
  Description of Artificial Sequence: Synthetic polypeptide
DEEEIRTTNPVATEQYGSVDDVTNGLERKGINR

SEQ ID NO: 36624 - protein, 28 aa, Artificial Sequence
  Description of Artificial Sequence: Synthetic peptide
DEEEVRSTNQVATQEYGSVSDNLQRGNT

SEQ ID NO: 36625 - protein, 33 aa, Artificial Sequence
  Description of Artificial Sequence: Synthetic polypeptide
DEEEIRTTNPVATEQYGSVISTANLPCRGDNCF

SEQ ID NO: 36626 - protein, 32 aa, Artificial Sequence
  Description of Artificial Sequence: Synthetic polypeptide
DEEEIRTTNPVATEQYGSVSATNLELVEGNDD

SEQ ID NO: 36627 - protein, 28 aa, Artificial Sequence
  Description of Artificial Sequence: Synthetic peptide
DEEEIRTTNIVATEQYGSVETIDQDGET

SEQ ID NO: 36628 - protein, 29 aa, Artificial Sequence
  Description of Artificial Sequence: Synthetic peptide
DDQEIRATNPIAYEQYGVVSATNLQRGNR

SEQ ID NO: 36629 - protein, 33 aa, Artificial Sequence
  Description of Artificial Sequence: Synthetic polypeptide
DEEEIRTTNPVATEQYGSVESDTPPLERDGDNR

SEQ ID NO: 36630 - protein, 28 aa, Artificial Sequence
  Description of Artificial Sequence: Synthetic peptide
QEEEIATVNPVATEVYGEASTNLQHGNR

SEQ ID NO: 36631 - protein, 31 aa, Artificial Sequence
  Description of Artificial Sequence: Synthetic polypeptide
DEEEIRTTNPVATEQYGSVATMELCVDGENR

SEQ ID NO: 36632 - protein, 29 aa, Artificial Sequence
  Description of Artificial Sequence: Synthetic peptide
DEEEIRTTNPTATEQYGEVSENPQSGDNI

SEQ ID NO: 36633 - protein, 28 aa, Artificial Sequence
  Description of Artificial Sequence: Synthetic peptide
NEGEICTTNPVATEWYGDVSTLLQRGNS

SEQ ID NO: 36634 - protein, 33 aa, Artificial Sequence
  Description of Artificial Sequence: Synthetic polypeptide
DEQEIRTTNPVATEQYGSVETENLVQREGENDR

SEQ ID NO: 36635 - protein, 30 aa, Artificial Sequence
  Description of Artificial Sequence: Synthetic polypeptide
DLEEIRTTNPVATENYGEVISTVLQREGNI

SEQ ID NO: 36636 - protein, 28 aa, Artificial Sequence
  Description of Artificial Sequence: Synthetic peptide
SEGEIRTTNPEATEIYGSVSTNWQQGLR

SEQ ID NO: 36637 - protein, 29 aa, Artificial Sequence
  Description of Artificial Sequence: Synthetic peptide
DEEEIRTTNPVATEQYGDVSENLMHAGQQ

SEQ ID NO: 36638 - protein, 31 aa, Artificial Sequence
  Description of Artificial Sequence: Synthetic polypeptide
DEEEIRTTNPVATEQYGEVSTMNLPQIGDTA

SEQ ID NO: 36639 - protein, 28 aa, Artificial Sequence
  Description of Artificial Sequence: Synthetic peptide
DEEEVRCTNPVATEIYGCVAMNLERGNR

SEQ ID NO: 36640 - protein, 28 aa, Artificial Sequence
  Description of Artificial Sequence: Synthetic peptide
DEHEIRTTNPVATEQYGSASEALCQGNE

SEQ ID NO: 36641 - protein, 28 aa, Artificial Sequence
  Description of Artificial Sequence: Synthetic peptide
DEEEVATTNIVATEMYGTVGTNLQRGGR

SEQ ID NO: 36642 - protein, 32 aa, Artificial Sequence
  Description of Artificial Sequence: Synthetic polypeptide
DEEEIRTTNPVATEQYGSVISTMNEPQDQGNF

SEQ ID NO: 36643 - protein, 28 aa, Artificial Sequence
  Description of Artificial Sequence: Synthetic peptide
SEEEIRTTNPVATEIFGSVSTDLQSGLL

SEQ ID NO: 36644 - protein, 28 aa, Artificial Sequence
  Description of Artificial Sequence: Synthetic peptide
DEEEIETTNIVANEQGGSVSTNLQTINL

SEQ ID NO: 36645 - protein, 32 aa, Artificial Sequence
  Description of Artificial Sequence: Synthetic polypeptide
DEEEIRTTNPVATEQYGSVDCTMNLCCRGDND

SEQ ID NO: 36646 - protein, 28 aa, Artificial Sequence
  Description of Artificial Sequence: Synthetic peptide
DDEEVACTNPVATEQYGSVSMNLQRLNQ

SEQ ID NO: 36647 - protein, 28 aa, Artificial Sequence
  Description of Artificial Sequence: Synthetic peptide
DEEEIRTTNPVATEQYGDVSECPQHGEL

SEQ ID NO: 36648 - protein, 28 aa, Artificial Sequence
  Description of Artificial Sequence: Synthetic peptide
DVEERIRTNDVADEQYGSVSTNLQQGGR

SEQ ID NO: 36649 - protein, 28 aa, Artificial Sequence
  Description of Artificial Sequence: Synthetic peptide
DEEEVRTTNIVANEQYGSVENNFQIGNR

SEQ ID NO: 36650 - protein, 30 aa, Artificial Sequence
  Description of Artificial Sequence: Synthetic polypeptide
DEEEIRTTNPVSTEQYGEASATNLQHAGGR

SEQ ID NO: 36651 - protein, 28 aa, Artificial Sequence
  Description of Artificial Sequence: Synthetic peptide
TEQEIATTNPVATECYGSTSTNLQHGND

SEQ ID NO: 36652 - protein, 28 aa, Artificial Sequence
  Description of Artificial Sequence: Synthetic peptide
AEEEIRTTNPDSTENYGEVSTNLQLGDR

SEQ ID NO: 36653 - protein, 30 aa, Artificial Sequence
  Description of Artificial Sequence: Synthetic polypeptide
QEEEIRTTNPVATEQYGVVSTDLQESGNDN

SEQ ID NO: 36654 - protein, 28 aa, Artificial Sequence
  Description of Artificial Sequence: Synthetic peptide
DEVEITTTNPVATEVYGSVSENLETGNG

SEQ ID NO: 36655 - protein, 28 aa, Artificial Sequence
  Description of Artificial Sequence: Synthetic peptide
DEEEIRTTNPCATEQYGSVGTDDEAGNM

SEQ ID NO: 36656 - protein, 33 aa, Artificial Sequence
  Description of Artificial Sequence: Synthetic polypeptide
DEEEIRTTNPVATEQYGESVDSETDGDVQRGNR

SEQ ID NO: 36657 - protein, 28 aa, Artificial Sequence
  Description of Artificial Sequence: Synthetic peptide
DEEEIRTTNPIASEQYGSVSTGDQGGMF

SEQ ID NO: 36658 - protein, 28 aa, Artificial Sequence
  Description of Artificial Sequence: Synthetic peptide
DEEEIAITNIVATERYGKVSDNLQRGNT

SEQ ID NO: 36659 - protein, 30 aa, Artificial Sequence
  Description of Artificial Sequence: Synthetic polypeptide
DEQEIRTTNPVATECYGSVSTDLQDQGNDS

SEQ ID NO: 36660 - protein, 28 aa, Artificial Sequence
  Description of Artificial Sequence: Synthetic peptide
DEQEIRTTNPEATEQYGSVSTDDERGEF

SEQ ID NO: 36661 - protein, 28 aa, Artificial Sequence
  Description of Artificial Sequence: Synthetic peptide
SEEEIRTTNPTATEQFGSVSTNEQNGTL

SEQ ID NO: 36662 - protein, 33 aa, Artificial Sequence
  Description of Artificial Sequence: Synthetic polypeptide
DEEEIRTTNPVATEQYGWSVSTNNLTQNDGMNV

SEQ ID NO: 36663 - protein, 28 aa, Artificial Sequence
  Description of Artificial Sequence: Synthetic peptide
DEECIRTTNRSATEYYGQVSTNLQQGNS

SEQ ID NO: 36664 - protein, 28 aa, Artificial Sequence
  Description of Artificial Sequence: Synthetic peptide
DEEEITATNPVATEIYGVVAMNLQRGTR

SEQ ID NO: 36665 - protein, 28 aa, Artificial Sequence
  Description of Artificial Sequence: Synthetic peptide
DEEEIATVNPVATEQYGEVGENIQRGNL

SEQ ID NO: 36666 - protein, 29 aa, Artificial Sequence
  Description of Artificial Sequence: Synthetic peptide
DEQEIRTTNPVATEMYGSVSEELQDIGNM

SEQ ID NO: 36667 - protein, 29 aa, Artificial Sequence
  Description of Artificial Sequence: Synthetic peptide
MEEEIRATNPVATESYGVCVSTPLQRGND

SEQ ID NO: 36668 - protein, 33 aa, Artificial Sequence
  Description of Artificial Sequence: Synthetic polypeptide
DEEEIRTTNPVATEQYGSVSITPNPLQIDGDER

SEQ ID NO: 36669 - protein, 30 aa, Artificial Sequence
  Description of Artificial Sequence: Synthetic polypeptide
DEEEIATTNPTATEQYGSVSTMNEQNGDNV

SEQ ID NO: 36670 - protein, 30 aa, Artificial Sequence
  Description of Artificial Sequence: Synthetic polypeptide
DEEEISATNPCATEQYGEVSTTNLQLQGNR

SEQ ID NO: 36671 - protein, 31 aa, Artificial Sequence
  Description of Artificial Sequence: Synthetic polypeptide
DEEEIGTTNPVATEQYGSVQLANSLQRGITR

SEQ ID NO: 36672 - protein, 30 aa, Artificial Sequence
  Description of Artificial Sequence: Synthetic polypeptide
DEEEIRTTNPVATEQYGSVDTNEQLVGDDA

SEQ ID NO: 36673 - protein, 30 aa, Artificial Sequence
  Description of Artificial Sequence: Synthetic polypeptide
DEAEIRTTNPVCTEQYGSASTNLEDNGNDR

SEQ ID NO: 36674 - protein, 31 aa, Artificial Sequence
  Description of Artificial Sequence: Synthetic polypeptide
DEEEIATTNPVATECYGSVSATNLQRNGEDL

SEQ ID NO: 36675 - protein, 28 aa, Artificial Sequence
  Description of Artificial Sequence: Synthetic peptide
KEEEIRTTNPVATEQYGDVSENLQNEEL

SEQ ID NO: 36676 - protein, 30 aa, Artificial Sequence
  Description of Artificial Sequence: Synthetic polypeptide
DEEEIRTTNPIATEQYGAVSAENWQRGNYI

SEQ ID NO: 36677 - protein, 29 aa, Artificial Sequence
  Description of Artificial Sequence: Synthetic peptide
DEHEIRTTNPVATEQYGVVDTMDLQAGNA

SEQ ID NO: 36678 - protein, 31 aa, Artificial Sequence
  Description of Artificial Sequence: Synthetic polypeptide
DEEEIRATNPVATEQYGEVISTMNLQQEGNI

SEQ ID NO: 36679 - protein, 28 aa, Artificial Sequence
  Description of Artificial Sequence: Synthetic peptide
SEVEIATTNPVATEIYGSVSTNEQRGDF

SEQ ID NO: 36680 - protein, 29 aa, Artificial Sequence
  Description of Artificial Sequence: Synthetic peptide
DEEEIRTTNPVATELYGSVSTNEEWQGTQ

SEQ ID NO: 36681 - protein, 32 aa, Artificial Sequence
  Description of Artificial Sequence: Synthetic polypeptide
AEEEIRTTNPVATEQYGVVDDTTNGLVQRGNR

SEQ ID NO: 36682 - protein, 28 aa, Artificial Sequence
  Description of Artificial Sequence: Synthetic peptide
DEEEIVTTNPDATEQYGSVSTVDQNGDF

SEQ ID NO: 36683 - protein, 29 aa, Artificial Sequence
  Description of Artificial Sequence: Synthetic peptide
DEEEIATTNPVATEQYGDVSCEELQLGNV

SEQ ID NO: 36684 - protein, 28 aa, Artificial Sequence
  Description of Artificial Sequence: Synthetic peptide
QEQEIACTNPVATEQYGEASENLQRGNR

SEQ ID NO: 36685 - protein, 28 aa, Artificial Sequence
  Description of Artificial Sequence: Synthetic peptide
DEEEIRTTNPVATEQYGDVSECLCHGEM

SEQ ID NO: 36686 - protein, 28 aa, Artificial Sequence
  Description of Artificial Sequence: Synthetic peptide
CEDEIRQTNPVATEQYGVVSENLQHGNH

SEQ ID NO: 36687 - protein, 28 aa, Artificial Sequence
  Description of Artificial Sequence: Synthetic peptide
HETEICSTNPVATEQYGNVATNLQRGNI

SEQ ID NO: 36688 - protein, 32 aa, Artificial Sequence
  Description of Artificial Sequence: Synthetic polypeptide
DEEEIRTTNPVATEQYGDVSATTNQQLRGEND

SEQ ID NO: 36689 - protein, 29 aa, Artificial Sequence
  Description of Artificial Sequence: Synthetic peptide
DEQEIRTTNPVATEQWGSVSENEMMRGNM

SEQ ID NO: 36690 - protein, 28 aa, Artificial Sequence
  Description of Artificial Sequence: Synthetic peptide
QEEEIAATNPVATEQYGSVSTNLQQETY

SEQ ID NO: 36691 - protein, 30 aa, Artificial Sequence
  Description of Artificial Sequence: Synthetic polypeptide
SEEEIRTTNPVSTEQWGDVSTNLQWRGEDR

SEQ ID NO: 36692 - protein, 28 aa, Artificial Sequence
  Description of Artificial Sequence: Synthetic peptide
DEDEICCTNPVATEQFGSVSENWQQGNR

SEQ ID NO: 36693 - protein, 28 aa, Artificial Sequence
  Description of Artificial Sequence: Synthetic peptide
DDEEIRCTNIVATEAYGKVSTNLVSGNR

SEQ ID NO: 36694 - protein, 28 aa, Artificial Sequence
  Description of Artificial Sequence: Synthetic peptide
DEVEIATTNPTATEQYGSVSENEQQGNF

SEQ ID NO: 36695 - protein, 32 aa, Artificial Sequence
  Description of Artificial Sequence: Synthetic polypeptide
DEEEIRTTNPVACEQYGVSVISHNNLQRGNNM

SEQ ID NO: 36696 - protein, 28 aa, Artificial Sequence
  Description of Artificial Sequence: Synthetic peptide
DEQEIRTTNPVATEQYGSVETNDEMGDA

SEQ ID NO: 36697 - protein, 28 aa, Artificial Sequence
  Description of Artificial Sequence: Synthetic peptide
DEEEIAQTNPVATEQYGVVSENLEVGND

SEQ ID NO: 36698 - protein, 28 aa, Artificial Sequence
  Description of Artificial Sequence: Synthetic peptide
QEQEIAATNPVATEQYGEASENLQRGNR

SEQ ID NO: 36699 - protein, 30 aa, Artificial Sequence
  Description of Artificial Sequence: Synthetic polypeptide
DEEEIRTTNPVATEQYGDVSENLMNRAGDA

SEQ ID NO: 36700 - protein, 28 aa, Artificial Sequence
  Description of Artificial Sequence: Synthetic peptide
DEEEIRTTNPVATECYGDVSENLQHEEN

SEQ ID NO: 36701 - protein, 28 aa, Artificial Sequence
  Description of Artificial Sequence: Synthetic peptide
DEGEIRTTNPVATESYGNISTNPQGGNQ

SEQ ID NO: 36702 - protein, 31 aa, Artificial Sequence
  Description of Artificial Sequence: Synthetic polypeptide
DEQEIRTTNPVATEQYGSVSTNPLQEKGEEN

SEQ ID NO: 36703 - protein, 28 aa, Artificial Sequence
  Description of Artificial Sequence: Synthetic peptide
DESEISTTNIVSTEQYGSVSENLQRAIR

SEQ ID NO: 36704 - protein, 30 aa, Artificial Sequence
  Description of Artificial Sequence: Synthetic polypeptide
QEEEIRTTNPVATEQYGVVSTELQVVEGNG

SEQ ID NO: 36705 - protein, 28 aa, Artificial Sequence
  Description of Artificial Sequence: Synthetic peptide
DESEIRTTNPTACECYGVVSENLQRGQR

SEQ ID NO: 36706 - protein, 32 aa, Artificial Sequence
  Description of Artificial Sequence: Synthetic polypeptide
DEEEIRTTNPFATEQYGSVPSTNNLFREGMND

SEQ ID NO: 36707 - protein, 28 aa, Artificial Sequence
  Description of Artificial Sequence: Synthetic peptide
DEEAIRTTNGVATEHYGQVTTNLIRGTR

SEQ ID NO: 36708 - protein, 30 aa, Artificial Sequence
  Description of Artificial Sequence: Synthetic polypeptide
DEEEIRPTNPVATEQYGEVSMTGDPQTGNR

SEQ ID NO: 36709 - protein, 33 aa, Artificial Sequence
  Description of Artificial Sequence: Synthetic polypeptide
DEEEIRTTNPVATEQYGSVSVTIPLVQRGDEPR

SEQ ID NO: 36710 - protein, 28 aa, Artificial Sequence
  Description of Artificial Sequence: Synthetic peptide
DENEIRTVNPVATEQYGEAATVLQRGGR

SEQ ID NO: 36711 - protein, 32 aa, Artificial Sequence
  Description of Artificial Sequence: Synthetic polypeptide
DHEEIRTTNPVATEQWYGSVSDTNPLDREGNP

SEQ ID NO: 36712 - protein, 30 aa, Artificial Sequence
  Description of Artificial Sequence: Synthetic polypeptide
DEEEIRTTNPFATEQYGSVSTVGNPEDGNP

SEQ ID NO: 36713 - protein, 32 aa, Artificial Sequence
  Description of Artificial Sequence: Synthetic polypeptide
DEEEIRTTNPVATEQYWSVETPNPLQRGDEPR

SEQ ID NO: 36714 - protein, 29 aa, Artificial Sequence
  Description of Artificial Sequence: Synthetic peptide
DEQEIRTTNPVATELWGSVSTNDMNRGNW

SEQ ID NO: 36715 - protein, 28 aa, Artificial Sequence
  Description of Artificial Sequence: Synthetic peptide
DEEEIAQTNPVATEQYGSVSTPQELGND

SEQ ID NO: 36716 - protein, 31 aa, Artificial Sequence
  Description of Artificial Sequence: Synthetic polypeptide
DEEEIRTTNPVATMQYGSVSDTNLELPKGND

SEQ ID NO: 36717 - protein, 28 aa, Artificial Sequence
  Description of Artificial Sequence: Synthetic peptide
QESEIRTTNPVATEIYGEVSYNLERGNM

SEQ ID NO: 36718 - protein, 30 aa, Artificial Sequence
  Description of Artificial Sequence: Synthetic polypeptide
DEEEIATTNPTATEQYGSVSTNEQLEGDNQ

SEQ ID NO: 36719 - protein, 28 aa, Artificial Sequence
  Description of Artificial Sequence: Synthetic peptide
DEAEIAQTNPVATEMYGSTSCNLQRGNY

SEQ ID NO: 36720 - protein, 30 aa, Artificial Sequence
  Description of Artificial Sequence: Synthetic polypeptide
DEEEIRTTNPVATEQYGDVSCEALQCLGNE

SEQ ID NO: 36721 - protein, 28 aa, Artificial Sequence
  Description of Artificial Sequence: Synthetic peptide
SEEEIRATNPTATEQFGSVSTNPQNGNF

SEQ ID NO: 36722 - protein, 32 aa, Artificial Sequence
  Description of Artificial Sequence: Synthetic polypeptide
DEEEIRTTNPVATEQYGSVSTEELQPQEGENG

SEQ ID NO: 36723 - protein, 33 aa, Artificial Sequence
  Description of Artificial Sequence: Synthetic polypeptide
DEREIRTTNPVATEQYGSVSSPTLNLQRVENNR

SEQ ID NO: 36724 - protein, 28 aa, Artificial Sequence
  Description of Artificial Sequence: Synthetic peptide
DEEEIRTTNPFATEQYGIVPTEQQYGNL

SEQ ID NO: 36725 - protein, 32 aa, Artificial Sequence
  Description of Artificial Sequence: Synthetic polypeptide
DEEEIRQTNPVATEQYGSVSVTGGLVEDRGNR

SEQ ID NO: 36726 - protein, 28 aa, Artificial Sequence
  Description of Artificial Sequence: Synthetic peptide
DEEMIRTTNIVCTEQYGSVSVNLQDGQE

SEQ ID NO: 36727 - protein, 31 aa, Artificial Sequence
  Description of Artificial Sequence: Synthetic polypeptide
DEEEIRTTNPVATEQYGSVSTNLEEVEGEDI

SEQ ID NO: 36728 - protein, 31 aa, Artificial Sequence
  Description of Artificial Sequence: Synthetic polypeptide
DEEEIVTTNPVATEQYGSVSTGGDQIRGDNY

SEQ ID NO: 36729 - protein, 29 aa, Artificial Sequence
  Description of Artificial Sequence: Synthetic peptide
SEEEIRTTNPVCTEQYGSVSTNGWQTGTA

SEQ ID NO: 36730 - protein, 33 aa, Artificial Sequence
  Description of Artificial Sequence: Synthetic polypeptide
DEEEIRTTNPVATEQYGHSVHQTNPLQIRGENP

SEQ ID NO: 36731 - protein, 28 aa, Artificial Sequence
  Description of Artificial Sequence: Synthetic peptide
DEQEIATTNIVATECYGSVSTDLQDGND

SEQ ID NO: 36732 - protein, 29 aa, Artificial Sequence
  Description of Artificial Sequence: Synthetic peptide
MENEIRTTNPVATEQYGSVSTDLQNGEDS

SEQ ID NO: 36733 - protein, 28 aa, Artificial Sequence
  Description of Artificial Sequence: Synthetic peptide
MENEIRSTNPVATECYGSVSTNLQVGDA

SEQ ID NO: 36734 - protein, 31 aa, Artificial Sequence
  Description of Artificial Sequence: Synthetic polypeptide
MEQEIRTTNPVATEQYGSVSTNLQENEGNDS

SEQ ID NO: 36735 - protein, 32 aa, Artificial Sequence
  Description of Artificial Sequence: Synthetic polypeptide
DEEEIRTTNPVATEQYGSVSETNLEDRGEEDH

SEQ ID NO: 36736 - protein, 28 aa, Artificial Sequence
  Description of Artificial Sequence: Synthetic peptide
DEEEIATTNPVATEQYGDVSENLMHGQQ

SEQ ID NO: 36737 - protein, 31 aa, Artificial Sequence
  Description of Artificial Sequence: Synthetic polypeptide
DEEEIRTTNPVATEQYGSVSTELQEHDGEDW

SEQ ID NO: 36738 - protein, 31 aa, Artificial Sequence
  Description of Artificial Sequence: Synthetic polypeptide
DEEEIRTTNPVATEQYGSVDSDDLQVHENER

SEQ ID NO: 36739 - protein, 28 aa, Artificial Sequence
  Description of Artificial Sequence: Synthetic peptide
DEEEIRSTNPVATEQYGVVSTALEQGEH

SEQ ID NO: 36740 - protein, 30 aa, Artificial Sequence
  Description of Artificial Sequence: Synthetic polypeptide
REEEIRTTNPVATEQYGCCSVDTNLQQGIP

SEQ ID NO: 36741 - protein, 29 aa, Artificial Sequence
  Description of Artificial Sequence: Synthetic peptide
DEEEIRTTNPVATEQYGDVSECLQEHGEL

SEQ ID NO: 36742 - protein, 28 aa, Artificial Sequence
  Description of Artificial Sequence: Synthetic peptide
DEEEIRTTNPVATEQYGSVFEGDCHGNC

SEQ ID NO: 36743 - protein, 28 aa, Artificial Sequence
  Description of Artificial Sequence: Synthetic peptide
KEEEIRTTNPVAVEQYGWVSTELQGGDL

SEQ ID NO: 36744 - protein, 28 aa, Artificial Sequence
  Description of Artificial Sequence: Synthetic peptide
DEQEIRTTNPVATEQYGSVSTDDEIGEA

SEQ ID NO: 36745 - protein, 32 aa, Artificial Sequence
  Description of Artificial Sequence: Synthetic polypeptide
DEEEIRTTNPVATEQYGDVSCEMNLQCRGNDS

SEQ ID NO: 36746 - protein, 28 aa, Artificial Sequence
  Description of Artificial Sequence: Synthetic peptide
AEQEIVATNPVATEIYGVVGTNLQRGNR

SEQ ID NO: 36747 - protein, 28 aa, Artificial Sequence
  Description of Artificial Sequence: Synthetic peptide
TEEEINITNNVATEQYGTVSDNLQRGNL

SEQ ID NO: 36748 - protein, 28 aa, Artificial Sequence
  Description of Artificial Sequence: Synthetic peptide
DEETIRTTNIVATEQYGDVSTNLHAGGI

SEQ ID NO: 36749 - protein, 28 aa, Artificial Sequence
  Description of Artificial Sequence: Synthetic peptide
SEQEISTTNPVGTEQYGSVSTNLNLGND

SEQ ID NO: 36750 - protein, 29 aa, Artificial Sequence
  Description of Artificial Sequence: Synthetic peptide
QDEEIRATNPVATEFFGSVSTNEQRGDNR

SEQ ID NO: 36751 - protein, 32 aa, Artificial Sequence
  Description of Artificial Sequence: Synthetic polypeptide
DEEEIRTTNPVATEQYGSVSDTELEINGENDR

SEQ ID NO: 36752 - protein, 34 aa, Artificial Sequence
  Description of Artificial Sequence: Synthetic polypeptide
DEEEIRTTNPVATEQYGMSHVLHTNLNQIRGDNR

SEQ ID NO: 36753 - protein, 31 aa, Artificial Sequence
  Description of Artificial Sequence: Synthetic polypeptide
DEQEIRTTNPVATEQYGSVDSETNLEDRGEL

SEQ ID NO: 36754 - protein, 28 aa, Artificial Sequence
  Description of Artificial Sequence: Synthetic peptide
DENEIATTNPVASEQYGVVSTNLQIDNN

SEQ ID NO: 36755 - protein, 28 aa, Artificial Sequence
  Description of Artificial Sequence: Synthetic peptide
DEQEVRCTNPVATEIYGCVATNLERGNR

SEQ ID NO: 36756 - protein, 28 aa, Artificial Sequence
  Description of Artificial Sequence: Synthetic peptide
SEGEIAATNPVATEQFGSVSENLQVGNR

SEQ ID NO: 36757 - protein, 34 aa, Artificial Sequence
  Description of Artificial Sequence: Synthetic polypeptide
DEEEIRTTNPVATEQYGSVSETEGLQVREGENDR

SEQ ID NO: 36758 - protein, 28 aa, Artificial Sequence
  Description of Artificial Sequence: Synthetic peptide
AEEEIAQTNPVATEQYGDVSTGDERGNR

SEQ ID NO: 36759 - protein, 29 aa, Artificial Sequence
  Description of Artificial Sequence: Synthetic peptide
MENEIRATNPVATEQYGSVSTNLQYGEDT

SEQ ID NO: 36760 - protein, 30 aa, Artificial Sequence
  Description of Artificial Sequence: Synthetic polypeptide
MEEEIRTTNPVATEMYGSVSENLQDTEGNM

SEQ ID NO: 36761 - protein, 28 aa, Artificial Sequence
  Description of Artificial Sequence: Synthetic peptide
DESEIATTNPVATEGYGVVASNLQRGNI

SEQ ID NO: 36762 - protein, 28 aa, Artificial Sequence
  Description of Artificial Sequence: Synthetic peptide
DEEEIRTTNPEATEQYGSVSTEDDEGDF

SEQ ID NO: 36763 - protein, 28 aa, Artificial Sequence
  Description of Artificial Sequence: Synthetic peptide
DEQEIRTTNPDATEQYGSVSTDEQDGEF

SEQ ID NO: 36764 - protein, 28 aa, Artificial Sequence
  Description of Artificial Sequence: Synthetic peptide
DDQEIRTTNPVATEQYGSVGTNDMRGTA

SEQ ID NO: 36765 - protein, 30 aa, Artificial Sequence
  Description of Artificial Sequence: Synthetic polypeptide
DEEEIRTTNPVATEQYGDASTMDLQQDGNV

SEQ ID NO: 36766 - protein, 28 aa, Artificial Sequence
  Description of Artificial Sequence: Synthetic peptide
DEDEIQTTNQVATEQMGSVSTIKQRGNT

SEQ ID NO: 36767 - protein, 30 aa, Artificial Sequence
  Description of Artificial Sequence: Synthetic polypeptide
DEEEIATVNPVATEQYGEASTNLQSRAGGR

SEQ ID NO: 36768 - protein, 28 aa, Artificial Sequence
  Description of Artificial Sequence: Synthetic peptide
YEHEIATTNPVATEQYGSVSTDLEAGNV

SEQ ID NO: 36769 - protein, 31 aa, Artificial Sequence
  Description of Artificial Sequence: Synthetic polypeptide
DEEEIRTTNPVATEQYGSVSTPNPLFIDGEP

SEQ ID NO: 36770 - protein, 28 aa, Artificial Sequence
  Description of Artificial Sequence: Synthetic peptide
DEQEIATTNPVATEQYGSVSTELEPGEL

SEQ ID NO: 36771 - protein, 28 aa, Artificial Sequence
  Description of Artificial Sequence: Synthetic peptide
DEEEIRTTNPDATQQYGSVSTPDDDGND

SEQ ID NO: 36772 - protein, 29 aa, Artificial Sequence
  Description of Artificial Sequence: Synthetic peptide
DENEIRTTNPVATEQWGSVSENEQMQGNA

SEQ ID NO: 36773 - protein, 28 aa, Artificial Sequence
  Description of Artificial Sequence: Synthetic peptide
DEQEIATTNPTATEVYGSVGMNLQVGNR

SEQ ID NO: 36774 - protein, 30 aa, Artificial Sequence
  Description of Artificial Sequence: Synthetic polypeptide
DEQEITTTNPCATEQYGSVSCTNLCEQGNR

SEQ ID NO: 36775 - protein, 28 aa, Artificial Sequence
  Description of Artificial Sequence: Synthetic peptide
DEEEIRTTNIVATEMFGDVSEAVQRGNR

SEQ ID NO: 36776 - protein, 28 aa, Artificial Sequence
  Description of Artificial Sequence: Synthetic peptide
DEEEIRTTNPVATEQYGSVDEGPNEGDR

SEQ ID NO: 36777 - protein, 28 aa, Artificial Sequence
  Description of Artificial Sequence: Synthetic peptide
DEEEITATNNVATEQRDSVTTNLQRGNA

SEQ ID NO: 36778 - protein, 31 aa, Artificial Sequence
  Description of Artificial Sequence: Synthetic polypeptide
DENEIRTTNPVATEQYGSVSTDLQENEGNDM

SEQ ID NO: 36779 - protein, 31 aa, Artificial Sequence
  Description of Artificial Sequence: Synthetic polypeptide
DEGEIRTTNPVATFHYGSVSDTNLQRDGNDE

SEQ ID NO: 36780 - protein, 30 aa, Artificial Sequence
  Description of Artificial Sequence: Synthetic polypeptide
QEEEIRSTNPVATEQYGSVSTDLQLDNGND

SEQ ID NO: 36781 - protein, 29 aa, Artificial Sequence
  Description of Artificial Sequence: Synthetic peptide
DEEEIRTTNPVATELWGIVSENLQMVGNQ

SEQ ID NO: 36782 - protein, 29 aa, Artificial Sequence
  Description of Artificial Sequence: Synthetic peptide
DEEEIRTTNPVATEQWGSVSDNDMQGNDS

SEQ ID NO: 36783 - protein, 31 aa, Artificial Sequence
  Description of Artificial Sequence: Synthetic polypeptide
DEQEIRTTNPVATEQYGSTVDSITNDLRGNL

SEQ ID NO: 36784 - protein, 30 aa, Artificial Sequence
  Description of Artificial Sequence: Synthetic polypeptide
SEDEIRTTNPVATETYGEVSTNLQREGDDR

SEQ ID NO: 36785 - protein, 28 aa, Artificial Sequence
  Description of Artificial Sequence: Synthetic peptide
DEQEVRTVNPVATEVYGVVAMNLQRGNR

SEQ ID NO: 36786 - protein, 30 aa, Artificial Sequence
  Description of Artificial Sequence: Synthetic polypeptide
DEQEIRTTNPVASEIYGCVSANNLQREGNR

SEQ ID NO: 36787 - protein, 28 aa, Artificial Sequence
  Description of Artificial Sequence: Synthetic peptide
DEQEIRTTNPCATEQYGCVATNLERPND

SEQ ID NO: 36788 - protein, 31 aa, Artificial Sequence
  Description of Artificial Sequence: Synthetic polypeptide
DEEEIATTNPVATECYGSVSATDLQEHEGNR

SEQ ID NO: 36789 - protein, 28 aa, Artificial Sequence
  Description of Artificial Sequence: Synthetic peptide
DEEEIAQTNPVATEQYGEVSEVLQHGGR

SEQ ID NO: 36790 - protein, 28 aa, Artificial Sequence
  Description of Artificial Sequence: Synthetic peptide
DEEEIWTTNPDATEQYGVVATNIQPGND

SEQ ID NO: 36791 - protein, 28 aa, Artificial Sequence
  Description of Artificial Sequence: Synthetic peptide
DEEEIRTTNPVATEQYGTTATNLQNSTT

SEQ ID NO: 36792 - protein, 28 aa, Artificial Sequence
  Description of Artificial Sequence: Synthetic peptide
SEEEIRATNPVATEMFGSVSENLQIGNQ

SEQ ID NO: 36793 - protein, 30 aa, Artificial Sequence
  Description of Artificial Sequence: Synthetic polypeptide
DEEEIRTTNPVATEQYGSVDSENEQTKGEI

SEQ ID NO: 36794 - protein, 29 aa, Artificial Sequence
  Description of Artificial Sequence: Synthetic peptide
DEEEIRTTNPVATECWGSYSTNLMMQGNM

SEQ ID NO: 36795 - protein, 28 aa, Artificial Sequence
  Description of Artificial Sequence: Synthetic peptide
DENEIRTTNPVATECYGSVSTDLEHGEL

SEQ ID NO: 36796 - protein, 28 aa, Artificial Sequence
  Description of Artificial Sequence: Synthetic peptide
DEQEIRTTNPVATEQYGSVSTDDEVGEF

SEQ ID NO: 36797 - protein, 32 aa, Artificial Sequence
  Description of Artificial Sequence: Synthetic polypeptide
DEEEIRTTNPVATEQYGSVSTNLEDPDGENDH

SEQ ID NO: 36798 - protein, 28 aa, Artificial Sequence
  Description of Artificial Sequence: Synthetic peptide
DEEEIAQTNPVATEQYGSVSTPQEVGNI

SEQ ID NO: 36799 - protein, 28 aa, Artificial Sequence
  Description of Artificial Sequence: Synthetic peptide
MENEIATTNPVATEQYGSVSEDLQQGNT

SEQ ID NO: 36800 - protein, 28 aa, Artificial Sequence
  Description of Artificial Sequence: Synthetic peptide
NEQEIRTTNPVATEQYGSVDTDDQHGNA

SEQ ID NO: 36801 - protein, 32 aa, Artificial Sequence
  Description of Artificial Sequence: Synthetic polypeptide
DEEEIRTTNPVATEQYGSVSCEMDLQCRGNDM

SEQ ID NO: 36802 - protein, 34 aa, Artificial Sequence
  Description of Artificial Sequence: Synthetic polypeptide
DEEEIRTTNPVATEQYGSVDSITNPLPQDRDGER

SEQ ID NO: 36803 - protein, 28 aa, Artificial Sequence
  Description of Artificial Sequence: Synthetic peptide
DEEEIRTTNIFATEQYGSVETNDDIGER

SEQ ID NO: 36804 - protein, 31 aa, Artificial Sequence
  Description of Artificial Sequence: Synthetic polypeptide
DEEEIRTTNPVATECYGSVSTEDLQEPKGNI

SEQ ID NO: 36805 - protein, 30 aa, Artificial Sequence
  Description of Artificial Sequence: Synthetic polypeptide
DEAEIASTNPVATEQYGSVSEMNLQERGDR

SEQ ID NO: 36806 - protein, 28 aa, Artificial Sequence
  Description of Artificial Sequence: Synthetic peptide
YEEEIRTTNPVCTEQYGSVSTEEEVGNY

SEQ ID NO: 36807 - protein, 28 aa, Artificial Sequence
  Description of Artificial Sequence: Synthetic peptide
DENEIRTTNPDATEQYGVVSTEGERGNW

SEQ ID NO: 36808 - protein, 31 aa, Artificial Sequence
  Description of Artificial Sequence: Synthetic polypeptide
DEQEIRTTNPVATEQYGSVSDTNDERDGDNP

SEQ ID NO: 36809 - protein, 28 aa, Artificial Sequence
  Description of Artificial Sequence: Synthetic peptide
AENEIRTTNPVATEQYGNVSENLMRGEA

SEQ ID NO: 36810 - protein, 28 aa, Artificial Sequence
  Description of Artificial Sequence: Synthetic peptide
DESEIATTNPVATEGYGVVASTLQRGNI

SEQ ID NO: 36811 - protein, 28 aa, Artificial Sequence
  Description of Artificial Sequence: Synthetic peptide
VEEEIRTTNPVATEMYGWVSTDLQVGDH

SEQ ID NO: 36812 - protein, 28 aa, Artificial Sequence
  Description of Artificial Sequence: Synthetic peptide
SEEEIRTTNGVATEQYGTVATNLQDTTR

SEQ ID NO: 36813 - protein, 29 aa, Artificial Sequence
  Description of Artificial Sequence: Synthetic peptide
DENEIATTNPVATECYGSVSTDLQHNGNQ

SEQ ID NO: 36814 - protein, 28 aa, Artificial Sequence
  Description of Artificial Sequence: Synthetic peptide
QEQEIAQTNPVATEQYGEASENLQRGNR

SEQ ID NO: 36815 - protein, 29 aa, Artificial Sequence
  Description of Artificial Sequence: Synthetic peptide
DEEEICTTNPTATEQYGDVSTNEPQNENR

SEQ ID NO: 36816 - protein, 30 aa, Artificial Sequence
  Description of Artificial Sequence: Synthetic polypeptide
REEEIRTTNPVATEQYGCSSVDTNLQQGIP

SEQ ID NO: 36817 - protein, 31 aa, Artificial Sequence
  Description of Artificial Sequence: Synthetic polypeptide
DEEEIRTTNPVATECYGSVSATNLQHEGEDL

SEQ ID NO: 36818 - protein, 29 aa, Artificial Sequence
  Description of Artificial Sequence: Synthetic peptide
DEEEIRTTNPIAYEIYGAVGTNLERNGNR

SEQ ID NO: 36819 - protein, 28 aa, Artificial Sequence
  Description of Artificial Sequence: Synthetic peptide
QEEEIVTTNIVATEQYGEASTVLQRGGR

SEQ ID NO: 36820 - protein, 28 aa, Artificial Sequence
  Description of Artificial Sequence: Synthetic peptide
AEQEIATTNPVATEQYGDASENLQRGGR

SEQ ID NO: 36821 - protein, 28 aa, Artificial Sequence
  Description of Artificial Sequence: Synthetic peptide
DEEEIRTTNPVATEQWGSVSTAEEVGDY

SEQ ID NO: 36822 - protein, 28 aa, Artificial Sequence
  Description of Artificial Sequence: Synthetic peptide
DENEIASVNPVAYEMYGSVSTNLQRPNR

SEQ ID NO: 36823 - protein, 28 aa, Artificial Sequence
  Description of Artificial Sequence: Synthetic peptide
DEEEIRTTNPVATEQYGDVSECLQHEEL

SEQ ID NO: 36824 - protein, 28 aa, Artificial Sequence
  Description of Artificial Sequence: Synthetic peptide
DEQEIVTTNIVATENYGEASTVLQRGNR

SEQ ID NO: 36825 - protein, 32 aa, Artificial Sequence
  Description of Artificial Sequence: Synthetic polypeptide
DEEEIRTTNPVATEQYGSVSTEELQQAGENDT

SEQ ID NO: 36826 - protein, 28 aa, Artificial Sequence
  Description of Artificial Sequence: Synthetic peptide
DEEEIRTTNPFATEQYGSVWTGLWDGEN

SEQ ID NO: 36827 - protein, 30 aa, Artificial Sequence
  Description of Artificial Sequence: Synthetic polypeptide
DEEEIRTTNPVATEQYGSVSDNLQEHEEDM

SEQ ID NO: 36828 - protein, 29 aa, Artificial Sequence
  Description of Artificial Sequence: Synthetic peptide
DENEIRTTNPVATECWGIVSENLQNGGNR

SEQ ID NO: 36829 - protein, 28 aa, Artificial Sequence
  Description of Artificial Sequence: Synthetic peptide
DEEEIRTTNPYATEQYGSVHTPDIPGNP

SEQ ID NO: 36830 - protein, 30 aa, Artificial Sequence
  Description of Artificial Sequence: Synthetic polypeptide
DEQEIRCTNPVASEIYGCVSATNLQREGNR

SEQ ID NO: 36831 - protein, 28 aa, Artificial Sequence
  Description of Artificial Sequence: Synthetic peptide
DENEIATTNPVATECYGSVSTDLQVGEL

SEQ ID NO: 36832 - protein, 32 aa, Artificial Sequence
  Description of Artificial Sequence: Synthetic polypeptide
DEEEIRTTNPVATEQYGSVSTNLEDDEGENDL

SEQ ID NO: 36833 - protein, 28 aa, Artificial Sequence
  Description of Artificial Sequence: Synthetic peptide
DEEEIITTNIVATEQYLSTSGNLQRYNA

SEQ ID NO: 36834 - protein, 34 aa, Artificial Sequence
  Description of Artificial Sequence: Synthetic polypeptide
DEEEIRTTNPVATEQYGSVSITPGPLVQLRGDNR

SEQ ID NO: 36835 - protein, 28 aa, Artificial Sequence
  Description of Artificial Sequence: Synthetic peptide
DEQEIRTTNPVATEQYGSVSTDDEQGEF

SEQ ID NO: 36836 - protein, 28 aa, Artificial Sequence
  Description of Artificial Sequence: Synthetic peptide
SEVEIATTNPVATEQFGSVSENLQNGNA

SEQ ID NO: 36837 - protein, 28 aa, Artificial Sequence
  Description of Artificial Sequence: Synthetic peptide
DEEEIRTTNPVATEMYGFVGTNLMRLTQ

SEQ ID NO: 36838 - protein, 31 aa, Artificial Sequence
  Description of Artificial Sequence: Synthetic polypeptide
DEEEIATTNPVATEQYGSVSITLNPDRKGNS

SEQ ID NO: 36839 - protein, 32 aa, Artificial Sequence
  Description of Artificial Sequence: Synthetic polypeptide
DEEEIRTTNPVATEQYGSVSETNLEDDEGEND

SEQ ID NO: 36840 - protein, 28 aa, Artificial Sequence
  Description of Artificial Sequence: Synthetic peptide
SEDEILTTNPVATELYGSVSDNLQGGNV

SEQ ID NO: 36841 - protein, 29 aa, Artificial Sequence
  Description of Artificial Sequence: Synthetic peptide
AEQEIVTTNPVATECYGSVSATNEQRQNR

SEQ ID NO: 36842 - protein, 29 aa, Artificial Sequence
  Description of Artificial Sequence: Synthetic peptide
DEEEIRTTNPVATEQYGSVSDNLEISEDG

SEQ ID NO: 36843 - protein, 28 aa, Artificial Sequence
  Description of Artificial Sequence: Synthetic peptide
DEEEIQTTNIVATSQYGSVSTNLQSSTT

SEQ ID NO: 36844 - protein, 33 aa, Artificial Sequence
  Description of Artificial Sequence: Synthetic polypeptide
DEEEIRTTNPVAYEQYGQSVSQTNDLLQRGIRR

SEQ ID NO: 36845 - protein, 30 aa, Artificial Sequence
  Description of Artificial Sequence: Synthetic polypeptide
DEEEIATTNPTATEQYGSVSTMNEQQGDNF

SEQ ID NO: 36846 - protein, 29 aa, Artificial Sequence
  Description of Artificial Sequence: Synthetic peptide
DEEEIWTTNPVATEQYGVVSNCILQLGER

SEQ ID NO: 36847 - protein, 28 aa, Artificial Sequence
  Description of Artificial Sequence: Synthetic peptide
DENEIVQTNPVATEQYGSVSTDDQHGNL

SEQ ID NO: 36848 - protein, 28 aa, Artificial Sequence
  Description of Artificial Sequence: Synthetic peptide
QEEEITATNPVATEQYGSVSTDLQSGDD

SEQ ID NO: 36849 - protein, 28 aa, Artificial Sequence
  Description of Artificial Sequence: Synthetic peptide
DEEEIRTTNPHATEQYGSVHEPEMRGNP

SEQ ID NO: 36850 - protein, 31 aa, Artificial Sequence
  Description of Artificial Sequence: Synthetic polypeptide
DEEEIRTTNPVATEQYGSVSTNPQENKGEDF

SEQ ID NO: 36851 - protein, 32 aa, Artificial Sequence
  Description of Artificial Sequence: Synthetic polypeptide
DENEIRTTNPVATEIYGSVSTENLVQNNGDNR

SEQ ID NO: 36852 - protein, 30 aa, Artificial Sequence
  Description of Artificial Sequence: Synthetic polypeptide
NETEIRTTNPVATEQYGSVSTCPPQARGNS

SEQ ID NO: 36853 - protein, 31 aa, Artificial Sequence
  Description of Artificial Sequence: Synthetic polypeptide
DEEEIYTTNPVATEQYGSVCSEDNLEQTGNL

SEQ ID NO: 36854 - protein, 28 aa, Artificial Sequence
  Description of Artificial Sequence: Synthetic peptide
DEEEISQTNPVATEQYGSASTGENRGNN

SEQ ID NO: 36855 - protein, 31 aa, Artificial Sequence
  Description of Artificial Sequence: Synthetic polypeptide
DEEEIRTTNPVATEQYGSVSTDLQDDKGEDQ

SEQ ID NO: 36856 - protein, 28 aa, Artificial Sequence
  Description of Artificial Sequence: Synthetic peptide
DEEEIRTTNPDATQQYGSVSTPDDPGNG

SEQ ID NO: 36857 - protein, 28 aa, Artificial Sequence
  Description of Artificial Sequence: Synthetic peptide
DEEEIATTNPVAHEQYGIVSTNWQIGDF

SEQ ID NO: 36858 - protein, 28 aa, Artificial Sequence
  Description of Artificial Sequence: Synthetic peptide
DEEEIYTTNPVATESYGSVSVNWQHGDS

SEQ ID NO: 36859 - protein, 34 aa, Artificial Sequence
  Description of Artificial Sequence: Synthetic polypeptide
DEEEIRTTNPVATEQYGSVDSETNLPLPREGLNR

SEQ ID NO: 36860 - protein, 32 aa, Artificial Sequence
  Description of Artificial Sequence: Synthetic polypeptide
DEEEIRTTNPVATEQYGSVSETNLEERGEEDS

SEQ ID NO: 36861 - protein, 34 aa, Artificial Sequence
  Description of Artificial Sequence: Synthetic polypeptide
DEEEIRTTNPVATEQYGSVSTTDNLVEEREGDNR

SEQ ID NO: 36862 - protein, 30 aa, Artificial Sequence
  Description of Artificial Sequence: Synthetic polypeptide
DEEEIRTTNPVATEFYGSVSTMDIQHFGNQ

SEQ ID NO: 36863 - protein, 32 aa, Artificial Sequence
  Description of Artificial Sequence: Synthetic polypeptide
DEEEIRTTNPVATEQYGSVSETNLEERDGEDF

SEQ ID NO: 36864 - protein, 28 aa, Artificial Sequence
  Description of Artificial Sequence: Synthetic peptide
MENEIRATNPVATEMYGWVSDNLQRGER

SEQ ID NO: 36865 - protein, 33 aa, Artificial Sequence
  Description of Artificial Sequence: Synthetic polypeptide
DEEEIRTTNPVATEQYGSVSITPNPLFIRGDER

SEQ ID NO: 36866 - protein, 28 aa, Artificial Sequence
  Description of Artificial Sequence: Synthetic peptide
SEEEIRTTNPAATEQYGSVSENEQHGTQ

SEQ ID NO: 36867 - protein, 33 aa, Artificial Sequence
  Description of Artificial Sequence: Synthetic polypeptide
DEEEIRTTNPVATEQYGSVDSDTNLEDPDGENR

SEQ ID NO: 36868 - protein, 31 aa, Artificial Sequence
  Description of Artificial Sequence: Synthetic polypeptide
DEEEIRTTNPFATEQYGSVSIELNPQDRGNS

SEQ ID NO: 36869 - protein, 28 aa, Artificial Sequence
  Description of Artificial Sequence: Synthetic peptide
DELAIATTNIVAFEQYGSTSTNLQRGNT

SEQ ID NO: 36870 - protein, 29 aa, Artificial Sequence
  Description of Artificial Sequence: Synthetic peptide
DEEEIRTTNPVSSEIYGCVSASNLERGNR

SEQ ID NO: 36871 - protein, 28 aa, Artificial Sequence
  Description of Artificial Sequence: Synthetic peptide
DENEIRCTNPVCTEPYGSVATNLQYGND

SEQ ID NO: 36872 - protein, 28 aa, Artificial Sequence
  Description of Artificial Sequence: Synthetic peptide
DEEEIRTTNPVATEQYGSVDTADLTGEA

SEQ ID NO: 36873 - protein, 31 aa, Artificial Sequence
  Description of Artificial Sequence: Synthetic polypeptide
DEEEIRTTNPVAYWQYGSVDCTNLALMRGNR

SEQ ID NO: 36874 - protein, 28 aa, Artificial Sequence
  Description of Artificial Sequence: Synthetic peptide
DEDIIRSTNFVATEQSGSVYTNEQRGNR

SEQ ID NO: 36875 - protein, 31 aa, Artificial Sequence
  Description of Artificial Sequence: Synthetic polypeptide
DEEEIRTTNPVATECYGSVSETNLEDNGENW

SEQ ID NO: 36876 - protein, 30 aa, Artificial Sequence
  Description of Artificial Sequence: Synthetic polypeptide
DEVEITTTNPVATEQYGSVSTGNPEIRGNF

SEQ ID NO: 36877 - protein, 30 aa, Artificial Sequence
  Description of Artificial Sequence: Synthetic polypeptide
DEEEIRTTNPVATEQYGSVSTDLEDLEGDQ

SEQ ID NO: 36878 - protein, 28 aa, Artificial Sequence
  Description of Artificial Sequence: Synthetic peptide
DEEEIRTTNPVATEPYGTTATNLQNSNT

SEQ ID NO: 36879 - protein, 32 aa, Artificial Sequence
  Description of Artificial Sequence: Synthetic polypeptide
DEEEIRTTNPVATEQYGSVSTGNEQDNEGDNE

SEQ ID NO: 36880 - protein, 31 aa, Artificial Sequence
  Description of Artificial Sequence: Synthetic polypeptide
GEEEIATTNPVATEQYGSVSTDLQEREGNDF

SEQ ID NO: 36881 - protein, 29 aa, Artificial Sequence
  Description of Artificial Sequence: Synthetic peptide
DEQEIRTTNPVATECWGSVSTNEQMRGTF

SEQ ID NO: 36882 - protein, 28 aa, Artificial Sequence
  Description of Artificial Sequence: Synthetic peptide
DEQEIATTNPVATECYGSVSTDLQYGED

SEQ ID NO: 36883 - protein, 31 aa, Artificial Sequence
  Description of Artificial Sequence: Synthetic polypeptide
DEEEIATTNPVATEQYGDVSCTMDLQCHGNR

SEQ ID NO: 36884 - protein, 28 aa, Artificial Sequence
  Description of Artificial Sequence: Synthetic peptide
DEEEIRTTNPIATEQYGTTGTELQRENI

SEQ ID NO: 36885 - protein, 28 aa, Artificial Sequence
  Description of Artificial Sequence: Synthetic peptide
DEQEIRTTNPVATELWGSVSENEMRGNP

SEQ ID NO: 36886 - protein, 32 aa, Artificial Sequence
  Description of Artificial Sequence: Synthetic polypeptide
DEEEIRTTNPVATEQYGSVESDTPNLDPGENP

SEQ ID NO: 36887 - protein, 29 aa, Artificial Sequence
  Description of Artificial Sequence: Synthetic peptide
DEEEIATTNPVATEQYGWVSTELQFEGDH

SEQ ID NO: 36888 - protein, 28 aa, Artificial Sequence
  Description of Artificial Sequence: Synthetic peptide
DEEEIRTTNPVATECYGVVSTELENGES

SEQ ID NO: 36889 - protein, 28 aa, Artificial Sequence
  Description of Artificial Sequence: Synthetic peptide
DENEIATTNPVATECYGSVSTELQHGEL

SEQ ID NO: 36890 - protein, 28 aa, Artificial Sequence
  Description of Artificial Sequence: Synthetic peptide
DEDEIRTTNPVATEQYGGCSDTLQHGNT

SEQ ID NO: 36891 - protein, 28 aa, Artificial Sequence
  Description of Artificial Sequence: Synthetic peptide
DEEEITTTNPVATEVYGAVSTNEEVGNT

SEQ ID NO: 36892 - protein, 28 aa, Artificial Sequence
  Description of Artificial Sequence: Synthetic peptide
QEQEIRATNPVATEQYGSASTVLQHGMR

SEQ ID NO: 36893 - protein, 28 aa, Artificial Sequence
  Description of Artificial Sequence: Synthetic peptide
DEVEIGTTNPTATETFGSVSTALQRGGR

SEQ ID NO: 36894 - protein, 28 aa, Artificial Sequence
  Description of Artificial Sequence: Synthetic peptide
DDQEIATTNPVATEIYGVVSSNLERGNR

SEQ ID NO: 36895 - protein, 28 aa, Artificial Sequence
  Description of Artificial Sequence: Synthetic peptide
DEVEIRTTNPCATELYGWVSTNEQTGNF

SEQ ID NO: 36896 - protein, 28 aa, Artificial Sequence
  Description of Artificial Sequence: Synthetic peptide
DEEEITATNPVGTEQYGSVSENLAVGNH

SEQ ID NO: 36897 - protein, 29 aa, Artificial Sequence
  Description of Artificial Sequence: Synthetic peptide
AEEEIRTTNPVATEQYGIVSAENLQWMQR

SEQ ID NO: 36898 - protein, 30 aa, Artificial Sequence
  Description of Artificial Sequence: Synthetic polypeptide
DEQEIRTTNPVATEQYGMVSTQLQTAGGMR

SEQ ID NO: 36899 - protein, 33 aa, Artificial Sequence
  Description of Artificial Sequence: Synthetic polypeptide
DEEEIRTTNPVATEQYGSVSTPNPLQEDDGDER

SEQ ID NO: 36900 - protein, 30 aa, Artificial Sequence
  Description of Artificial Sequence: Synthetic polypeptide
DEEEIRTTNPVATEQYGSVSEMDLQQQGDM

SEQ ID NO: 36901 - protein, 28 aa, Artificial Sequence
  Description of Artificial Sequence: Synthetic peptide
DESEIATTNPTATELYGSVSEDLQRGND

SEQ ID NO: 36902 - protein, 30 aa, Artificial Sequence
  Description of Artificial Sequence: Synthetic polypeptide
DEIEICTTNPVATEQYGTVASVTNLQGGNI

SEQ ID NO: 36903 - protein, 31 aa, Artificial Sequence
  Description of Artificial Sequence: Synthetic polypeptide
DEEEIRTTNPVATEQWGSVDTNLMLRNGNDM

SEQ ID NO: 36904 - protein, 28 aa, Artificial Sequence
  Description of Artificial Sequence: Synthetic peptide
DEEEIRTTNPVATEQYWSVETPLDPGEP

SEQ ID NO: 36905 - protein, 34 aa, Artificial Sequence
  Description of Artificial Sequence: Synthetic polypeptide
DEEEIRTTNPVATEQYGSVSTTDNGLVQREGEND

SEQ ID NO: 36906 - protein, 28 aa, Artificial Sequence
  Description of Artificial Sequence: Synthetic peptide
DENEIRTTNPVATEWYGIVSEEEQRGNF

SEQ ID NO: 36907 - protein, 28 aa, Artificial Sequence
  Description of Artificial Sequence: Synthetic peptide
DEEEIRTTNPIATFQYGCVSSDLERGNP

SEQ ID NO: 36908 - protein, 28 aa, Artificial Sequence
  Description of Artificial Sequence: Synthetic peptide
DEDEVRAVNPVAYEPYGSVGTNLQRGNR

SEQ ID NO: 36909 - protein, 31 aa, Artificial Sequence
  Description of Artificial Sequence: Synthetic polypeptide
DEEEIRTTNPDATEQYGWVSTTNLQDDGIND

SEQ ID NO: 36910 - protein, 30 aa, Artificial Sequence
  Description of Artificial Sequence: Synthetic polypeptide
DEQEIRCTNPVASEVYGAVSATNLQREGNR

SEQ ID NO: 36911 - protein, 33 aa, Artificial Sequence
  Description of Artificial Sequence: Synthetic polypeptide
DEEEIRTTNPVATEQYGSVSETNLEETDGDNDR

SEQ ID NO: 36912 - protein, 31 aa, Artificial Sequence
  Description of Artificial Sequence: Synthetic polypeptide
DEQEIRTTNPVATEQYGSVDSTPLEETGNDR

SEQ ID NO: 36913 - protein, 29 aa, Artificial Sequence
  Description of Artificial Sequence: Synthetic peptide
AETEIRTTNPVATEQYGCVSEMNLQRLIR

SEQ ID NO: 36914 - protein, 28 aa, Artificial Sequence
  Description of Artificial Sequence: Synthetic peptide
DEEEIRTTNIVATEQYGSVETDLDLGEW

SEQ ID NO: 36915 - protein, 28 aa, Artificial Sequence
  Description of Artificial Sequence: Synthetic peptide
YEEEIRTTNPVATDQYGSVSTEDTIGNV

SEQ ID NO: 36916 - protein, 31 aa, Artificial Sequence
  Description of Artificial Sequence: Synthetic polypeptide
DEEEIRTTNPVATECYGSVSTNLQDHEGEDD

SEQ ID NO: 36917 - protein, 33 aa, Artificial Sequence
  Description of Artificial Sequence: Synthetic polypeptide
DEEEIRTTNPVATEQYGSVCSTEDLQRKGEEDR

SEQ ID NO: 36918 - protein, 28 aa, Artificial Sequence
  Description of Artificial Sequence: Synthetic peptide
DEEEIRTTNPVATEQWGSVDTNDETGTM

SEQ ID NO: 36919 - protein, 28 aa, Artificial Sequence
  Description of Artificial Sequence: Synthetic peptide
DEEEIRATNPECTELYGSVSTNLQSGDV

SEQ ID NO: 36920 - protein, 28 aa, Artificial Sequence
  Description of Artificial Sequence: Synthetic peptide
SENEISTTNPVATEVYGSVSENEQRGNS

SEQ ID NO: 36921 - protein, 28 aa, Artificial Sequence
  Description of Artificial Sequence: Synthetic peptide
DEEEVATTNPIAYEMYGSVSTALQRGPR

SEQ ID NO: 36922 - protein, 32 aa, Artificial Sequence
  Description of Artificial Sequence: Synthetic polypeptide
DEEEIRTTNPVATEQYGSVETLNPLQEGDEPR

SEQ ID NO: 36923 - protein, 28 aa, Artificial Sequence
  Description of Artificial Sequence: Synthetic peptide
DEEEIRTTNPVATEQYGSVSTCEEADEV

SEQ ID NO: 36924 - protein, 30 aa, Artificial Sequence
  Description of Artificial Sequence: Synthetic polypeptide
DEQEIRTTNPVASEIYGAVSATNLEREGNR

SEQ ID NO: 36925 - protein, 33 aa, Artificial Sequence
  Description of Artificial Sequence: Synthetic polypeptide
DEEEIRTTNPVATEQYGSVSDTTGLQLDNGENR

SEQ ID NO: 36926 - protein, 28 aa, Artificial Sequence
  Description of Artificial Sequence: Synthetic peptide
DEEEIATTNPVATEQYGDVSENLMHGQN

SEQ ID NO: 36927 - protein, 28 aa, Artificial Sequence
  Description of Artificial Sequence: Synthetic peptide
MENEIRTTNPVATECYGSVSEDLQAGNV

SEQ ID NO: 36928 - protein, 29 aa, Artificial Sequence
  Description of Artificial Sequence: Synthetic peptide
MENEIRTTNPVATECYGSVSTNLQDSGDM

SEQ ID NO: 36929 - protein, 28 aa, Artificial Sequence
  Description of Artificial Sequence: Synthetic peptide
DEEEIRTTNPVATEQYGVTATNLQNSST

SEQ ID NO: 36930 - protein, 28 aa, Artificial Sequence
  Description of Artificial Sequence: Synthetic peptide
DEEEIRTTNPVGTEQYGSVAEDLQIGEM

SEQ ID NO: 36931 - protein, 28 aa, Artificial Sequence
  Description of Artificial Sequence: Synthetic peptide
DEQEIRTTNPTATEIYGSVSTAPQRGEI

SEQ ID NO: 36932 - protein, 28 aa, Artificial Sequence
  Description of Artificial Sequence: Synthetic peptide
DEDEIRQTNPVATEQYGSVSTTCQREEM

SEQ ID NO: 36933 - protein, 28 aa, Artificial Sequence
  Description of Artificial Sequence: Synthetic peptide
DEEEVACTNPVASEQYGSVAMNLQRGNQ

SEQ ID NO: 36934 - protein, 30 aa, Artificial Sequence
  Description of Artificial Sequence: Synthetic polypeptide
DEEEIRTTNPSATEQYGSVSCTECYQVGER

SEQ ID NO: 36935 - protein, 28 aa, Artificial Sequence
  Description of Artificial Sequence: Synthetic peptide
DEHEIVSTNPVATEVYGSVSTELQVGNS

SEQ ID NO: 36936 - protein, 28 aa, Artificial Sequence
  Description of Artificial Sequence: Synthetic peptide
DEQEIRTTNPVATEQYGSVSTDDEHGEN

SEQ ID NO: 36937 - protein, 31 aa, Artificial Sequence
  Description of Artificial Sequence: Synthetic polypeptide
DEEIIYTTNPVATEQYGSVSITNLQILGENP

SEQ ID NO: 36938 - protein, 32 aa, Artificial Sequence
  Description of Artificial Sequence: Synthetic polypeptide
DEEEIRTTNPVATEQYGMSVHQTNLIIRGDNP

SEQ ID NO: 36939 - protein, 29 aa, Artificial Sequence
  Description of Artificial Sequence: Synthetic peptide
MENEIRTTNPVATEQYGSVATNLQEVGEL

SEQ ID NO: 36940 - protein, 28 aa, Artificial Sequence
  Description of Artificial Sequence: Synthetic peptide
DEEEIRTTNPVSSENYGTVSMNLQRGTQ

SEQ ID NO: 36941 - protein, 28 aa, Artificial Sequence
  Description of Artificial Sequence: Synthetic peptide
DEEEIRTTNPFATEQYGSVSTCDITGES

SEQ ID NO: 36942 - protein, 31 aa, Artificial Sequence
  Description of Artificial Sequence: Synthetic polypeptide
DEEEIRTTNPVATEQYGSVSCEMDLQVGNDS

SEQ ID NO: 36943 - protein, 31 aa, Artificial Sequence
  Description of Artificial Sequence: Synthetic polypeptide
DEEEIRTTNPVATEQYGSVSTELQDYEGEDD

SEQ ID NO: 36944 - protein, 28 aa, Artificial Sequence
  Description of Artificial Sequence: Synthetic peptide
DEEEINLTSIVAELNYGSVSTNLQRGNR

SEQ ID NO: 36945 - protein, 29 aa, Artificial Sequence
  Description of Artificial Sequence: Synthetic peptide
YDAWEIRTTNYVATEQYGWVSQNLPRGNR

SEQ ID NO: 36946 - protein, 31 aa, Artificial Sequence
  Description of Artificial Sequence: Synthetic polypeptide
DEEEIRTTNPVATEQYGSVSEMNPQENGDNV

SEQ ID NO: 36947 - protein, 28 aa, Artificial Sequence
  Description of Artificial Sequence: Synthetic peptide
DEEEIRTTNPVATEQYGNVSTPDEEGTL

SEQ ID NO: 36948 - protein, 32 aa, Artificial Sequence
  Description of Artificial Sequence: Synthetic polypeptide
DEEEIRTTNPVATEQYGSVSTCNPQEAKGNDT

SEQ ID NO: 36949 - protein, 28 aa, Artificial Sequence
  Description of Artificial Sequence: Synthetic peptide
MEEEIRTTNPVATEQYGSASEDLQYGDD

SEQ ID NO: 36950 - protein, 33 aa, Artificial Sequence
  Description of Artificial Sequence: Synthetic polypeptide
DEEEIRTTNPVATEQYGSVYSTENGLQQNGVND

SEQ ID NO: 36951 - protein, 30 aa, Artificial Sequence
  Description of Artificial Sequence: Synthetic polypeptide
DENEIRTTNPVATEQYGSVSCENLCWVGNL

SEQ ID NO: 36952 - protein, 29 aa, Artificial Sequence
  Description of Artificial Sequence: Synthetic peptide
DEEEIRTTNPVATEQYGEVSEVLQHAEER

SEQ ID NO: 36953 - protein, 28 aa, Artificial Sequence
  Description of Artificial Sequence: Synthetic peptide
DEEEIRTTNPVSTEQYGSYSENEMQGNQ

SEQ ID NO: 36954 - protein, 28 aa, Artificial Sequence
  Description of Artificial Sequence: Synthetic peptide
DEEEIRTTNPTATEQYGSVETGPYQGNG

SEQ ID NO: 36955 - protein, 28 aa, Artificial Sequence
  Description of Artificial Sequence: Synthetic peptide
DEENIRDTNIGTTEQYGSVSTNALRGNR

SEQ ID NO: 36956 - protein, 28 aa, Artificial Sequence
  Description of Artificial Sequence: Synthetic peptide
DENEIATTNPVATEQYGSVSTDLEVGEL

SEQ ID NO: 36957 - protein, 28 aa, Artificial Sequence
  Description of Artificial Sequence: Synthetic peptide
CEEEIRTTNPVATEVYGEVSTNLQTEQM

SEQ ID NO: 36958 - protein, 33 aa, Artificial Sequence
  Description of Artificial Sequence: Synthetic polypeptide
DEEEIRTTNPVATEQYGSVTSLTAPGLLRGTNR

SEQ ID NO: 36959 - protein, 28 aa, Artificial Sequence
  Description of Artificial Sequence: Synthetic peptide
DDEEIRCTNPVATEIYGCVAMNLQPGNR

SEQ ID NO: 36960 - protein, 31 aa, Artificial Sequence
  Description of Artificial Sequence: Synthetic polypeptide
DEEEIRTTNPVATEQYGSVSTDLQDIKGEDN

SEQ ID NO: 36961 - protein, 28 aa, Artificial Sequence
  Description of Artificial Sequence: Synthetic peptide
DEQEITATNIVATEVYGSASTNLQRGGR

SEQ ID NO: 36962 - protein, 28 aa, Artificial Sequence
  Description of Artificial Sequence: Synthetic peptide
DEEEIRTVNIVATEQYGCVATNLQNSNT

SEQ ID NO: 36963 - protein, 32 aa, Artificial Sequence
  Description of Artificial Sequence: Synthetic polypeptide
DEEEIRTTNPVATEQYGSVSTEELEPQEGENG

SEQ ID NO: 36964 - protein, 28 aa, Artificial Sequence
  Description of Artificial Sequence: Synthetic peptide
DEEVISTTNIVATEQGGSTSTNLQRNTR

SEQ ID NO: 36965 - protein, 28 aa, Artificial Sequence
  Description of Artificial Sequence: Synthetic peptide
DEEEIRCTNPVATEQYGTVDENLDVGNQ

SEQ ID NO: 36966 - protein, 34 aa, Artificial Sequence
  Description of Artificial Sequence: Synthetic polypeptide
DEEEIRTTNPVATEQYGSVYSTLNLQDREGDNTG

SEQ ID NO: 36967 - protein, 30 aa, Artificial Sequence
  Description of Artificial Sequence: Synthetic polypeptide
DEEEIATTNPVATEQYGSVSTDLQEQGEDN

SEQ ID NO: 36968 - protein, 28 aa, Artificial Sequence
  Description of Artificial Sequence: Synthetic peptide
NEHEIRTTNPVGTEQYGSVSSNDQHGNS

SEQ ID NO: 36969 - protein, 28 aa, Artificial Sequence
  Description of Artificial Sequence: Synthetic peptide
DEQEVAATNPVATEIYGVVATNLQRGNR

SEQ ID NO: 36970 - protein, 30 aa, Artificial Sequence
  Description of Artificial Sequence: Synthetic polypeptide
DEEEIRATNPVATECYGSVSEANLQRGDTV

SEQ ID NO: 36971 - protein, 28 aa, Artificial Sequence
  Description of Artificial Sequence: Synthetic peptide
DTEEIRTTNPYATEQYGSVHTGEIRGNP

SEQ ID NO: 36972 - protein, 28 aa, Artificial Sequence
  Description of Artificial Sequence: Synthetic peptide
DEAEIVTTNPVATEQYGSVSMEEQVGNY

SEQ ID NO: 36973 - protein, 28 aa, Artificial Sequence
  Description of Artificial Sequence: Synthetic peptide
DEEELATTNPVATECYGSTSTNLQHGEN

SEQ ID NO: 36974 - protein, 28 aa, Artificial Sequence
  Description of Artificial Sequence: Synthetic peptide
SEEEIRTTNPVATEQYGTTATNLQSSNT

SEQ ID NO: 36975 - protein, 28 aa, Artificial Sequence
  Description of Artificial Sequence: Synthetic peptide
DEEELRTTNIVATEQYGSVSDLEQHGNF

SEQ ID NO: 36976 - protein, 31 aa, Artificial Sequence
  Description of Artificial Sequence: Synthetic polypeptide
DEEEIRTTNPVATECYGSVSATNLQHEGEDD

SEQ ID NO: 36977 - protein, 32 aa, Artificial Sequence
  Description of Artificial Sequence: Synthetic polypeptide
DEEEIRTTNPVATEQYWSVSTPNPLQRDGDEP

SEQ ID NO: 36978 - protein, 32 aa, Artificial Sequence
  Description of Artificial Sequence: Synthetic polypeptide
DEEEIRQTNPVATEQYGSVDETGGLQRNGENR

SEQ ID NO: 36979 - protein, 28 aa, Artificial Sequence
  Description of Artificial Sequence: Synthetic peptide
DEVEIAATNPVATENFGWVSSNLQRGNR

SEQ ID NO: 36980 - protein, 30 aa, Artificial Sequence
  Description of Artificial Sequence: Synthetic polypeptide
DDEEIRTTNPVATEQYGSVSTELEEYEGNS

SEQ ID NO: 36981 - protein, 33 aa, Artificial Sequence
  Description of Artificial Sequence: Synthetic polypeptide
DEEEIRTTNPVATEQYGSVISTENGEPQRGINQ

SEQ ID NO: 36982 - protein, 30 aa, Artificial Sequence
  Description of Artificial Sequence: Synthetic polypeptide
DEEEIVTTNPVATECYGWVSTNLQRKGDEV

SEQ ID NO: 36983 - protein, 29 aa, Artificial Sequence
  Description of Artificial Sequence: Synthetic peptide
DEVEICTTNPVATEQYGDVSTVLQSRGML

SEQ ID NO: 36984 - protein, 29 aa, Artificial Sequence
  Description of Artificial Sequence: Synthetic peptide
QEQEISATNPVATEQYGEVSAENLQRGNR

SEQ ID NO: 36985 - protein, 30 aa, Artificial Sequence
  Description of Artificial Sequence: Synthetic polypeptide
DEEEITTTNPVATEQYGSVSTELEPKGEAR

SEQ ID NO: 36986 - protein, 35 aa, Artificial Sequence
  Description of Artificial Sequence: Synthetic polypeptide
DEEEIRTTNPVATEQYGSVSSLTMNGLVQREGENR

SEQ ID NO: 36987 - protein, 29 aa, Artificial Sequence
  Description of Artificial Sequence: Synthetic peptide
QEGEITTTNPVATECYGSVSTGNLQQGNP

SEQ ID NO: 36988 - protein, 30 aa, Artificial Sequence
  Description of Artificial Sequence: Synthetic polypeptide
DEEEIRTTNPVATECWGSVSTNDMLGGNDR

SEQ ID NO: 36989 - protein, 29 aa, Artificial Sequence
  Description of Artificial Sequence: Synthetic peptide
DEVEIRTTNPVATELYGVCSENLQEQGNR

SEQ ID NO: 36990 - protein, 28 aa, Artificial Sequence
  Description of Artificial Sequence: Synthetic peptide
DEEEIRTTNPVATEPYGTTATNLQSSNT

SEQ ID NO: 36991 - protein, 32 aa, Artificial Sequence
  Description of Artificial Sequence: Synthetic polypeptide
DEEEIRTTNPVATEQYGSVSSTGNPGQDMGNF

SEQ ID NO: 36992 - protein, 32 aa, Artificial Sequence
  Description of Artificial Sequence: Synthetic polypeptide
DEEEIRTTNPVATEQYGSVSTTNLEDEGENDL

SEQ ID NO: 36993 - protein, 30 aa, Artificial Sequence
  Description of Artificial Sequence: Synthetic polypeptide
DEEEIRTTNPVATEQYGDVSCTMELCVGNV

SEQ ID NO: 36994 - protein, 34 aa, Artificial Sequence
  Description of Artificial Sequence: Synthetic polypeptide
DEEEIRTTNPVATEQYGSVISTLNLPQLREGVNQ

SEQ ID NO: 36995 - protein, 28 aa, Artificial Sequence
  Description of Artificial Sequence: Synthetic peptide
DESEIRATNPVATENFGVVSNNLQHGNR

SEQ ID NO: 36996 - protein, 28 aa, Artificial Sequence
  Description of Artificial Sequence: Synthetic peptide
DEEEICTTNPEATETYGDVSVNLQTGNE

SEQ ID NO: 36997 - protein, 32 aa, Artificial Sequence
  Description of Artificial Sequence: Synthetic polypeptide
DEEEIRTTNPVATEQYGSVSATDGLVEREGND

SEQ ID NO: 36998 - protein, 32 aa, Artificial Sequence
  Description of Artificial Sequence: Synthetic polypeptide
DEEEIRTTNPVATEQYGSVDCTCNLEERGENS

SEQ ID NO: 36999 - protein, 28 aa, Artificial Sequence
  Description of Artificial Sequence: Synthetic peptide
DEEEIRTTNPVATEQYGDVSENEMQGDM

SEQ ID NO: 37000 - protein, 28 aa, Artificial Sequence
  Description of Artificial Sequence: Synthetic peptide
SEEEIQTTNIVATEQYGAVATNLQRSNT

SEQ ID NO: 37001 - protein, 32 aa, Artificial Sequence
  Description of Artificial Sequence: Synthetic polypeptide
DEEEIRTTNPVATEQYGSVFITMNLEPVGNDR

SEQ ID NO: 37002 - protein, 29 aa, Artificial Sequence
  Description of Artificial Sequence: Synthetic peptide
DSNEIRTTNPCATEQYGNVSENLQRNGNH

SEQ ID NO: 37003 - protein, 28 aa, Artificial Sequence
  Description of Artificial Sequence: Synthetic peptide
DEEEITTTNPEATEHYGSVSTELQLGDF

SEQ ID NO: 37004 - protein, 28 aa, Artificial Sequence
  Description of Artificial Sequence: Synthetic peptide
DEEEITTTNITATEQYGSVAENLQQGDR

SEQ ID NO: 37005 - protein, 33 aa, Artificial Sequence
  Description of Artificial Sequence: Synthetic polypeptide
DEEEIRTTNPVATEQYGSVSETCPLVLDRGTNR

SEQ ID NO: 37006 - protein, 34 aa, Artificial Sequence
  Description of Artificial Sequence: Synthetic polypeptide
DEEEIRTTNPVATEQYGSVSDTMNLVQIPDGNPR

SEQ ID NO: 37007 - protein, 30 aa, Artificial Sequence
  Description of Artificial Sequence: Synthetic polypeptide
DEEEIRTTNPVATEQYGSVDTMDDQGGNDV

SEQ ID NO: 37008 - protein, 28 aa, Artificial Sequence
  Description of Artificial Sequence: Synthetic peptide
DEEEVNTTNSVNTEQYGSVSTIELRGNR

SEQ ID NO: 37009 - protein, 28 aa, Artificial Sequence
  Description of Artificial Sequence: Synthetic peptide
DEEEIRTTNPFATEQYGSVDTGELAGNE

SEQ ID NO: 37010 - protein, 28 aa, Artificial Sequence
  Description of Artificial Sequence: Synthetic peptide
DEQEIRTTNPVATEQYGSVSTDEDLGEP

SEQ ID NO: 37011 - protein, 32 aa, Artificial Sequence
  Description of Artificial Sequence: Synthetic polypeptide
DENEIRTTNPVATEQYGSVSTTNLVQVNGEND

SEQ ID NO: 37012 - protein, 31 aa, Artificial Sequence
  Description of Artificial Sequence: Synthetic polypeptide
DEEEIRTTNPVATEQYGWVSTNLQEIEGEDC

SEQ ID NO: 37013 - protein, 32 aa, Artificial Sequence
  Description of Artificial Sequence: Synthetic polypeptide
DEEEIATTNPVATECYGSVSTNLQETNGENDR

SEQ ID NO: 37014 - protein, 28 aa, Artificial Sequence
  Description of Artificial Sequence: Synthetic peptide
DEEEITATNPVATECFGSVSTNLQQGTS

SEQ ID NO: 37015 - protein, 28 aa, Artificial Sequence
  Description of Artificial Sequence: Synthetic peptide
DENEIRSTNPVASEQYGVVSTDLQQGNL

SEQ ID NO: 37016 - protein, 28 aa, Artificial Sequence
  Description of Artificial Sequence: Synthetic peptide
DEFEINTTNPVATEQYGDVSDFIQRGNV

SEQ ID NO: 37017 - protein, 28 aa, Artificial Sequence
  Description of Artificial Sequence: Synthetic peptide
DEEEIRTTNPVATEQYGSWDTGPQEGDM

SEQ ID NO: 37018 - protein, 28 aa, Artificial Sequence
  Description of Artificial Sequence: Synthetic peptide
DENEIMTTNPTATEQYGSVSTNVQSGDF

SEQ ID NO: 37019 - protein, 29 aa, Artificial Sequence
  Description of Artificial Sequence: Synthetic peptide
AEEEIRTVNPVATEGYGWCSTNLQRAGGR

SEQ ID NO: 37020 - protein, 32 aa, Artificial Sequence
  Description of Artificial Sequence: Synthetic polypeptide
DEEEIRTTNPVATEQYGSVYSTNGEQLQGVNQ

SEQ ID NO: 37021 - protein, 29 aa, Artificial Sequence
  Description of Artificial Sequence: Synthetic peptide
DEEEIATTNPCATEQYGCVSATNVQRGQF

SEQ ID NO: 37022 - protein, 34 aa, Artificial Sequence
  Description of Artificial Sequence: Synthetic polypeptide
DEEEIRTTNPVATEQYGSVSSITGPLNQRGDNPR

SEQ ID NO: 37023 - protein, 28 aa, Artificial Sequence
  Description of Artificial Sequence: Synthetic peptide
NEEEIRTTNPVCTEIYGSVSTADQMGND

SEQ ID NO: 37024 - protein, 32 aa, Artificial Sequence
  Description of Artificial Sequence: Synthetic polypeptide
DEEEIRTTNPVATEQYGSVSTMNPQLIEGDNF

SEQ ID NO: 37025 - protein, 30 aa, Artificial Sequence
  Description of Artificial Sequence: Synthetic polypeptide
DEEEIRTTNPVATEQYGDVSCENLCHGNDS

SEQ ID NO: 37026 - protein, 28 aa, Artificial Sequence
  Description of Artificial Sequence: Synthetic peptide
DEEEIRTTNPVATEQYGSVSEDDDTGEM

SEQ ID NO: 37027 - protein, 30 aa, Artificial Sequence
  Description of Artificial Sequence: Synthetic polypeptide
DEEEIAATNPVATEQYGSVSENLQDQGDDR

SEQ ID NO: 37028 - protein, 28 aa, Artificial Sequence
  Description of Artificial Sequence: Synthetic peptide
DEVEIRTTNPTATEQFGEVSTNLQNGTA

SEQ ID NO: 37029 - protein, 30 aa, Artificial Sequence
  Description of Artificial Sequence: Synthetic polypeptide
DEEEIRCTNPVATEIYGCVAATNLEREGNR

SEQ ID NO: 37030 - protein, 31 aa, Artificial Sequence
  Description of Artificial Sequence: Synthetic polypeptide
DEEEVRTTNPVATEQYGSVSDLALQSKGENR

SEQ ID NO: 37031 - protein, 28 aa, Artificial Sequence
  Description of Artificial Sequence: Synthetic peptide
AENEIATTNPVATEQYGEASENLQRGGR

SEQ ID NO: 37032 - protein, 28 aa, Artificial Sequence
  Description of Artificial Sequence: Synthetic peptide
DEEEIETTNIVAANYYGDVSTNLQDGNR

SEQ ID NO: 37033 - protein, 29 aa, Artificial Sequence
  Description of Artificial Sequence: Synthetic peptide
DEEEIRTTNPVATEQYGSVSEDPVQLGDS

SEQ ID NO: 37034 - protein, 28 aa, Artificial Sequence
  Description of Artificial Sequence: Synthetic peptide
DEEEIRATNIVSTEHYGAVATNLQRGGR

SEQ ID NO: 37035 - protein, 29 aa, Artificial Sequence
  Description of Artificial Sequence: Synthetic peptide
DEEEVRTTNPCATEQYGSVSTINLDRLMG

SEQ ID NO: 37036 - protein, 28 aa, Artificial Sequence
  Description of Artificial Sequence: Synthetic peptide
SEDEIRTTNPAATEMYGEVSENWQRGNR

SEQ ID NO: 37037 - protein, 28 aa, Artificial Sequence
  Description of Artificial Sequence: Synthetic peptide
DEVEIATTNPVATEMYGEVSTNEQQGNF

SEQ ID NO: 37038 - protein, 30 aa, Artificial Sequence
  Description of Artificial Sequence: Synthetic polypeptide
DEEEIRTTNPVATEQYGSMSTDLDREGDDD

SEQ ID NO: 37039 - protein, 28 aa, Artificial Sequence
  Description of Artificial Sequence: Synthetic peptide
SEEEIAATNPVATEQFGSVSENLQQGNF

SEQ ID NO: 37040 - protein, 28 aa, Artificial Sequence
  Description of Artificial Sequence: Synthetic peptide
DEQEIVSTNPVSTEQYGSVSNNLQLGNQ

SEQ ID NO: 37041 - protein, 28 aa, Artificial Sequence
  Description of Artificial Sequence: Synthetic peptide
DEQEIATVNPVATEQYGSMSTNLQNGEM

SEQ ID NO: 37042 - protein, 28 aa, Artificial Sequence
  Description of Artificial Sequence: Synthetic peptide
DEEEIRTTNEVATEQYLSVSDKLRGSNG

SEQ ID NO: 37043 - protein, 29 aa, Artificial Sequence
  Description of Artificial Sequence: Synthetic peptide
SEEEIRATNPTATEQYGSVSENEQQEGNR

SEQ ID NO: 37044 - protein, 31 aa, Artificial Sequence
  Description of Artificial Sequence: Synthetic polypeptide
DEEEIATTNPVATEQYGSVSEDLQESEGNDR

SEQ ID NO: 37045 - protein, 28 aa, Artificial Sequence
  Description of Artificial Sequence: Synthetic peptide
DENEIRTTNPVSTECYGSVSENLQLGTS

SEQ ID NO: 37046 - protein, 31 aa, Artificial Sequence
  Description of Artificial Sequence: Synthetic polypeptide
DEEEIRATNPVATEQYGSTSVTMNLQLQGNN

SEQ ID NO: 37047 - protein, 28 aa, Artificial Sequence
  Description of Artificial Sequence: Synthetic peptide
DEENISTTNIVCTEQYGRVANNLQRGNR

SEQ ID NO: 37048 - protein, 32 aa, Artificial Sequence
  Description of Artificial Sequence: Synthetic polypeptide
DEEEIRTTNPVATEQYGSVSTINPLQVADGEW

SEQ ID NO: 37049 - protein, 28 aa, Artificial Sequence
  Description of Artificial Sequence: Synthetic peptide
DEVEIATTNPVATEQYGSIPTNEQHFNR

SEQ ID NO: 37050 - protein, 28 aa, Artificial Sequence
  Description of Artificial Sequence: Synthetic peptide
DEEEIRPTNPVATEIYGSVSTEPQDGDN

SEQ ID NO: 37051 - protein, 28 aa, Artificial Sequence
  Description of Artificial Sequence: Synthetic peptide
GEEEIASTNPVATEMYGEVSCNLQRGGR

SEQ ID NO: 37052 - protein, 33 aa, Artificial Sequence
  Description of Artificial Sequence: Synthetic polypeptide
DEEEIRTTNPVATEQYGSVSITTNLEEVEGDNR

SEQ ID NO: 37053 - protein, 28 aa, Artificial Sequence
  Description of Artificial Sequence: Synthetic peptide
DEEEIAQTNPVATEQYGSVSTDQEDGNA

SEQ ID NO: 37054 - protein, 28 aa, Artificial Sequence
  Description of Artificial Sequence: Synthetic peptide
DDEEIRSTNIVATENYGGVHTNKQRGNR

SEQ ID NO: 37055 - protein, 28 aa, Artificial Sequence
  Description of Artificial Sequence: Synthetic peptide
DEEEIRCTNPVATEHYGAVSDNEQVGNA

SEQ ID NO: 37056 - protein, 29 aa, Artificial Sequence
  Description of Artificial Sequence: Synthetic peptide
DEIEIATVNPVATEQFGSVSTPQQRGENR

SEQ ID NO: 37057 - protein, 33 aa, Artificial Sequence
  Description of Artificial Sequence: Synthetic polypeptide
DEEEIRTTNPVATEQYGSVETNPLVQERGDEPR

SEQ ID NO: 37058 - protein, 28 aa, Artificial Sequence
  Description of Artificial Sequence: Synthetic peptide
DEEEIRTTNNTATEQYGSHSNYLQRLNT

SEQ ID NO: 37059 - protein, 28 aa, Artificial Sequence
  Description of Artificial Sequence: Synthetic peptide
DEEECSTTNIIATEQYGSVSTNLQNKDR

SEQ ID NO: 37060 - protein, 28 aa, Artificial Sequence
  Description of Artificial Sequence: Synthetic peptide
DEEEIATTNPVASECYGSVSTELEQGNI

SEQ ID NO: 37061 - protein, 31 aa, Artificial Sequence
  Description of Artificial Sequence: Synthetic polypeptide
DEEEIRTTNPVATEQYGSVSCEMDLQHGNDA

SEQ ID NO: 37062 - protein, 30 aa, Artificial Sequence
  Description of Artificial Sequence: Synthetic polypeptide
DEEEIRTTNPVATEQYGSVSTDPQEIGEDL

SEQ ID NO: 37063 - protein, 29 aa, Artificial Sequence
  Description of Artificial Sequence: Synthetic peptide
DDQEIRTTNPIAYEHYGVVSATNLQRGNR

SEQ ID NO: 37064 - protein, 28 aa, Artificial Sequence
  Description of Artificial Sequence: Synthetic peptide
DEAEINTTNPVATECYGEVSTNLQRPPH

SEQ ID NO: 37065 - protein, 28 aa, Artificial Sequence
  Description of Artificial Sequence: Synthetic peptide
DEQEIRTTNPVATEQWGSVDTNEMQGNW

SEQ ID NO: 37066 - protein, 33 aa, Artificial Sequence
  Description of Artificial Sequence: Synthetic polypeptide
DEEEIRTTNPVATEQYGSVSDTPNPLQPEGDNP

SEQ ID NO: 37067 - protein, 28 aa, Artificial Sequence
  Description of Artificial Sequence: Synthetic peptide
SDEEIATTNPVATEMYGSVSTNLMVGNS

SEQ ID NO: 37068 - protein, 28 aa, Artificial Sequence
  Description of Artificial Sequence: Synthetic peptide
QEVEIRATNPVATECYGSVSTDLQSGNL

SEQ ID NO: 37069 - protein, 28 aa, Artificial Sequence
  Description of Artificial Sequence: Synthetic peptide
DENEIRTVNPVATEQYGSMATDLQLGNM

SEQ ID NO: 37070 - protein, 32 aa, Artificial Sequence
  Description of Artificial Sequence: Synthetic polypeptide
DEEEIRTTNPTATEQYGSVISTMNEQERGDNG

SEQ ID NO: 37071 - protein, 30 aa, Artificial Sequence
  Description of Artificial Sequence: Synthetic polypeptide
DEEEIRATNPVATEQYGSVAENLQERGDDW

SEQ ID NO: 37072 - protein, 29 aa, Artificial Sequence
  Description of Artificial Sequence: Synthetic peptide
DENEIRTTNPVATEQWGSYSTNEMRGNDA

SEQ ID NO: 37073 - protein, 33 aa, Artificial Sequence
  Description of Artificial Sequence: Synthetic polypeptide
DEEEIRTTNPVATEQYGSVSDTLADQRKGEEPR

SEQ ID NO: 37074 - protein, 30 aa, Artificial Sequence
  Description of Artificial Sequence: Synthetic polypeptide
DEEEIRPTNPDATEQYGEVSMTGDPQTGNR

SEQ ID NO: 37075 - protein, 28 aa, Artificial Sequence
  Description of Artificial Sequence: Synthetic peptide
DEQEIASTNPVATECYGSVSTNLQEEEL

SEQ ID NO: 37076 - protein, 28 aa, Artificial Sequence
  Description of Artificial Sequence: Synthetic peptide
DEQEIRTTNPVATEQYGSVETDDEGGEN

SEQ ID NO: 37077 - protein, 31 aa, Artificial Sequence
  Description of Artificial Sequence: Synthetic polypeptide
DEQEIATTNPVATEQYGDVSCTMDLQCHGNR

SEQ ID NO: 37078 - protein, 35 aa, Artificial Sequence
  Description of Artificial Sequence: Synthetic polypeptide
DEEEIRTTNPVATEQYGSVISTMNGLPQLREGDNG

SEQ ID NO: 37079 - protein, 28 aa, Artificial Sequence
  Description of Artificial Sequence: Synthetic peptide
FEEEIRAVNPVATEPWGSVSENVQRGNT

SEQ ID NO: 37080 - protein, 31 aa, Artificial Sequence
  Description of Artificial Sequence: Synthetic polypeptide
DEEEIAQTNPVATEQYGSVSTGLEDRGDNDI

SEQ ID NO: 37081 - protein, 30 aa, Artificial Sequence
  Description of Artificial Sequence: Synthetic polypeptide
DEEEIRTTNPVATEQYGSVSDINEQNEEPS

SEQ ID NO: 37082 - protein, 31 aa, Artificial Sequence
  Description of Artificial Sequence: Synthetic polypeptide
DEEEIATTNPVATEQYGSVSATDLQINGEDL

SEQ ID NO: 37083 - protein, 31 aa, Artificial Sequence
  Description of Artificial Sequence: Synthetic polypeptide
QENEIRTTNPVATECYGSVSDTDLERNGENR

SEQ ID NO: 37084 - protein, 31 aa, Artificial Sequence
  Description of Artificial Sequence: Synthetic polypeptide
DEQEIATTNPVATEQYGSVSATDLQDREGEL

SEQ ID NO: 37085 - protein, 28 aa, Artificial Sequence
  Description of Artificial Sequence: Synthetic peptide
DEEEVATTNPVATEVYGGVATNLQRTTT

SEQ ID NO: 37086 - protein, 28 aa, Artificial Sequence
  Description of Artificial Sequence: Synthetic peptide
DEQEIRTTNPEATEQYGSVSTDLEMEEG

SEQ ID NO: 37087 - protein, 28 aa, Artificial Sequence
  Description of Artificial Sequence: Synthetic peptide
DEEEINSTNIVATEQWGSVSTNLGGINN

SEQ ID NO: 37088 - protein, 31 aa, Artificial Sequence
  Description of Artificial Sequence: Synthetic polypeptide
DEEEIRTTNPVATEQYGSVSTCDQDCNGFEF

SEQ ID NO: 37089 - protein, 28 aa, Artificial Sequence
  Description of Artificial Sequence: Synthetic peptide
GEHEIRTTNPVATEQYGVIGTDLQEGNW

SEQ ID NO: 37090 - protein, 28 aa, Artificial Sequence
  Description of Artificial Sequence: Synthetic peptide
TEQEIATTNPVATEQYGMTSTNLLHGND

SEQ ID NO: 37091 - protein, 32 aa, Artificial Sequence
  Description of Artificial Sequence: Synthetic polypeptide
DEEEIRTTNPVATEQYGSVSETNLEEVEGEDF

SEQ ID NO: 37092 - protein, 32 aa, Artificial Sequence
  Description of Artificial Sequence: Synthetic polypeptide
DEQEIATTNPVATEQYGSVSATNLEREGENDI

SEQ ID NO: 37093 - protein, 28 aa, Artificial Sequence
  Description of Artificial Sequence: Synthetic peptide
DESEIATTNPTATELYGSVSEDLQQGND

SEQ ID NO: 37094 - protein, 33 aa, Artificial Sequence
  Description of Artificial Sequence: Synthetic polypeptide
DEEEIRTTNPTATEQYGSVSTANLQLIEGENDI

SEQ ID NO: 37095 - protein, 29 aa, Artificial Sequence
  Description of Artificial Sequence: Synthetic peptide
DEVEICTTNPVSTEQYGDVSTVLQSRGML

SEQ ID NO: 37096 - protein, 28 aa, Artificial Sequence
  Description of Artificial Sequence: Synthetic peptide
DEVEIRTTNPTATECFGEVSTNLQNGTA

SEQ ID NO: 37097 - protein, 33 aa, Artificial Sequence
  Description of Artificial Sequence: Synthetic polypeptide
DEEEIRTTNPVATEQYGSVDCTMNGLCCRGDND

SEQ ID NO: 37098 - protein, 28 aa, Artificial Sequence
  Description of Artificial Sequence: Synthetic peptide
NEEEIKTTNPVATEQYGTTATNLQSSNT

SEQ ID NO: 37099 - protein, 28 aa, Artificial Sequence
  Description of Artificial Sequence: Synthetic peptide
DEEEIRTTNPYATEQYGFVSNDLGPGTL

SEQ ID NO: 37100 - protein, 28 aa, Artificial Sequence
  Description of Artificial Sequence: Synthetic peptide
VEEEIRATNPVCTEQWGSVSDNLQYGQV

SEQ ID NO: 37101 - protein, 28 aa, Artificial Sequence
  Description of Artificial Sequence: Synthetic peptide
SEEEIRATNPVATEMFGSVSENLQIGTQ

SEQ ID NO: 37102 - protein, 30 aa, Artificial Sequence
  Description of Artificial Sequence: Synthetic polypeptide
DEEEIRTTNPVATEQYGDVSENEMNRAGDA

SEQ ID NO: 37103 - protein, 30 aa, Artificial Sequence
  Description of Artificial Sequence: Synthetic polypeptide
DEVEIATTNPAATEIYGSVSTCNLQNGPNE

SEQ ID NO: 37104 - protein, 28 aa, Artificial Sequence
  Description of Artificial Sequence: Synthetic peptide
GEEEIRSTNPVATEQYGVVSTALEQGEH

SEQ ID NO: 37105 - protein, 34 aa, Artificial Sequence
  Description of Artificial Sequence: Synthetic polypeptide
DEEEIRTTNPVATEQYGSVDEETDNLEDREGENR

SEQ ID NO: 37106 - protein, 28 aa, Artificial Sequence
  Description of Artificial Sequence: Synthetic peptide
DEEEIKTTNIVATESYGSVANNLQMFNT

SEQ ID NO: 37107 - protein, 31 aa, Artificial Sequence
  Description of Artificial Sequence: Synthetic polypeptide
DEEEIRTTNPVATEQYGSVSEMDLQQEQGDM

SEQ ID NO: 37108 - protein, 31 aa, Artificial Sequence
  Description of Artificial Sequence: Synthetic polypeptide
DEEEIRTTNPVATEQYGSVSTDPQEIKGEDL

SEQ ID NO: 37109 - protein, 28 aa, Artificial Sequence
  Description of Artificial Sequence: Synthetic peptide
DEEEIRTTNPFATEQYGSVWTGDWDGEN

SEQ ID NO: 37110 - protein, 33 aa, Artificial Sequence
  Description of Artificial Sequence: Synthetic polypeptide
DEEEIRTTNPTATEQYGSVISTMNEQERGDNDG

SEQ ID NO: 37111 - protein, 28 aa, Artificial Sequence
  Description of Artificial Sequence: Synthetic peptide
AEEEIATTNSVATEQYGSVSTNNQSSDA

SEQ ID NO: 37112 - protein, 32 aa, Artificial Sequence
  Description of Artificial Sequence: Synthetic polypeptide
DEEEIRTTNPVATEQYGSVSTNLEDHEGEEDF

SEQ ID NO: 37113 - protein, 28 aa, Artificial Sequence
  Description of Artificial Sequence: Synthetic peptide
HELEIATTNPVATECYGSASTNIQTGMR

SEQ ID NO: 37114 - protein, 32 aa, Artificial Sequence
  Description of Artificial Sequence: Synthetic polypeptide
DEEEIRTTNPVATEQYGSVSTIEPLQEFDGEY

SEQ ID NO: 37115 - protein, 28 aa, Artificial Sequence
  Description of Artificial Sequence: Synthetic peptide
DEEEIRTTNPVDTERYGTTATNLQSSNT

SEQ ID NO: 37116 - protein, 28 aa, Artificial Sequence
  Description of Artificial Sequence: Synthetic peptide
DEEEIATTNIVAWEQYGKVATNHQNSNR

SEQ ID NO: 37117 - protein, 28 aa, Artificial Sequence
  Description of Artificial Sequence: Synthetic peptide
DEEEIRATNIVATEEYGVVATNLQNGTT

SEQ ID NO: 37118 - protein, 35 aa, Artificial Sequence
  Description of Artificial Sequence: Synthetic polypeptide
DEEEIRTTNPVATEQYGSVSSLTMNGLVQREGENQ

SEQ ID NO: 37119 - protein, 29 aa, Artificial Sequence
  Description of Artificial Sequence: Synthetic peptide
MENEIRTTNPVATECYGSVSTNEQDHGEQ

SEQ ID NO: 37120 - protein, 31 aa, Artificial Sequence
  Description of Artificial Sequence: Synthetic polypeptide
DEEEIATTNPVATECYGSVSATNLQHEGEDL

SEQ ID NO: 37121 - protein, 30 aa, Artificial Sequence
  Description of Artificial Sequence: Synthetic polypeptide
DEGEIRTTNPVATECYGWVSTELQVNGNDT

SEQ ID NO: 37122 - protein, 33 aa, Artificial Sequence
  Description of Artificial Sequence: Synthetic polypeptide
DEEEIRTTNPVATEQYGSVISATENLQINGTHG

SEQ ID NO: 37123 - protein, 33 aa, Artificial Sequence
  Description of Artificial Sequence: Synthetic polypeptide
DEEEIRTTNPVATEQYGSVSETNLEERDGDEDF

SEQ ID NO: 37124 - protein, 31 aa, Artificial Sequence
  Description of Artificial Sequence: Synthetic polypeptide
DEEEIRTTNPVATEQYGSVSTNPDQVTEEDV

SEQ ID NO: 37125 - protein, 32 aa, Artificial Sequence
  Description of Artificial Sequence: Synthetic polypeptide
DEVEIRTTNPVATEQYGSVSTMNEQIEGDNDE

SEQ ID NO: 37126 - protein, 32 aa, Artificial Sequence
  Description of Artificial Sequence: Synthetic polypeptide
DEEEIRTTNPVATEQYGDVSCEMNLQCGGNDS

SEQ ID NO: 37127 - protein, 34 aa, Artificial Sequence
  Description of Artificial Sequence: Synthetic polypeptide
DEEEIRTTNPVATEQYGSVISTLNLPQLFEGVNQ

SEQ ID NO: 37128 - protein, 32 aa, Artificial Sequence
  Description of Artificial Sequence: Synthetic polypeptide
DEEEIRTTNPVATEQYGDVSCEMNLQCTGNDV

SEQ ID NO: 37129 - protein, 28 aa, Artificial Sequence
  Description of Artificial Sequence: Synthetic peptide
DEEEIATTNPVATEQYGGVADNLQNQTT

SEQ ID NO: 37130 - protein, 30 aa, Artificial Sequence
  Description of Artificial Sequence: Synthetic polypeptide
DEEEIRTTNPVSTEQYGTVSMENIQQNGNH

SEQ ID NO: 37131 - protein, 31 aa, Artificial Sequence
  Description of Artificial Sequence: Synthetic polypeptide
DNEEIRSTNPVATEQYGSVNTNGEQREGDPR

SEQ ID NO: 37132 - protein, 28 aa, Artificial Sequence
  Description of Artificial Sequence: Synthetic peptide
DEEEIRTTNPVATRPYGTTATNLQSSNT

SEQ ID NO: 37133 - protein, 32 aa, Artificial Sequence
  Description of Artificial Sequence: Synthetic polypeptide
DEEEIRTTNPDATEQYGWVASTTNLQDDGIND

SEQ ID NO: 37134 - protein, 28 aa, Artificial Sequence
  Description of Artificial Sequence: Synthetic peptide
DEEEIRTTNPVATEQYGSVSEDDEHEEN

SEQ ID NO: 37135 - protein, 28 aa, Artificial Sequence
  Description of Artificial Sequence: Synthetic peptide
DEEEIRTTNPVATEQYGVTADNLQNSST

SEQ ID NO: 37136 - protein, 32 aa, Artificial Sequence
  Description of Artificial Sequence: Synthetic polypeptide
DEEEIRTTNPTATEQYGSVSTANEQEFGDNTG

SEQ ID NO: 37137 - protein, 32 aa, Artificial Sequence
  Description of Artificial Sequence: Synthetic polypeptide
DEEEIRTTNPVATEQYGEVISTMNLPQIGDTA

SEQ ID NO: 37138 - protein, 28 aa, Artificial Sequence
  Description of Artificial Sequence: Synthetic peptide
YEHEIATTNPVATEQYGAVSTDLEAGNV

SEQ ID NO: 37139 - protein, 30 aa, Artificial Sequence
  Description of Artificial Sequence: Synthetic polypeptide
DENEIVTTNPVATECYGSVSTELQVTGENQ

SEQ ID NO: 37140 - protein, 32 aa, Artificial Sequence
  Description of Artificial Sequence: Synthetic polypeptide
DEEEIRTTNPVATEQYGSVSTTDNGLEYEENE

SEQ ID NO: 37141 - protein, 28 aa, Artificial Sequence
  Description of Artificial Sequence: Synthetic peptide
DEEEIRTTNPVATEQWGIVDTNDETGTM

SEQ ID NO: 37142 - protein, 28 aa, Artificial Sequence
  Description of Artificial Sequence: Synthetic peptide
DENEIAQTNPVATEQYGSVSTDQEVGND

SEQ ID NO: 37143 - protein, 34 aa, Artificial Sequence
  Description of Artificial Sequence: Synthetic polypeptide
DEEEIRTTNPVATEQYGSVDSDTNLEDIEGENER

SEQ ID NO: 37144 - protein, 30 aa, Artificial Sequence
  Description of Artificial Sequence: Synthetic polypeptide
DEEEIRTTNPVATECWGSVSTNDMLGGNDI

SEQ ID NO: 37145 - protein, 28 aa, Artificial Sequence
  Description of Artificial Sequence: Synthetic peptide
DENEIASVNPVAYEMYGSVSTNLQRPNF

SEQ ID NO: 37146 - protein, 28 aa, Artificial Sequence
  Description of Artificial Sequence: Synthetic peptide
DEEEINTTNPVATDNYGSVSDPLGGGNG

SEQ ID NO: 37147 - protein, 31 aa, Artificial Sequence
  Description of Artificial Sequence: Synthetic polypeptide
DEEEIRTTNPVATEQYGSVSDNLQEHDEEDM

SEQ ID NO: 37148 - protein, 31 aa, Artificial Sequence
  Description of Artificial Sequence: Synthetic polypeptide
GEEEIATTNPVATEQYGSVSTDLQENEGNDF

SEQ ID NO: 37149 - protein, 33 aa, Artificial Sequence
  Description of Artificial Sequence: Synthetic polypeptide
DEEEIRTTNPVATEQYGSVCSDTGNLQDQGDEY

SEQ ID NO: 37150 - protein, 29 aa, Artificial Sequence
  Description of Artificial Sequence: Synthetic peptide
DENEIKTTNPVATEQYGSVSENEQNLGTF

SEQ ID NO: 37151 - protein, 28 aa, Artificial Sequence
  Description of Artificial Sequence: Synthetic peptide
SEGEIAATNPVATEQFGSVSENLQVGNA

SEQ ID NO: 37152 - protein, 31 aa, Artificial Sequence
  Description of Artificial Sequence: Synthetic polypeptide
DEEEIRTTNPVATEQYGSVSTCDQQCNGFEF

SEQ ID NO: 37153 - protein, 28 aa, Artificial Sequence
  Description of Artificial Sequence: Synthetic peptide
DEGEIVATNPVATEVYGDVSTNIQRGPF

SEQ ID NO: 37154 - protein, 31 aa, Artificial Sequence
  Description of Artificial Sequence: Synthetic polypeptide
DEQEIRTTNPVATEQYGSVSCEMNLCQGNDY

SEQ ID NO: 37155 - protein, 28 aa, Artificial Sequence
  Description of Artificial Sequence: Synthetic peptide
DEEEICTTNPFATEQYGIVPTEQQYGNL

SEQ ID NO: 37156 - protein, 31 aa, Artificial Sequence
  Description of Artificial Sequence: Synthetic polypeptide
QEEEIRTTNPVATECYGSVSANDLEERNGER

SEQ ID NO: 37157 - protein, 28 aa, Artificial Sequence
  Description of Artificial Sequence: Synthetic peptide
DENEIAQTNPVATEQYGSVSTDDEVGNL

SEQ ID NO: 37158 - protein, 33 aa, Artificial Sequence
  Description of Artificial Sequence: Synthetic polypeptide
DEEEIRTTNPVATEQYGSVSETVGNDTDERGER

SEQ ID NO: 37159 - protein, 28 aa, Artificial Sequence
  Description of Artificial Sequence: Synthetic peptide
QEEEIAATNPVATEQYGSVSTALQQETY

SEQ ID NO: 37160 - protein, 33 aa, Artificial Sequence
  Description of Artificial Sequence: Synthetic polypeptide
DEEEIRTTNPVATEQYGHSVHQTNPLLIRGENP

SEQ ID NO: 37161 - protein, 34 aa, Artificial Sequence
  Description of Artificial Sequence: Synthetic polypeptide
DEEEIRTTNPVATEQYGSVDSDTNLPEEEKGENR

SEQ ID NO: 37162 - protein, 32 aa, Artificial Sequence
  Description of Artificial Sequence: Synthetic polypeptide
DEEEIRTTNPVATEQYGSVSTGNDEVYNGENS

SEQ ID NO: 37163 - protein, 33 aa, Artificial Sequence
  Description of Artificial Sequence: Synthetic polypeptide
DEEEIRTTNPVATEQYGSVSVENEGGQRDGINH

SEQ ID NO: 37164 - protein, 28 aa, Artificial Sequence
  Description of Artificial Sequence: Synthetic peptide
QEEEICCTNPEATEQYGSVSTNDQLGPH

SEQ ID NO: 37165 - protein, 28 aa, Artificial Sequence
  Description of Artificial Sequence: Synthetic peptide
DEQEVAATNPVSTEIYGVVATNLQRGNR

SEQ ID NO: 37166 - protein, 30 aa, Artificial Sequence
  Description of Artificial Sequence: Synthetic polypeptide
DEEEIRTTNPVATEQYGDVSCEADQCLGNE

SEQ ID NO: 37167 - protein, 28 aa, Artificial Sequence
  Description of Artificial Sequence: Synthetic peptide
DEVEIATTNPVGTEQYGSIPTNEQHFNR

SEQ ID NO: 37168 - protein, 28 aa, Artificial Sequence
  Description of Artificial Sequence: Synthetic peptide
TENEIRTTNPVGTEQYGNVSENLMRGDA

SEQ ID NO: 37169 - protein, 28 aa, Artificial Sequence
  Description of Artificial Sequence: Synthetic peptide
SEEEIRATNPTATEMFGSVSTNPQNGNF

SEQ ID NO: 37170 - protein, 28 aa, Artificial Sequence
  Description of Artificial Sequence: Synthetic peptide
DEEEIRTTNPVATECYGDVSECLQHEEL

SEQ ID NO: 37171 - protein, 28 aa, Artificial Sequence
  Description of Artificial Sequence: Synthetic peptide
DEEEVRTTNPCATEQFGCTSANLEIGNR

SEQ ID NO: 37172 - protein, 28 aa, Artificial Sequence
  Description of Artificial Sequence: Synthetic peptide
YEEEITTTNPVATEQYGEAPTVLQRPNH

SEQ ID NO: 37173 - protein, 30 aa, Artificial Sequence
  Description of Artificial Sequence: Synthetic polypeptide
YEHELRTTNPVATEQYGSVSTMNLQTNGTQ

SEQ ID NO: 37174 - protein, 31 aa, Artificial Sequence
  Description of Artificial Sequence: Synthetic polypeptide
DEEEIRTTNPEATEQYGSVSTENLVEDEGDF

SEQ ID NO: 37175 - protein, 28 aa, Artificial Sequence
  Description of Artificial Sequence: Synthetic peptide
AEEEIRTTNPDSTENYGEVSTNLQLGDA

SEQ ID NO: 37176 - protein, 30 aa, Artificial Sequence
  Description of Artificial Sequence: Synthetic polypeptide
DEEEIRTTNPVATEQYGSVSDNLEISKEDG

SEQ ID NO: 37177 - protein, 33 aa, Artificial Sequence
  Description of Artificial Sequence: Synthetic polypeptide
DEEEIRTTNPVATEQYGSVYSTEDGLQQNGVND

SEQ ID NO: 37178 - protein, 28 aa, Artificial Sequence
  Description of Artificial Sequence: Synthetic peptide
DENEIACTNPVATEQYGVVSTELQIGEY

SEQ ID NO: 37179 - protein, 28 aa, Artificial Sequence
  Description of Artificial Sequence: Synthetic peptide
YEEEIRTTNPCATEPYGTVSTAEQWGNE

SEQ ID NO: 37180 - protein, 28 aa, Artificial Sequence
  Description of Artificial Sequence: Synthetic peptide
DEEEIATVNPVCTETYGSVVTNFQSGNQ

SEQ ID NO: 37181 - protein, 29 aa, Artificial Sequence
  Description of Artificial Sequence: Synthetic peptide
DDEEIRTTNPIAYEIYGAVGTNLERNGNR

SEQ ID NO: 37182 - protein, 30 aa, Artificial Sequence
  Description of Artificial Sequence: Synthetic polypeptide
DEEEIWTTNPVATEQYGVVCSNCILQLGER

SEQ ID NO: 37183 - protein, 30 aa, Artificial Sequence
  Description of Artificial Sequence: Synthetic polypeptide
DEAEIRTTNPVCTEQYGSACTNLEDNGNDR

SEQ ID NO: 37184 - protein, 28 aa, Artificial Sequence
  Description of Artificial Sequence: Synthetic peptide
GEEEIRTTNPVATEQYGWVATDDDPGNI

SEQ ID NO: 37185 - protein, 32 aa, Artificial Sequence
  Description of Artificial Sequence: Synthetic polypeptide
DEEEIRTTNPVATEQYGSVSATDLELVNGNDD

SEQ ID NO: 37186 - protein, 28 aa, Artificial Sequence
  Description of Artificial Sequence: Synthetic peptide
DEEEIATTNPVATEQYGDVSENLMHFQN

SEQ ID NO: 37187 - protein, 28 aa, Artificial Sequence
  Description of Artificial Sequence: Synthetic peptide
DEVEIATTNPTATEQYGGVSENEQQGNF

SEQ ID NO: 37188 - protein, 32 aa, Artificial Sequence
  Description of Artificial Sequence: Synthetic polypeptide
DEEEIRTTNPVATEQYGSVDCTMALQHAGNDD

SEQ ID NO: 37189 - protein, 28 aa, Artificial Sequence
  Description of Artificial Sequence: Synthetic peptide
QEVEIRATNPVATECYGSVSMDLQSGNL

SEQ ID NO: 37190 - protein, 30 aa, Artificial Sequence
  Description of Artificial Sequence: Synthetic polypeptide
DSNEIRTTNPCATEQYGNVSSENLQRNGNH

SEQ ID NO: 37191 - protein, 28 aa, Artificial Sequence
  Description of Artificial Sequence: Synthetic peptide
DEQEIATVNPVSTEVYGSVSENLQHGGR

SEQ ID NO: 37192 - protein, 28 aa, Artificial Sequence
  Description of Artificial Sequence: Synthetic peptide
DEEELATTNPVATECYGSTSTDLQHGEN

SEQ ID NO: 37193 - protein, 32 aa, Artificial Sequence
  Description of Artificial Sequence: Synthetic polypeptide
DEEEIRTTNPVATEQYGSVSTIEPLQVADGEW

SEQ ID NO: 37194 - protein, 28 aa, Artificial Sequence
  Description of Artificial Sequence: Synthetic peptide
DEEEITATNPVGTEQYGSVSENPAVGNH

SEQ ID NO: 37195 - protein, 28 aa, Artificial Sequence
  Description of Artificial Sequence: Synthetic peptide
REIEIRSVNPVATENYGEVSCNLQQGNR

SEQ ID NO: 37196 - protein, 34 aa, Artificial Sequence
  Description of Artificial Sequence: Synthetic polypeptide
DEQEIRTTNPVATEQYGSVETENPLVQREGENDR

SEQ ID NO: 37197 - protein, 30 aa, Artificial Sequence
  Description of Artificial Sequence: Synthetic polypeptide
DEQEIRCTNPVASEIYGCVSATNLERNGNR

SEQ ID NO: 37198 - protein, 33 aa, Artificial Sequence
  Description of Artificial Sequence: Synthetic polypeptide
DEEEIRTTNPVATEQYGSVSETNLEDRDGEEDH

SEQ ID NO: 37199 - protein, 28 aa, Artificial Sequence
  Description of Artificial Sequence: Synthetic peptide
AEAEINTTNPVATECYGEVSTNLQRPPH

SEQ ID NO: 37200 - protein, 32 aa, Artificial Sequence
  Description of Artificial Sequence: Synthetic polypeptide
DEEEIRTTNPVATEQYGDVSCEMDLQCHGNDR

SEQ ID NO: 37201 - protein, 32 aa, Artificial Sequence
  Description of Artificial Sequence: Synthetic polypeptide
DEEEIRTTNPIATEQYGSVAATNLPQMRKELR

SEQ ID NO: 37202 - protein, 28 aa, Artificial Sequence
  Description of Artificial Sequence: Synthetic peptide
DEEEIRTTNPVATEPYGTTATNLQNSTT

SEQ ID NO: 37203 - protein, 32 aa, Artificial Sequence
  Description of Artificial Sequence: Synthetic polypeptide
DEEEIYTTNPVATEQYGSVCSEDNLEQDTGNL

SEQ ID NO: 37204 - protein, 32 aa, Artificial Sequence
  Description of Artificial Sequence: Synthetic polypeptide
DEEEIRTTNPVATEQYGSVFITMNLEPVGNDS

SEQ ID NO: 37205 - protein, 30 aa, Artificial Sequence
  Description of Artificial Sequence: Synthetic polypeptide
DEVEITTTNPVATEHYGSVSTGNPEIRGNF

SEQ ID NO: 37206 - protein, 30 aa, Artificial Sequence
  Description of Artificial Sequence: Synthetic polypeptide
DEQEIRTTNPVATEAYGMVSTQLQTAGGMR

SEQ ID NO: 37207 - protein, 29 aa, Artificial Sequence
  Description of Artificial Sequence: Synthetic peptide
AETEIRTVNPVATEQYGWVSENLQHAGGR

SEQ ID NO: 37208 - protein, 28 aa, Artificial Sequence
  Description of Artificial Sequence: Synthetic peptide
DEAEIAATNPVATENYGSVANNLQRGTQ

SEQ ID NO: 37209 - protein, 32 aa, Artificial Sequence
  Description of Artificial Sequence: Synthetic polypeptide
DEEEIRTTNPVATEQYGSVSCEMDLQCHGNDA

SEQ ID NO: 37210 - protein, 33 aa, Artificial Sequence
  Description of Artificial Sequence: Synthetic polypeptide
DEEEIRTTNPVATEQYGSVSATNLELDNGENDD

SEQ ID NO: 37211 - protein, 33 aa, Artificial Sequence
  Description of Artificial Sequence: Synthetic polypeptide
DEEEIRTTNPVATEQYGSVDSTNLEENEGENDV

SEQ ID NO: 37212 - protein, 28 aa, Artificial Sequence
  Description of Artificial Sequence: Synthetic peptide
DEEEIRTTNPFATEQYGSVHTGPCDGED

SEQ ID NO: 37213 - protein, 28 aa, Artificial Sequence
  Description of Artificial Sequence: Synthetic peptide
AENEIAQTNPVATEQYGVVSTDLQRGED

SEQ ID NO: 37214 - protein, 28 aa, Artificial Sequence
  Description of Artificial Sequence: Synthetic peptide
DEDEIATTNPVSTETYGIVGTNLQRLTR

SEQ ID NO: 37215 - protein, 28 aa, Artificial Sequence
  Description of Artificial Sequence: Synthetic peptide
DEQEVRATNPVSSEIYGCVATNLQRGNR

SEQ ID NO: 37216 - protein, 33 aa, Artificial Sequence
  Description of Artificial Sequence: Synthetic polypeptide
DEEEIRTTNPDATEQYGSVSDTPNPLQPEGDNP

SEQ ID NO: 37217 - protein, 28 aa, Artificial Sequence
  Description of Artificial Sequence: Synthetic peptide
DEESIITTNQVYIEQYGSISDNLQRGTR

SEQ ID NO: 37218 - protein, 28 aa, Artificial Sequence
  Description of Artificial Sequence: Synthetic peptide
QESEIYTTNPVATEIYGEVSYNLERGNM

SEQ ID NO: 37219 - protein, 30 aa, Artificial Sequence
  Description of Artificial Sequence: Synthetic polypeptide
DEEEIRTTNPVATEQYGSVGTNEPEVEEDR

SEQ ID NO: 37220 - protein, 33 aa, Artificial Sequence
  Description of Artificial Sequence: Synthetic polypeptide
DEEEIRTTNPVATEQYGSVSETNLEDDEGENED

SEQ ID NO: 37221 - protein, 28 aa, Artificial Sequence
  Description of Artificial Sequence: Synthetic peptide
VEEEIRTTNPVATEQYGEAGDNLQQQTR

SEQ ID NO: 37222 - protein, 30 aa, Artificial Sequence
  Description of Artificial Sequence: Synthetic polypeptide
DEEEIAATNPVATECYGSVSTENLETGDNI

SEQ ID NO: 37223 - protein, 28 aa, Artificial Sequence
  Description of Artificial Sequence: Synthetic peptide
QEEEICTTNPEATETYGDVSVNLQTGNE

SEQ ID NO: 37224 - protein, 35 aa, Artificial Sequence
  Description of Artificial Sequence: Synthetic polypeptide
DEEEIRTTNPVATEQYGSVSSTTPNLPNRNGMNPR

SEQ ID NO: 37225 - protein, 28 aa, Artificial Sequence
  Description of Artificial Sequence: Synthetic peptide
DEEEIRAVNIVATEQIGSVSTGNQRKNT

SEQ ID NO: 37226 - protein, 31 aa, Artificial Sequence
  Description of Artificial Sequence: Synthetic polypeptide
DEEEIRTTNPVATEHFGGVSTANLPQIGNNQ

SEQ ID NO: 37227 - protein, 28 aa, Artificial Sequence
  Description of Artificial Sequence: Synthetic peptide
DEENIRTTNDVARNQYGEASTNCQRGNG

SEQ ID NO: 37228 - protein, 28 aa, Artificial Sequence
  Description of Artificial Sequence: Synthetic peptide
DEEEVRCTNIVSTENYGEVAMNLQRGNR

SEQ ID NO: 37229 - protein, 29 aa, Artificial Sequence
  Description of Artificial Sequence: Synthetic peptide
DEEEIRTTNPVASEQYGECSEQLQQNGNQ

SEQ ID NO: 37230 - protein, 28 aa, Artificial Sequence
  Description of Artificial Sequence: Synthetic peptide
DEEEIRTTNIVATQQYGSWETIEQTGNE

SEQ ID NO: 37231 - protein, 29 aa, Artificial Sequence
  Description of Artificial Sequence: Synthetic peptide
DEEEINSVNPVATEQYGTVATNLQHAGMR

SEQ ID NO: 37232 - protein, 28 aa, Artificial Sequence
  Description of Artificial Sequence: Synthetic peptide
DENEIAQTNPVATEQYGVVDTNLEVGNL

SEQ ID NO: 37233 - protein, 30 aa, Artificial Sequence
  Description of Artificial Sequence: Synthetic polypeptide
DEEEIRTTNPVASEQYGSCAENLQERGDDW

SEQ ID NO: 37234 - protein, 28 aa, Artificial Sequence
  Description of Artificial Sequence: Synthetic peptide
DENEIRTTNPVATEQWGSVDTNEMIGDQ

SEQ ID NO: 37235 - protein, 31 aa, Artificial Sequence
  Description of Artificial Sequence: Synthetic polypeptide
NETEIRTTNPVATEQYGSVSTCPPPQARGNS

SEQ ID NO: 37236 - protein, 33 aa, Artificial Sequence
  Description of Artificial Sequence: Synthetic polypeptide
DEEEIRTTNPVATEQYGSVSDTEALQQEGENDI

SEQ ID NO: 37237 - protein, 28 aa, Artificial Sequence
  Description of Artificial Sequence: Synthetic peptide
DEEEIRTTNPVATEIYGVMSTDLDYGEA

SEQ ID NO: 37238 - protein, 33 aa, Artificial Sequence
  Description of Artificial Sequence: Synthetic polypeptide
DEEEIRTTNPFATEQYGSVSITPGLVDLRGDNR

SEQ ID NO: 37239 - protein, 28 aa, Artificial Sequence
  Description of Artificial Sequence: Synthetic peptide
VEEEIRATNPVCSEQYGCVSMNLQRGTQ

SEQ ID NO: 37240 - protein, 30 aa, Artificial Sequence
  Description of Artificial Sequence: Synthetic polypeptide
DEQEIATTNPVATECYGSVSATDLQHEGNL

SEQ ID NO: 37241 - protein, 28 aa, Artificial Sequence
  Description of Artificial Sequence: Synthetic peptide
DEIEVNTTNIVTQENYGSVSDNLQRGNR

SEQ ID NO: 37242 - protein, 29 aa, Artificial Sequence
  Description of Artificial Sequence: Synthetic peptide
DEEEINATNPVSTEQYGVVGTNLQSRGGH

SEQ ID NO: 37243 - protein, 28 aa, Artificial Sequence
  Description of Artificial Sequence: Synthetic peptide
DEEEIRTTNPIATEQYGTTGTELQREMI

SEQ ID NO: 37244 - protein, 33 aa, Artificial Sequence
  Description of Artificial Sequence: Synthetic polypeptide
DEEEIRTTNPTATEQYGSVSTANEQEREGDNTV

SEQ ID NO: 37245 - protein, 28 aa, Artificial Sequence
  Description of Artificial Sequence: Synthetic peptide
DEQEIRTTNIAATEQYGEVSENEQVGTR

SEQ ID NO: 37246 - protein, 33 aa, Artificial Sequence
  Description of Artificial Sequence: Synthetic polypeptide
DEEEIRTTNPVATEQYGECVSTCNLEQLMGDNW

SEQ ID NO: 37247 - protein, 32 aa, Artificial Sequence
  Description of Artificial Sequence: Synthetic polypeptide
DEEEIRTTNPVATEQYGVVDSVTIDGQRKGNS

SEQ ID NO: 37248 - protein, 28 aa, Artificial Sequence
  Description of Artificial Sequence: Synthetic peptide
MEEEIRTTNPVATEQFGIVSENLDFGMS

SEQ ID NO: 37249 - protein, 28 aa, Artificial Sequence
  Description of Artificial Sequence: Synthetic peptide
DEQEIAPVNPVATEQYGSMSTNLQNGEM

SEQ ID NO: 37250 - protein, 28 aa, Artificial Sequence
  Description of Artificial Sequence: Synthetic peptide
DEQEIRTTNIEATEQYGSVSTEEDGGNG

SEQ ID NO: 37251 - protein, 32 aa, Artificial Sequence
  Description of Artificial Sequence: Synthetic polypeptide
DEEEIRTTNPVATEIYGVVSETDLQVRGENDN

SEQ ID NO: 37252 - protein, 28 aa, Artificial Sequence
  Description of Artificial Sequence: Synthetic peptide
TEEEIRTTNIVATENHGSASTNLDRGAQ

SEQ ID NO: 37253 - protein, 28 aa, Artificial Sequence
  Description of Artificial Sequence: Synthetic peptide
DEQEIATTNIVATKIYGQVSDNLQRGDR

SEQ ID NO: 37254 - protein, 28 aa, Artificial Sequence
  Description of Artificial Sequence: Synthetic peptide
DEEEINTTNIVAAEVLGSVRTNIQRGNT

SEQ ID NO: 37255 - protein, 28 aa, Artificial Sequence
  Description of Artificial Sequence: Synthetic peptide
DEEEIRTTNPVATEQYGSVSECDEHEEQ

SEQ ID NO: 37256 - protein, 32 aa, Artificial Sequence
  Description of Artificial Sequence: Synthetic polypeptide
DEEEIRTTNPVATEQYGSVSCTMELCDYGNDF

SEQ ID NO: 37257 - protein, 28 aa, Artificial Sequence
  Description of Artificial Sequence: Synthetic peptide
QEQEIAQTNPVATEQYGEASENLQRGGR

SEQ ID NO: 37258 - protein, 28 aa, Artificial Sequence
  Description of Artificial Sequence: Synthetic peptide
DEEEIRTTNIVATEQYGSVETDDDIGEN

SEQ ID NO: 37259 - protein, 28 aa, Artificial Sequence
  Description of Artificial Sequence: Synthetic peptide
DTEEIRTTNPYATEQYGSVHTPDIPGNP

SEQ ID NO: 37260 - protein, 29 aa, Artificial Sequence
  Description of Artificial Sequence: Synthetic peptide
DEEEIATTNPCATEQYGCVSATTVQRGQF

SEQ ID NO: 37261 - protein, 32 aa, Artificial Sequence
  Description of Artificial Sequence: Synthetic polypeptide
DEEEIRTTNPVATECYGSVSATNLQDHEGEDL

SEQ ID NO: 37262 - protein, 30 aa, Artificial Sequence
  Description of Artificial Sequence: Synthetic polypeptide
DENEIATTNPVATECYGSVSTDLQIHNGNQ

SEQ ID NO: 37263 - protein, 28 aa, Artificial Sequence
  Description of Artificial Sequence: Synthetic peptide
DEEEVCTTNIVATEHYGVVSTNLIMGQR

SEQ ID NO: 37264 - protein, 31 aa, Artificial Sequence
  Description of Artificial Sequence: Synthetic polypeptide
DEEEIGTTNPVATEQYGSVQLANSEQRGITR

SEQ ID NO: 37265 - protein, 28 aa, Artificial Sequence
  Description of Artificial Sequence: Synthetic peptide
QEQEIACTNPVATEQYGEASEVLQRGNR

SEQ ID NO: 37266 - protein, 28 aa, Artificial Sequence
  Description of Artificial Sequence: Synthetic peptide
DESEIKATNHVATEQYGLTSTNLQSGNG

SEQ ID NO: 37267 - protein, 28 aa, Artificial Sequence
  Description of Artificial Sequence: Synthetic peptide
DIEEGRNTNDVGTEMYGSVATNEQRGNR

SEQ ID NO: 37268 - protein, 28 aa, Artificial Sequence
  Description of Artificial Sequence: Synthetic peptide
QEVEITATNPVATEQYGSVSTDLQSGDD

SEQ ID NO: 37269 - protein, 31 aa, Artificial Sequence
  Description of Artificial Sequence: Synthetic polypeptide
DEEEISSTNPVATEQYGDVISTNLQLNGLNA

SEQ ID NO: 37270 - protein, 34 aa, Artificial Sequence
  Description of Artificial Sequence: Synthetic polypeptide
DEEEIRTTNPVATEQYGSVSVTIPLVQDRGDEPR

SEQ ID NO: 37271 - protein, 28 aa, Artificial Sequence
  Description of Artificial Sequence: Synthetic peptide
DEEEVRATNIVATEIYGVVATNLQRGGQ

SEQ ID NO: 37272 - protein, 29 aa, Artificial Sequence
  Description of Artificial Sequence: Synthetic peptide
QEQEIAATNPVATEQYGEASAENLQRGNR

SEQ ID NO: 37273 - protein, 33 aa, Artificial Sequence
  Description of Artificial Sequence: Synthetic polypeptide
DEEEIRTTNPVATEQYGSVSTCCLQLFKGDNDN

SEQ ID NO: 37274 - protein, 28 aa, Artificial Sequence
  Description of Artificial Sequence: Synthetic peptide
MENEIATVNPVATEQYGSVSEDLQQGNT

SEQ ID NO: 37275 - protein, 28 aa, Artificial Sequence
  Description of Artificial Sequence: Synthetic peptide
YEEEIVTTNPVCTEQYGSVSTEEEVGNY

SEQ ID NO: 37276 - protein, 28 aa, Artificial Sequence
  Description of Artificial Sequence: Synthetic peptide
DEEETRTTNISATTMYGSVSTNLQMGTT

SEQ ID NO: 37277 - protein, 31 aa, Artificial Sequence
  Description of Artificial Sequence: Synthetic polypeptide
DEEEIRTTNPIATEQYGAVSNAENWQRGNYI

SEQ ID NO: 37278 - protein, 28 aa, Artificial Sequence
  Description of Artificial Sequence: Synthetic peptide
GEEEIASTNPVATEMYGEVACNLQRGGR

SEQ ID NO: 37279 - protein, 28 aa, Artificial Sequence
  Description of Artificial Sequence: Synthetic peptide
DEEEVNTTNIVALSQVGSVSTQTQRGNR

SEQ ID NO: 37280 - protein, 31 aa, Artificial Sequence
  Description of Artificial Sequence: Synthetic polypeptide
DEQEIATTNPVATEQYGSVSITLNPDRKGNS

SEQ ID NO: 37281 - protein, 28 aa, Artificial Sequence
  Description of Artificial Sequence: Synthetic peptide
DEEEIRTTNPVATEQYGSHNQNDSEGEM

SEQ ID NO: 37282 - protein, 29 aa, Artificial Sequence
  Description of Artificial Sequence: Synthetic peptide
DEEEIRTTNPTATEQYGEVSENPQLGDTH

SEQ ID NO: 37283 - protein, 32 aa, Artificial Sequence
  Description of Artificial Sequence: Synthetic polypeptide
DEEEIRTTNPVATEQYGSVSTDLQENEGDEEI

SEQ ID NO: 37284 - protein, 30 aa, Artificial Sequence
  Description of Artificial Sequence: Synthetic polypeptide
DEEEIRTTNPVATEQYGDVSECLQCHAGEQ

SEQ ID NO: 37285 - protein, 28 aa, Artificial Sequence
  Description of Artificial Sequence: Synthetic peptide
AEEEIAQTNPDATEQYGDVSTGDERGNR

SEQ ID NO: 37286 - protein, 28 aa, Artificial Sequence
  Description of Artificial Sequence: Synthetic peptide
DEEEIQTNNIVATENYGSVSDILEIGNR

SEQ ID NO: 37287 - protein, 28 aa, Artificial Sequence
  Description of Artificial Sequence: Synthetic peptide
DEEEIRTTNIFATEQYGSVETDLEDGEI

SEQ ID NO: 37288 - protein, 28 aa, Artificial Sequence
  Description of Artificial Sequence: Synthetic peptide
DEEEIRTTNPVATEQYGDVSECPCHGEL

SEQ ID NO: 37289 - protein, 32 aa, Artificial Sequence
  Description of Artificial Sequence: Synthetic polypeptide
DEEEIRTTNPVATECYGSVSATNLQDHEGEDD

SEQ ID NO: 37290 - protein, 33 aa, Artificial Sequence
  Description of Artificial Sequence: Synthetic polypeptide
DEEEIRTTNPFATEQYGSVPSETNNLFREGMND

SEQ ID NO: 37291 - protein, 31 aa, Artificial Sequence
  Description of Artificial Sequence: Synthetic polypeptide
DEEEIATTNPVATECYGSVSATNLQHNGEDD

SEQ ID NO: 37292 - protein, 30 aa, Artificial Sequence
  Description of Artificial Sequence: Synthetic polypeptide
DEDEVKTTNPVATEPYGSVSADNLQRGPQR

SEQ ID NO: 37293 - protein, 28 aa, Artificial Sequence
  Description of Artificial Sequence: Synthetic peptide
SEEEIYTTNPVATESYGSVSVNWQHGDS

SEQ ID NO: 37294 - protein, 28 aa, Artificial Sequence
  Description of Artificial Sequence: Synthetic peptide
DEQEIRTTNPVATEQWGSVSENEMIGDW

SEQ ID NO: 37295 - protein, 31 aa, Artificial Sequence
  Description of Artificial Sequence: Synthetic polypeptide
DEQEIRTTNPEATEQYGSVSTNPLQEKGEEN

SEQ ID NO: 37296 - protein, 29 aa, Artificial Sequence
  Description of Artificial Sequence: Synthetic peptide
SEGEIRTTNPVCTEQYGSVSTNGWQTGTA

SEQ ID NO: 37297 - protein, 28 aa, Artificial Sequence
  Description of Artificial Sequence: Synthetic peptide
DEDEIKTTNGVATRIYQSVSTNQQRGNT

SEQ ID NO: 37298 - protein, 28 aa, Artificial Sequence
  Description of Artificial Sequence: Synthetic peptide
VEEEIRTTNPIATFQYGCVSSDLERGNP

SEQ ID NO: 37299 - protein, 28 aa, Artificial Sequence
  Description of Artificial Sequence: Synthetic peptide
DEEEIGTTRIVDTEQYSSVSDNLVRSNR

SEQ ID NO: 37300 - protein, 28 aa, Artificial Sequence
  Description of Artificial Sequence: Synthetic peptide
VESEIRTTNPVATEMYGWVSTDLQVGDH

SEQ ID NO: 37301 - protein, 31 aa, Artificial Sequence
  Description of Artificial Sequence: Synthetic polypeptide
DEEEIRTTNPVATEQYGSVDSCENEQTKGEI

SEQ ID NO: 37302 - protein, 32 aa, Artificial Sequence
  Description of Artificial Sequence: Synthetic polypeptide
DEEEIRTTNPVATEQYGSVSTNLEEVEGEEDF

SEQ ID NO: 37303 - protein, 30 aa, Artificial Sequence
  Description of Artificial Sequence: Synthetic polypeptide
DEQEIVTTNPVATEMYGSVSGENLTHGDNR

SEQ ID NO: 37304 - protein, 28 aa, Artificial Sequence
  Description of Artificial Sequence: Synthetic peptide
DTEEIITTNIIADEQYGSVNTILQRGNG

SEQ ID NO: 37305 - protein, 34 aa, Artificial Sequence
  Description of Artificial Sequence: Synthetic polypeptide
DEEEIRTTNPVATEQYGSVCSETCPLVLDRGTNR

SEQ ID NO: 37306 - protein, 28 aa, Artificial Sequence
  Description of Artificial Sequence: Synthetic peptide
DEEEIRTTNPVATEQYGSVSEDDEHEEA

SEQ ID NO: 37307 - protein, 35 aa, Artificial Sequence
  Description of Artificial Sequence: Synthetic polypeptide
DEEEIRTTNPVATEQYGSVSTTDNGLVQIREGEND

SEQ ID NO: 37308 - protein, 31 aa, Artificial Sequence
  Description of Artificial Sequence: Synthetic polypeptide
DEEEIATTNPVATEQYGSVSTDLQDDKGEDQ

SEQ ID NO: 37309 - protein, 28 aa, Artificial Sequence
  Description of Artificial Sequence: Synthetic peptide
SEVEIAATNPVATEIYGSVSTNEQRGDF

SEQ ID NO: 37310 - protein, 28 aa, Artificial Sequence
  Description of Artificial Sequence: Synthetic peptide
DEEEIRATNNVCTENLGSVSTNLYGGDR

SEQ ID NO: 37311 - protein, 28 aa, Artificial Sequence
  Description of Artificial Sequence: Synthetic peptide
DEVEISTTNPEATFQYGCVSANLQQGNF

SEQ ID NO: 37312 - protein, 30 aa, Artificial Sequence
  Description of Artificial Sequence: Synthetic polypeptide
DEEEIRTTNPVATEQYGDASTTCLQVAGEY

SEQ ID NO: 37313 - protein, 28 aa, Artificial Sequence
  Description of Artificial Sequence: Synthetic peptide
DLEEIRTTNNVATDQVGSISDILQSGNR

SEQ ID NO: 37314 - protein, 28 aa, Artificial Sequence
  Description of Artificial Sequence: Synthetic peptide
DCEEIRTTNIVCTEQYGVISTNLINGNS

SEQ ID NO: 37315 - protein, 28 aa, Artificial Sequence
  Description of Artificial Sequence: Synthetic peptide
DEEEIAATNPVATEMFGGVSTNLQQGTF

SEQ ID NO: 37316 - protein, 30 aa, Artificial Sequence
  Description of Artificial Sequence: Synthetic polypeptide
DEQEIRCTNPVASEIYGCVSANNLQREGNR

SEQ ID NO: 37317 - protein, 30 aa, Artificial Sequence
  Description of Artificial Sequence: Synthetic polypeptide
DEEEIRATNPSATEQYGSVSCTECYQVGER

SEQ ID NO: 37318 - protein, 28 aa, Artificial Sequence
  Description of Artificial Sequence: Synthetic peptide
DENEIATTNPVATECYGSVSTELEHGEL

SEQ ID NO: 37319 - protein, 28 aa, Artificial Sequence
  Description of Artificial Sequence: Synthetic peptide
DEEEIATTNPTATEQYGEVSENEQQGDF

SEQ ID NO: 37320 - protein, 28 aa, Artificial Sequence
  Description of Artificial Sequence: Synthetic peptide
DEEEIRTTNPFATEQYWSVSPDLEREED

SEQ ID NO: 37321 - protein, 30 aa, Artificial Sequence
  Description of Artificial Sequence: Synthetic polypeptide
DEEEIRTTNPVATEQYGDVSENLQIHEEDN

SEQ ID NO: 37322 - protein, 28 aa, Artificial Sequence
  Description of Artificial Sequence: Synthetic peptide
DEDEWRTTSIVATEQIGTVSTNNQRGGR

SEQ ID NO: 37323 - protein, 28 aa, Artificial Sequence
  Description of Artificial Sequence: Synthetic peptide
DEEQIRTTNPVAFEQWGSVSDNLHPGSG

SEQ ID NO: 37324 - protein, 28 aa, Artificial Sequence
  Description of Artificial Sequence: Synthetic peptide
QEEEIATVNPVSTEVYGEASTNLQHGNR

SEQ ID NO: 37325 - protein, 34 aa, Artificial Sequence
  Description of Artificial Sequence: Synthetic polypeptide
DEEEIRTTNPVATEQYGSVSITTNLEEVEGDNDR

SEQ ID NO: 37326 - protein, 29 aa, Artificial Sequence
  Description of Artificial Sequence: Synthetic peptide
DDEEIRTTNPTATEVYGWVSAEEMQRGNR

SEQ ID NO: 37327 - protein, 28 aa, Artificial Sequence
  Description of Artificial Sequence: Synthetic peptide
QENEIATTNPVATEQYGSVSTDLEVGEL

SEQ ID NO: 37328 - protein, 32 aa, Artificial Sequence
  Description of Artificial Sequence: Synthetic polypeptide
DEEEIRTTNPEATEQYGSVSTNGDQEIEGENF

SEQ ID NO: 37329 - protein, 28 aa, Artificial Sequence
  Description of Artificial Sequence: Synthetic peptide
DENEIAQTNPVATEQYGSVSTPQELGND

SEQ ID NO: 37330 - protein, 28 aa, Artificial Sequence
  Description of Artificial Sequence: Synthetic peptide
DEEEIVTTNPVATEQYGEVSEVLQHEEK

SEQ ID NO: 37331 - protein, 29 aa, Artificial Sequence
  Description of Artificial Sequence: Synthetic peptide
DDQEIRATNPIAYEHYGVVSATNLQRGNR

SEQ ID NO: 37332 - protein, 32 aa, Artificial Sequence
  Description of Artificial Sequence: Synthetic polypeptide
DEEEIRTTNPVATEQYGSVSEMNPQENGDNDV

SEQ ID NO: 37333 - protein, 31 aa, Artificial Sequence
  Description of Artificial Sequence: Synthetic polypeptide
DEEEIATTNPTATEQYGSVSTMNEQLNGDNV

SEQ ID NO: 37334 - protein, 33 aa, Artificial Sequence
  Description of Artificial Sequence: Synthetic polypeptide
DEEEIRTTNPVATEQYGSVCSTEDLQRKGEEDI

SEQ ID NO: 37335 - protein, 31 aa, Artificial Sequence
  Description of Artificial Sequence: Synthetic polypeptide
DEEEIRTTNPVATELYGSVSCTEDLEEWGNE

SEQ ID NO: 37336 - protein, 32 aa, Artificial Sequence
  Description of Artificial Sequence: Synthetic polypeptide
DEEEIRTTNPVATEQYGSVDCTMDLQCAGNDL

SEQ ID NO: 37337 - protein, 28 aa, Artificial Sequence
  Description of Artificial Sequence: Synthetic peptide
DEQEIRTTNIVATEQYGSVSTDDEVGDN

SEQ ID NO: 37338 - protein, 32 aa, Artificial Sequence
  Description of Artificial Sequence: Synthetic polypeptide
DEEEIRTTNPVATEQYGSVDCTCALEERGENS

SEQ ID NO: 37339 - protein, 31 aa, Artificial Sequence
  Description of Artificial Sequence: Synthetic polypeptide
DEQEIATTNPVATEQYGSVSATNLENGENDI

SEQ ID NO: 37340 - protein, 30 aa, Artificial Sequence
  Description of Artificial Sequence: Synthetic polypeptide
DEEEIRATNPFATEQYGSVSTVGNPEDGNP

SEQ ID NO: 37341 - protein, 30 aa, Artificial Sequence
  Description of Artificial Sequence: Synthetic polypeptide
DEQEIRTTNPVATEQYGDVSEMDLQTGNDM

SEQ ID NO: 37342 - protein, 28 aa, Artificial Sequence
  Description of Artificial Sequence: Synthetic peptide
DEEEIRTTNPDATEQYGSVFEGDCHGNC

SEQ ID NO: 37343 - protein, 31 aa, Artificial Sequence
  Description of Artificial Sequence: Synthetic polypeptide
DEEEIATTNPTATEQYGSVSTMNEQLQGDNF

SEQ ID NO: 37344 - protein, 28 aa, Artificial Sequence
  Description of Artificial Sequence: Synthetic peptide
DEYEIRTTNIVATEQCGTWSTGLQNQNR

SEQ ID NO: 37345 - protein, 28 aa, Artificial Sequence
  Description of Artificial Sequence: Synthetic peptide
DEEEITTTNPEATEHYGSVSTELELGDF

SEQ ID NO: 37346 - protein, 28 aa, Artificial Sequence
  Description of Artificial Sequence: Synthetic peptide
DEEEIRTTNPYATEQYGSVHEGEMEGNA

SEQ ID NO: 37347 - protein, 32 aa, Artificial Sequence
  Description of Artificial Sequence: Synthetic polypeptide
DEEEIRTTNPVATEQYGSHVSEALQDQYGANP

SEQ ID NO: 37348 - protein, 28 aa, Artificial Sequence
  Description of Artificial Sequence: Synthetic peptide
DEEEIRSTNISATEQYLGVSTNLGNSNR

SEQ ID NO: 37349 - protein, 29 aa, Artificial Sequence
  Description of Artificial Sequence: Synthetic peptide
DENEIRTTNPVATEIWGSVSTNEQMTGTF

SEQ ID NO: 37350 - protein, 28 aa, Artificial Sequence
  Description of Artificial Sequence: Synthetic peptide
DEEEIRTTNPVATECYGDVSEDLQHEEN

SEQ ID NO: 37351 - protein, 33 aa, Artificial Sequence
  Description of Artificial Sequence: Synthetic polypeptide
DEEEIRTTNPVATEQYGSVSDTTGLELDNGENR

SEQ ID NO: 37352 - protein, 28 aa, Artificial Sequence
  Description of Artificial Sequence: Synthetic peptide
DEQEIRATNPVASEIYGCVANNLERGNR

SEQ ID NO: 37353 - protein, 30 aa, Artificial Sequence
  Description of Artificial Sequence: Synthetic polypeptide
DEQEVRTTNPVATEVYGCVAATNLEREGNR

SEQ ID NO: 37354 - protein, 31 aa, Artificial Sequence
  Description of Artificial Sequence: Synthetic polypeptide
DEEEIRTTNPVATECYGSVSTELQDYEGEDD

SEQ ID NO: 37355 - protein, 28 aa, Artificial Sequence
  Description of Artificial Sequence: Synthetic peptide
DEEEITATNPVATECFGSVSTNWQQGTS

SEQ ID NO: 37356 - protein, 28 aa, Artificial Sequence
  Description of Artificial Sequence: Synthetic peptide
DEGEIATTNPVATECYGSVSTDLEPGEN

SEQ ID NO: 37357 - protein, 30 aa, Artificial Sequence
  Description of Artificial Sequence: Synthetic polypeptide
DEQEIRTTNPVATECYGSVSTDLQDQGDDS

SEQ ID NO: 37358 - protein, 28 aa, Artificial Sequence
  Description of Artificial Sequence: Synthetic peptide
DEEEIITTNIVKTENQGGVSANLQRGTR

SEQ ID NO: 37359 - protein, 28 aa, Artificial Sequence
  Description of Artificial Sequence: Synthetic peptide
DEETTRFTNIAATEQYGSVSTNVQNGNE

SEQ ID NO: 37360 - protein, 31 aa, Artificial Sequence
  Description of Artificial Sequence: Synthetic polypeptide
GEEEIATTNPVATEQYGSVSEDLQESEGNDR

SEQ ID NO: 37361 - protein, 28 aa, Artificial Sequence
  Description of Artificial Sequence: Synthetic peptide
DEDEISTTNPVATEMWGSISENLQHFNR

SEQ ID NO: 37362 - protein, 33 aa, Artificial Sequence
  Description of Artificial Sequence: Synthetic polypeptide
DEEEIRTTNPVATEQYGSVSTCNPVQEAKGNDT

SEQ ID NO: 37363 - protein, 28 aa, Artificial Sequence
  Description of Artificial Sequence: Synthetic peptide
QEGEIATTNPCASEQYGIVSTNLQSGTR

SEQ ID NO: 37364 - protein, 30 aa, Artificial Sequence
  Description of Artificial Sequence: Synthetic polypeptide
DENEINSTNPVATEQYGSVSTNLQDMNGEA

SEQ ID NO: 37365 - protein, 28 aa, Artificial Sequence
  Description of Artificial Sequence: Synthetic peptide
DEEEIRQTNIVAHNQYGSVATNDQRNNT

SEQ ID NO: 37366 - protein, 30 aa, Artificial Sequence
  Description of Artificial Sequence: Synthetic polypeptide
DEEEIATTNPVATELYGSVSDDLQYANGNI

SEQ ID NO: 37367 - protein, 29 aa, Artificial Sequence
  Description of Artificial Sequence: Synthetic peptide
MEQEIRTTNPVATEMYGSVSEELQDIGNM

SEQ ID NO: 37368 - protein, 28 aa, Artificial Sequence
  Description of Artificial Sequence: Synthetic peptide
DEEEIATTNPVATEQYGDVSENLMHMQQ

SEQ ID NO: 37369 - protein, 32 aa, Artificial Sequence
  Description of Artificial Sequence: Synthetic polypeptide
DEEEIRTTNPVATEQYGSVSTELQEHDGDEDW

SEQ ID NO: 37370 - protein, 28 aa, Artificial Sequence
  Description of Artificial Sequence: Synthetic peptide
DEQEIRCTNPVASEIYGCVAMNLERGNR

SEQ ID NO: 37371 - protein, 28 aa, Artificial Sequence
  Description of Artificial Sequence: Synthetic peptide
DDEEIRTTNPCAYEFYGVVASNLERGNR

SEQ ID NO: 37372 - protein, 33 aa, Artificial Sequence
  Description of Artificial Sequence: Synthetic polypeptide
DEEEIRTTNPVATEQYGSVETLNPLQDEGDEPR

SEQ ID NO: 37373 - protein, 28 aa, Artificial Sequence
  Description of Artificial Sequence: Synthetic peptide
DEEEICTTNPTATEQYGEVSENEQNGTE

SEQ ID NO: 37374 - protein, 31 aa, Artificial Sequence
  Description of Artificial Sequence: Synthetic polypeptide
DEEEIATTNPTATEQYGSVSTMNEQDQGDNF

SEQ ID NO: 37375 - protein, 30 aa, Artificial Sequence
  Description of Artificial Sequence: Synthetic polypeptide
DEEEIRTTNPVATEQYGEVSENLQEAEEDM

SEQ ID NO: 37376 - protein, 28 aa, Artificial Sequence
  Description of Artificial Sequence: Synthetic peptide
DEEEIRTTNIDATEQYGSVETDDDRENM

SEQ ID NO: 37377 - protein, 34 aa, Artificial Sequence
  Description of Artificial Sequence: Synthetic polypeptide
DEEEIRTTNPDATEQYGSVSTVNPLVEDREGENR

SEQ ID NO: 37378 - protein, 28 aa, Artificial Sequence
  Description of Artificial Sequence: Synthetic peptide
DEFEINATNPVATEQYGDVSDFIQRGNV

SEQ ID NO: 37379 - protein, 28 aa, Artificial Sequence
  Description of Artificial Sequence: Synthetic peptide
DEEEIRTTNIDATEQYGSVDTIQQDENL

SEQ ID NO: 37380 - protein, 31 aa, Artificial Sequence
  Description of Artificial Sequence: Synthetic polypeptide
DEEEIATTNPVATEQYGDVSCTDLQCQAGNA

SEQ ID NO: 37381 - protein, 35 aa, Artificial Sequence
  Description of Artificial Sequence: Synthetic polypeptide
DEEEIRTTNPVATEQYGSVISTMNGLPQLREGDNF

SEQ ID NO: 37382 - protein, 29 aa, Artificial Sequence
  Description of Artificial Sequence: Synthetic peptide
DEEEIRTTNPVATECYGVMSTELQDAGES

SEQ ID NO: 37383 - protein, 28 aa, Artificial Sequence
  Description of Artificial Sequence: Synthetic peptide
DEEEIRTTNIVATNEYGTVADNLQRANT

SEQ ID NO: 37384 - protein, 28 aa, Artificial Sequence
  Description of Artificial Sequence: Synthetic peptide
AENEIRTTNPVATESYGNVSENLMRGEA

SEQ ID NO: 37385 - protein, 31 aa, Artificial Sequence
  Description of Artificial Sequence: Synthetic polypeptide
DEEEIRTTNPVATEQYGDVSCEMNLCHGNDS

SEQ ID NO: 37386 - protein, 28 aa, Artificial Sequence
  Description of Artificial Sequence: Synthetic peptide
DEQEIVSTNPVSTEMYGSVSNNLQLGNQ

SEQ ID NO: 37387 - protein, 33 aa, Artificial Sequence
  Description of Artificial Sequence: Synthetic polypeptide
DEEEIRTTNPVATEQYGSVSITPNPLQIDGDEP

SEQ ID NO: 37388 - protein, 31 aa, Artificial Sequence
  Description of Artificial Sequence: Synthetic polypeptide
DEDEIRATNPVATEQYGEVISTMNLQQEGNI

SEQ ID NO: 37389 - protein, 33 aa, Artificial Sequence
  Description of Artificial Sequence: Synthetic polypeptide
DEEEIRTTNPVATEQYGSVTSDTPNLDPEGENP

SEQ ID NO: 37390 - protein, 32 aa, Artificial Sequence
  Description of Artificial Sequence: Synthetic polypeptide
NEEEIRTTNPVATEQYGSVSTEELQQAGENDT

SEQ ID NO: 37391 - protein, 28 aa, Artificial Sequence
  Description of Artificial Sequence: Synthetic peptide
DEEEIQTTNSVAIEEYGYVSTNEQRGAF

SEQ ID NO: 37392 - protein, 31 aa, Artificial Sequence
  Description of Artificial Sequence: Synthetic polypeptide
DEEEIATTNPVATECYGSVSATDLQRNGEDL

SEQ ID NO: 37393 - protein, 29 aa, Artificial Sequence
  Description of Artificial Sequence: Synthetic peptide
AEQEIVTTNPVATECYGFVSATNEQRQNR

SEQ ID NO: 37394 - protein, 28 aa, Artificial Sequence
  Description of Artificial Sequence: Synthetic peptide
DEEEIRTTNPDATEQYGSVFEPLDNGEN

SEQ ID NO: 37395 - protein, 28 aa, Artificial Sequence
  Description of Artificial Sequence: Synthetic peptide
DESEVRTTNPTACECYGVVSENLQRGQR

SEQ ID NO: 37396 - protein, 28 aa, Artificial Sequence
  Description of Artificial Sequence: Synthetic peptide
NEEEIRTTNPVCTEIYGTVSTADQMGND

SEQ ID NO: 37397 - protein, 28 aa, Artificial Sequence
  Description of Artificial Sequence: Synthetic peptide
DEEEVRTTNIVATKQEGTVSTNLQNTNN

SEQ ID NO: 37398 - protein, 30 aa, Artificial Sequence
  Description of Artificial Sequence: Synthetic polypeptide
DEEEIRTTNPVATEQYGDVSENEMNQAGDA

SEQ ID NO: 37399 - protein, 28 aa, Artificial Sequence
  Description of Artificial Sequence: Synthetic peptide
DENEIRCTNPDATEQYGVVSTEGERGNW

SEQ ID NO: 37400 - protein, 28 aa, Artificial Sequence
  Description of Artificial Sequence: Synthetic peptide
DEEELRATNIVSTEIYGVVATNLQRGTR

SEQ ID NO: 37401 - protein, 32 aa, Artificial Sequence
  Description of Artificial Sequence: Synthetic polypeptide
DEEEIRTTNPVATMQYGSVSDTNFELPKGNED

SEQ ID NO: 37402 - protein, 28 aa, Artificial Sequence
  Description of Artificial Sequence: Synthetic peptide
DEEEIAATNPVATEMFGSVSDNEQIGTR

SEQ ID NO: 37403 - protein, 28 aa, Artificial Sequence
  Description of Artificial Sequence: Synthetic peptide
SEEEIRTTNPIATEIFGSVSTDLQSGLL

SEQ ID NO: 37404 - protein, 28 aa, Artificial Sequence
  Description of Artificial Sequence: Synthetic peptide
DEEGLRTTLDVHTESYGSVSTNVQTGNR

SEQ ID NO: 37405 - protein, 28 aa, Artificial Sequence
  Description of Artificial Sequence: Synthetic peptide
DEEEIKNTNGVARNQYGEVSTNVQRGNN

SEQ ID NO: 37406 - protein, 28 aa, Artificial Sequence
  Description of Artificial Sequence: Synthetic peptide
DEQEIRGTNIVAQEQNGSVCTNLDRGDR

SEQ ID NO: 37407 - protein, 30 aa, Artificial Sequence
  Description of Artificial Sequence: Synthetic polypeptide
DEGEIRATNPVATECFGSVSTGNLQQGDDR

SEQ ID NO: 37408 - protein, 34 aa, Artificial Sequence
  Description of Artificial Sequence: Synthetic polypeptide
DEEEIRTTNPTATEQYGSVYSTLNLQDREGDNTG

SEQ ID NO: 37409 - protein, 31 aa, Artificial Sequence
  Description of Artificial Sequence: Synthetic polypeptide
DEEEIRTTNPVATEQWGSYSTNEMDYDGNDR

SEQ ID NO: 37410 - protein, 32 aa, Artificial Sequence
  Description of Artificial Sequence: Synthetic polypeptide
DEEEIATTNPTATEQYGSVSTMNEQLQEGDNF

SEQ ID NO: 37411 - protein, 28 aa, Artificial Sequence
  Description of Artificial Sequence: Synthetic peptide
DENEIATTNPVASEQYGVVSTNFQIDNN

SEQ ID NO: 37412 - protein, 33 aa, Artificial Sequence
  Description of Artificial Sequence: Synthetic polypeptide
DEEEIRQTNPVATEQYGSVSVTGGLVEDRGDNR

SEQ ID NO: 37413 - protein, 30 aa, Artificial Sequence
  Description of Artificial Sequence: Synthetic polypeptide
QEEEIRTTNPVSTEQYGEASATNLQHAGGR

SEQ ID NO: 37414 - protein, 28 aa, Artificial Sequence
  Description of Artificial Sequence: Synthetic peptide
DNEEIRTTNIVAAEQLGTTHTNLQRLNR

SEQ ID NO: 37415 - protein, 34 aa, Artificial Sequence
  Description of Artificial Sequence: Synthetic polypeptide
DEEEIRTTNPVATEQYGSVSDTMNLVEIPDGNPR

SEQ ID NO: 37416 - protein, 28 aa, Artificial Sequence
  Description of Artificial Sequence: Synthetic peptide
DEQEIRTTNIVATEQYWSVSEDLQLGES

SEQ ID NO: 37417 - protein, 30 aa, Artificial Sequence
  Description of Artificial Sequence: Synthetic polypeptide
DEEEIRTTNPTATEQYGEVSENPQDSGDNI

SEQ ID NO: 37418 - protein, 29 aa, Artificial Sequence
  Description of Artificial Sequence: Synthetic peptide
QDEEIRATNPVATEFFGSVSTNEQRGDNP

SEQ ID NO: 37419 - protein, 32 aa, Artificial Sequence
  Description of Artificial Sequence: Synthetic polypeptide
DEEEIRTTNPVATEQYGSVSTNPVQENKGEDF

SEQ ID NO: 37420 - protein, 32 aa, Artificial Sequence
  Description of Artificial Sequence: Synthetic polypeptide
DEEEIRTTNPVATEQYGSVDCTMELQCVGNDN

SEQ ID NO: 37421 - protein, 32 aa, Artificial Sequence
  Description of Artificial Sequence: Synthetic polypeptide
DEQEIRTTNPVATEQYGSVSTLNPDQDHGEDR

SEQ ID NO: 37422 - protein, 32 aa, Artificial Sequence
  Description of Artificial Sequence: Synthetic polypeptide
DEEEIRTTNPVATEQYWSVSTPNPLQDDGDEP

SEQ ID NO: 37423 - protein, 30 aa, Artificial Sequence
  Description of Artificial Sequence: Synthetic polypeptide
QEEEITTTNPVATEQYGVVSTELQVVEGNG

SEQ ID NO: 37424 - protein, 28 aa, Artificial Sequence
  Description of Artificial Sequence: Synthetic peptide
QEVEIYTTNPVATEQFGSVSTALQGGDN

SEQ ID NO: 37425 - protein, 28 aa, Artificial Sequence
  Description of Artificial Sequence: Synthetic peptide
SEEEIMTTNPASTEQYGSVSVNLQVGDA

SEQ ID NO: 37426 - protein, 28 aa, Artificial Sequence
  Description of Artificial Sequence: Synthetic peptide
AEEEIRTTNILANEQFGGVSTNLQGANR

SEQ ID NO: 37427 - protein, 28 aa, Artificial Sequence
  Description of Artificial Sequence: Synthetic peptide
DEQEIRTTNIVATEQYGSVETELEDGEM

SEQ ID NO: 37428 - protein, 33 aa, Artificial Sequence
  Description of Artificial Sequence: Synthetic polypeptide
DEEEIRTTNPVATEQYGSVDSTDLVEDHEGNDR

SEQ ID NO: 37429 - protein, 28 aa, Artificial Sequence
  Description of Artificial Sequence: Synthetic peptide
NEEEIQTGNGVAQEQYGSVSVNLGRGNT

SEQ ID NO: 37430 - protein, 28 aa, Artificial Sequence
  Description of Artificial Sequence: Synthetic peptide
DEGEIRTENIVGTEQYGVVSDNLQIGNF

SEQ ID NO: 37431 - protein, 30 aa, Artificial Sequence
  Description of Artificial Sequence: Synthetic polypeptide
DEIEICTTNPVATEQYGTCASVTNLQGGNI

SEQ ID NO: 37432 - protein, 30 aa, Artificial Sequence
  Description of Artificial Sequence: Synthetic polypeptide
MEEEIRATNPVATESYGVCVSTLPLQRGND

SEQ ID NO: 37433 - protein, 28 aa, Artificial Sequence
  Description of Artificial Sequence: Synthetic peptide
EEEEIRNTNIVATEIYGSVATNVQHANR

SEQ ID NO: 37434 - protein, 29 aa, Artificial Sequence
  Description of Artificial Sequence: Synthetic peptide
DEEEIAATNPVATEQYGWVSTELQFEGDH

SEQ ID NO: 37435 - protein, 28 aa, Artificial Sequence
  Description of Artificial Sequence: Synthetic peptide
NEEEIRTENIVATEMYGSVNDNLQSGGR

SEQ ID NO: 37436 - protein, 31 aa, Artificial Sequence
  Description of Artificial Sequence: Synthetic polypeptide
MEEEIRTTNPVATECYGSVSTDLQENEGNDM

SEQ ID NO: 37437 - protein, 28 aa, Artificial Sequence
  Description of Artificial Sequence: Synthetic peptide
DENNIRTTNIVTTEQYGAWSTNLQDGNQ

SEQ ID NO: 37438 - protein, 28 aa, Artificial Sequence
  Description of Artificial Sequence: Synthetic peptide
DENEIRSTNPVASEQYGVVSTDLQQGEL

SEQ ID NO: 37439 - protein, 28 aa, Artificial Sequence
  Description of Artificial Sequence: Synthetic peptide
DEHEIVSTNPVASEVYGSVSTELQVGNS

SEQ ID NO: 37440 - protein, 33 aa, Artificial Sequence
  Description of Artificial Sequence: Synthetic polypeptide
DEEEIRTTNPVATEQYGSVTSETNDTEIRGENP

SEQ ID NO: 37441 - protein, 31 aa, Artificial Sequence
  Description of Artificial Sequence: Synthetic polypeptide
DEEEIATTNPVATECYGSVSTNLQHEGEEDL

SEQ ID NO: 37442 - protein, 32 aa, Artificial Sequence
  Description of Artificial Sequence: Synthetic polypeptide
DEEEIRTTNPVATEQYGSVDCTMELCDRGNDC

SEQ ID NO: 37443 - protein, 28 aa, Artificial Sequence
  Description of Artificial Sequence: Synthetic peptide
DEEVIRTTNLVTTEQLGLVSTALQRGGT

SEQ ID NO: 37444 - protein, 34 aa, Artificial Sequence
  Description of Artificial Sequence: Synthetic polypeptide
DEEEIRTTNPVATEQYGSVTSLTAPGLLPRGTNR

SEQ ID NO: 37445 - protein, 28 aa, Artificial Sequence
  Description of Artificial Sequence: Synthetic peptide
DEEEILTTNIVATKQYGHVSTQLQRIGG

SEQ ID NO: 37446 - protein, 28 aa, Artificial Sequence
  Description of Artificial Sequence: Synthetic peptide
DEEEQRTTDHVKTNIYGSVSTNLQRGCD

SEQ ID NO: 37447 - protein, 28 aa, Artificial Sequence
  Description of Artificial Sequence: Synthetic peptide
SEEEIRCTNPEATEMFGSVSTNLQLGTI

SEQ ID NO: 37448 - protein, 28 aa, Artificial Sequence
  Description of Artificial Sequence: Synthetic peptide
DEEEIASVNIVSTKNWGSVSTNLQRGNR

SEQ ID NO: 37449 - protein, 28 aa, Artificial Sequence
  Description of Artificial Sequence: Synthetic peptide
DEEEIRTCNIVHTQQYGHVSTNLQRASG

SEQ ID NO: 37450 - protein, 33 aa, Artificial Sequence
  Description of Artificial Sequence: Synthetic polypeptide
DEEEIRTTNPDATEQYGSVSDTPNLQIDNGDNP

SEQ ID NO: 37451 - protein, 28 aa, Artificial Sequence
  Description of Artificial Sequence: Synthetic peptide
DEEEIRPTNPDATENYGSVSTCEDPGNG

SEQ ID NO: 37452 - protein, 30 aa, Artificial Sequence
  Description of Artificial Sequence: Synthetic polypeptide
DEQEITTTNPCATEQYGVVSCTNLCEQGNR

SEQ ID NO: 37453 - protein, 28 aa, Artificial Sequence
  Description of Artificial Sequence: Synthetic peptide
QEQEIAATNPVATEQYGEASEVLQRGNR

SEQ ID NO: 37454 - protein, 32 aa, Artificial Sequence
  Description of Artificial Sequence: Synthetic polypeptide
DEEEIRTTNPVATEQYGSVSETELQETDGDDY

SEQ ID NO: 37455 - protein, 28 aa, Artificial Sequence
  Description of Artificial Sequence: Synthetic peptide
DEEEIRTVNIEAWEQYGVVATNLQRTNT

SEQ ID NO: 37456 - protein, 28 aa, Artificial Sequence
  Description of Artificial Sequence: Synthetic peptide
DEQEVRTTNIVATEQIGEVSTNVQRGTT

SEQ ID NO: 37457 - protein, 34 aa, Artificial Sequence
  Description of Artificial Sequence: Synthetic polypeptide
DEEEIRTTNPVATEQYGSVSTTDNLVEEVEGDNR

SEQ ID NO: 37458 - protein, 28 aa, Artificial Sequence
  Description of Artificial Sequence: Synthetic peptide
SEEEIRTTNPVATEQWGSVSTAEEVGDY

SEQ ID NO: 37459 - protein, 31 aa, Artificial Sequence
  Description of Artificial Sequence: Synthetic polypeptide
MENEIRTTNPVATEQYGSVSTDLQENEGNDM

SEQ ID NO: 37460 - protein, 28 aa, Artificial Sequence
  Description of Artificial Sequence: Synthetic peptide
QEQEIVATNPVATEQYGEASENLQRGGR

SEQ ID NO: 37461 - protein, 31 aa, Artificial Sequence
  Description of Artificial Sequence: Synthetic polypeptide
DEQEIRTTNPVATEWYGSVSTNLQEVEGDDN

SEQ ID NO: 37462 - protein, 28 aa, Artificial Sequence
  Description of Artificial Sequence: Synthetic peptide
DEEEIHFTNIVKTEQYGTHSTNLQRSNN

SEQ ID NO: 37463 - protein, 31 aa, Artificial Sequence
  Description of Artificial Sequence: Synthetic polypeptide
DEEEIRTTNPVATEQWGSVDTNLMLTNGNDM

SEQ ID NO: 37464 - protein, 30 aa, Artificial Sequence
  Description of Artificial Sequence: Synthetic polypeptide
DEEEIATTNPVATEQYGDVSCEELQLGDNV

SEQ ID NO: 37465 - protein, 32 aa, Artificial Sequence
  Description of Artificial Sequence: Synthetic polypeptide
DEEEIRTTNPVATEQYGSVSETDLELNNGNDT

SEQ ID NO: 37466 - protein, 34 aa, Artificial Sequence
  Description of Artificial Sequence: Synthetic polypeptide
DEEEIRTTNPDATEQYGSVSITPGPLVQLRGDNR

SEQ ID NO: 37467 - protein, 28 aa, Artificial Sequence
  Description of Artificial Sequence: Synthetic peptide
DENEIAQTNPVATEQYGSVSTGDEHGNQ

SEQ ID NO: 37468 - protein, 28 aa, Artificial Sequence
  Description of Artificial Sequence: Synthetic peptide
DEQEIRTTNIVATDQYGSVETILDIGDR

SEQ ID NO: 37469 - protein, 28 aa, Artificial Sequence
  Description of Artificial Sequence: Synthetic peptide
SEVEIAATNPTATEQYGSVSTNEQQGNF

SEQ ID NO: 37470 - protein, 30 aa, Artificial Sequence
  Description of Artificial Sequence: Synthetic polypeptide
DEEEIRTTNPCATEQYGDVSCTMELCVGNV

SEQ ID NO: 37471 - protein, 28 aa, Artificial Sequence
  Description of Artificial Sequence: Synthetic peptide
AENEIACTNPVATEQYGEASENLQRGGR

SEQ ID NO: 37472 - protein, 28 aa, Artificial Sequence
  Description of Artificial Sequence: Synthetic peptide
DEEENETTNNVATEHYLSVSDNLQTGNQ

SEQ ID NO: 37473 - protein, 29 aa, Artificial Sequence
  Description of Artificial Sequence: Synthetic peptide
AEVEITATNPVATEQYGSVSENLQHAGMR

SEQ ID NO: 37474 - protein, 28 aa, Artificial Sequence
  Description of Artificial Sequence: Synthetic peptide
NEEEIKSTNIVSTENYGNVGTNLQRGNR

SEQ ID NO: 37475 - protein, 28 aa, Artificial Sequence
  Description of Artificial Sequence: Synthetic peptide
DEGEIRETNIVGTVQYGSVSDNLQRSNT

SEQ ID NO: 37476 - protein, 28 aa, Artificial Sequence
  Description of Artificial Sequence: Synthetic peptide
SENEIASVNPVAYEQYGSVSTNLQRPNF

SEQ ID NO: 37477 - protein, 28 aa, Artificial Sequence
  Description of Artificial Sequence: Synthetic peptide
DEQEIATTNIVSTEVYGWVGTNLQRGGR

SEQ ID NO: 37478 - protein, 32 aa, Artificial Sequence
  Description of Artificial Sequence: Synthetic polypeptide
DEQEIRTTNPVATEQYGSTVDSITNADLRGNL

SEQ ID NO: 37479 - protein, 28 aa, Artificial Sequence
  Description of Artificial Sequence: Synthetic peptide
DGEMIRTTNIVAREQYGSVDGNEQSGNR

SEQ ID NO: 37480 - protein, 30 aa, Artificial Sequence
  Description of Artificial Sequence: Synthetic polypeptide
DEEEIRTTNPAATEQYGSVSENPQEFGPDI

SEQ ID NO: 37481 - protein, 28 aa, Artificial Sequence
  Description of Artificial Sequence: Synthetic peptide
DEEEIRTTNPFATEQYGSVHTGDCDGED

SEQ ID NO: 37482 - protein, 32 aa, Artificial Sequence
  Description of Artificial Sequence: Synthetic polypeptide
DEEEIRQTNPVATEQYGSVSITGNLEINGNDQ

SEQ ID NO: 37483 - protein, 30 aa, Artificial Sequence
  Description of Artificial Sequence: Synthetic polypeptide
SEEEIRATNPTATEQYGSVSEMNEQQEGNR

SEQ ID NO: 37484 - protein, 30 aa, Artificial Sequence
  Description of Artificial Sequence: Synthetic polypeptide
DEEEISTTNPVATEQYGDASTMDLQQDGNV

SEQ ID NO: 37485 - protein, 28 aa, Artificial Sequence
  Description of Artificial Sequence: Synthetic peptide
DEQEIATTNPVATECYGSVSTDLEHGEL

SEQ ID NO: 37486 - protein, 31 aa, Artificial Sequence
  Description of Artificial Sequence: Synthetic polypeptide
DEEEIVTTNPVATEQYGSVSTGGDQITGDNY

SEQ ID NO: 37487 - protein, 33 aa, Artificial Sequence
  Description of Artificial Sequence: Synthetic polypeptide
DEEEIRTTNPVATEQYGSVSITPNPLFIDGDER

SEQ ID NO: 37488 - protein, 28 aa, Artificial Sequence
  Description of Artificial Sequence: Synthetic peptide
DEQEIATTNPVATECYGSVSTDLEYGED

SEQ ID NO: 37489 - protein, 28 aa, Artificial Sequence
  Description of Artificial Sequence: Synthetic peptide
DENEISATNPVATEQYGWVSDNLQEGEA

SEQ ID NO: 37490 - protein, 28 aa, Artificial Sequence
  Description of Artificial Sequence: Synthetic peptide
DEQEIACTNPVASEVYGCVGMNLQRGNR

SEQ ID NO: 37491 - protein, 29 aa, Artificial Sequence
  Description of Artificial Sequence: Synthetic peptide
DEEEICTTNPVATEQYGSCSDVLQHAGPM

SEQ ID NO: 37492 - protein, 28 aa, Artificial Sequence
  Description of Artificial Sequence: Synthetic peptide
DEEEIRTTNPDATEQYGSVFEPDCDGNC

SEQ ID NO: 37493 - protein, 28 aa, Artificial Sequence
  Description of Artificial Sequence: Synthetic peptide
DELEIYATNIVATEEYGSVSTGLQRGEG

SEQ ID NO: 37494 - protein, 35 aa, Artificial Sequence
  Description of Artificial Sequence: Synthetic polypeptide
DEEEIRTTNPVATEQYGSVSSITGPLNQVRGDNPR

SEQ ID NO: 37495 - protein, 28 aa, Artificial Sequence
  Description of Artificial Sequence: Synthetic peptide
DDSEIRSTNPVSTEQYGNVANNLQRGQR

SEQ ID NO: 37496 - protein, 32 aa, Artificial Sequence
  Description of Artificial Sequence: Synthetic polypeptide
DEEEIRTTNPVATEQYGSVSATDLELDNGNDD

SEQ ID NO: 37497 - protein, 28 aa, Artificial Sequence
  Description of Artificial Sequence: Synthetic peptide
DEQEIRSTNPVATEQYGNVSDCLQGFNL

SEQ ID NO: 37498 - protein, 28 aa, Artificial Sequence
  Description of Artificial Sequence: Synthetic peptide
QECEIRTTNPVATYQYGSVSEVLYGGNN

SEQ ID NO: 37499 - protein, 28 aa, Artificial Sequence
  Description of Artificial Sequence: Synthetic peptide
DEEEIRTTNPCGTEQYGSVAEDLQIGEM

SEQ ID NO: 37500 - protein, 32 aa, Artificial Sequence
  Description of Artificial Sequence: Synthetic polypeptide
DEQEIRTTNPVATEQYGSVDSTPPLEETGNDR

SEQ ID NO: 37501 - protein, 28 aa, Artificial Sequence
  Description of Artificial Sequence: Synthetic peptide
EEEEIRQTNNVATKQYGSVSTNNGRGTM

SEQ ID NO: 37502 - protein, 33 aa, Artificial Sequence
  Description of Artificial Sequence: Synthetic polypeptide
DEEEIRTTNPVATEQYGSVSTPNPLQEDDGDEE

SEQ ID NO: 37503 - protein, 28 aa, Artificial Sequence
  Description of Artificial Sequence: Synthetic peptide
DEEEIRTTNPVATEQWGDVSENEMQGDA

SEQ ID NO: 37504 - protein, 28 aa, Artificial Sequence
  Description of Artificial Sequence: Synthetic peptide
DEVEIATTNPTATEMFGSVSENLQRGTF

SEQ ID NO: 37505 - protein, 34 aa, Artificial Sequence
  Description of Artificial Sequence: Synthetic polypeptide
DEEEIRTTNPVATEQYGWSVSTNNLTQDNDGMNV

SEQ ID NO: 37506 - protein, 28 aa, Artificial Sequence
  Description of Artificial Sequence: Synthetic peptide
DEQEIACTNIVASEIYGCVATNLQRGNR

SEQ ID NO: 37507 - protein, 28 aa, Artificial Sequence
  Description of Artificial Sequence: Synthetic peptide
DEGEIATTNPVATENYGEVSVNLIQGNQ

SEQ ID NO: 37508 - protein, 28 aa, Artificial Sequence
  Description of Artificial Sequence: Synthetic peptide
DEYEIRTTNIFATEQYGSVETILDIGER

SEQ ID NO: 37509 - protein, 28 aa, Artificial Sequence
  Description of Artificial Sequence: Synthetic peptide
DDQEIATTNPVATEIYGVVASNLERGNR

SEQ ID NO: 37510 - protein, 28 aa, Artificial Sequence
  Description of Artificial Sequence: Synthetic peptide
DEEEIVTTNPVATEQYGDVSENLMHMQQ

SEQ ID NO: 37511 - protein, 29 aa, Artificial Sequence
  Description of Artificial Sequence: Synthetic peptide
DEEEIRTTNPVATECYGIVSTVPQSREDL

SEQ ID NO: 37512 - protein, 30 aa, Artificial Sequence
  Description of Artificial Sequence: Synthetic polypeptide
DEEEIAATNPTATEQFGSVSTNPQREGTTR

SEQ ID NO: 37513 - protein, 31 aa, Artificial Sequence
  Description of Artificial Sequence: Synthetic polypeptide
DEEEIRTTNPVATEQYGSVDTMDDQQGGNDV

SEQ ID NO: 37514 - protein, 28 aa, Artificial Sequence
  Description of Artificial Sequence: Synthetic peptide
DEVEIATTNPVCTECYGTVSTDWQHGNR

SEQ ID NO: 37515 - protein, 28 aa, Artificial Sequence
  Description of Artificial Sequence: Synthetic peptide
DEEEIRTTNPVATENYGNVSTPDEEGTL

SEQ ID NO: 37516 - protein, 32 aa, Artificial Sequence
  Description of Artificial Sequence: Synthetic polypeptide
DEEEIRTTNPVATEQYGSVSETNLEDNDGEEL

SEQ ID NO: 37517 - protein, 28 aa, Artificial Sequence
  Description of Artificial Sequence: Synthetic peptide
DEEEITATNPAATEIFGEVSTNPQRGNA

SEQ ID NO: 37518 - protein, 28 aa, Artificial Sequence
  Description of Artificial Sequence: Synthetic peptide
DEEKIRTTNTVACEQIGSLSTNVQRGDL

SEQ ID NO: 37519 - protein, 32 aa, Artificial Sequence
  Description of Artificial Sequence: Synthetic polypeptide
DEEEIRTTNPVATEQYGSVSCENPLDERDGES

SEQ ID NO: 37520 - protein, 28 aa, Artificial Sequence
  Description of Artificial Sequence: Synthetic peptide
DEEELRTVNIVATEIYGSMSTNLLNGNQ

SEQ ID NO: 37521 - protein, 28 aa, Artificial Sequence
  Description of Artificial Sequence: Synthetic peptide
DEEEIRTTNPVATEQYGSVSEEDEHEEN

SEQ ID NO: 37522 - protein, 30 aa, Artificial Sequence
  Description of Artificial Sequence: Synthetic polypeptide
DEVEIATTNPTATEQYGSVSTNEQLEGDNQ

SEQ ID NO: 37523 - protein, 31 aa, Artificial Sequence
  Description of Artificial Sequence: Synthetic polypeptide
DEEEIVTTNPVATECYGWVSETNLQRKGDEV

SEQ ID NO: 37524 - protein, 28 aa, Artificial Sequence
  Description of Artificial Sequence: Synthetic peptide
DEEEIVTTNPVATECFGSVSTSLQCPEI

SEQ ID NO: 37525 - protein, 28 aa, Artificial Sequence
  Description of Artificial Sequence: Synthetic peptide
VDEEIRNTNGVATEQYGSVSDEIQRGNN

SEQ ID NO: 37526 - protein, 28 aa, Artificial Sequence
  Description of Artificial Sequence: Synthetic peptide
DEEEIRTTNPDATEQYGSVFEDDCHGNC

SEQ ID NO: 37527 - protein, 28 aa, Artificial Sequence
  Description of Artificial Sequence: Synthetic peptide
DEQEIRTTNPVATEQYGSVETDDEHGEN

SEQ ID NO: 37528 - protein, 28 aa, Artificial Sequence
  Description of Artificial Sequence: Synthetic peptide
DEEEIRTTNPIACEQYGSVSTADFLGLM

SEQ ID NO: 37529 - protein, 28 aa, Artificial Sequence
  Description of Artificial Sequence: Synthetic peptide
DEEEIRTTNIVATEQYGSVETIDDDGEI

SEQ ID NO: 37530 - protein, 28 aa, Artificial Sequence
  Description of Artificial Sequence: Synthetic peptide
DEEEIQTTNIVATQQQGHVSTNLRRGGQ

SEQ ID NO: 37531 - protein, 30 aa, Artificial Sequence
  Description of Artificial Sequence: Synthetic polypeptide
SEDEIRTTNPVATETYGEVSENLQREGDDR

SEQ ID NO: 37532 - protein, 28 aa, Artificial Sequence
  Description of Artificial Sequence: Synthetic peptide
DIEEIRTTNIIATEQYGSWEQDLQRGNY

SEQ ID NO: 37533 - protein, 30 aa, Artificial Sequence
  Description of Artificial Sequence: Synthetic polypeptide
DENEIRTTNPVATEQWGSYSTNEMDRGNDA

SEQ ID NO: 37534 - protein, 28 aa, Artificial Sequence
  Description of Artificial Sequence: Synthetic peptide
DEQEIATTNPVATECYGSTSTDLQHGEN

SEQ ID NO: 37535 - protein, 28 aa, Artificial Sequence
  Description of Artificial Sequence: Synthetic peptide
DEEEIATTNPVASECYGSVSTELEQGLI

SEQ ID NO: 37536 - protein, 33 aa, Artificial Sequence
  Description of Artificial Sequence: Synthetic polypeptide
DEEEIRTTNPVATEQYGSVSTTNQELREGENDT

SEQ ID NO: 37537 - protein, 28 aa, Artificial Sequence
  Description of Artificial Sequence: Synthetic peptide
DEEEIRTTNPIASEQYGSVGTGDQGGMF

SEQ ID NO: 37538 - protein, 32 aa, Artificial Sequence
  Description of Artificial Sequence: Synthetic polypeptide
DEEEIRTTNPVATEQYGSVSETNLEDNEGEDD

SEQ ID NO: 37539 - protein, 28 aa, Artificial Sequence
  Description of Artificial Sequence: Synthetic peptide
DEEEIRTENDMAAAQYGLVSDNLQRGND

SEQ ID NO: 37540 - protein, 28 aa, Artificial Sequence
  Description of Artificial Sequence: Synthetic peptide
DEVEITTTNPVATEVYGSVSEALETGNG

SEQ ID NO: 37541 - protein, 33 aa, Artificial Sequence
  Description of Artificial Sequence: Synthetic polypeptide
DEEEIRTTNPVATEQYGSVSITGDLVENNGNDR

SEQ ID NO: 37542 - protein, 28 aa, Artificial Sequence
  Description of Artificial Sequence: Synthetic peptide
DEQEIATTNPTATEVYGCVGMNLQVGNR

SEQ ID NO: 37543 - protein, 28 aa, Artificial Sequence
  Description of Artificial Sequence: Synthetic peptide
DEEEIRTTNIVATEQYWSVETELEDGEI

SEQ ID NO: 37544 - protein, 28 aa, Artificial Sequence
  Description of Artificial Sequence: Synthetic peptide
AESELASTNPVSTELYGSVATNLQRGNR

SEQ ID NO: 37545 - protein, 32 aa, Artificial Sequence
  Description of Artificial Sequence: Synthetic polypeptide
DEEEIRTTNPVATEQYGSVSCTNPLDCNEGEN

SEQ ID NO: 37546 - protein, 29 aa, Artificial Sequence
  Description of Artificial Sequence: Synthetic peptide
VENEIRTTNPVATECYGSVSTELEIHGNH

SEQ ID NO: 37547 - protein, 33 aa, Artificial Sequence
  Description of Artificial Sequence: Synthetic polypeptide
DEEEIRTTNPVATEQYGSVDCTMNGLCCRGDNG

SEQ ID NO: 37548 - protein, 28 aa, Artificial Sequence
  Description of Artificial Sequence: Synthetic peptide
DEETITTTNNVATEIYGSVHTGAQRGAR

SEQ ID NO: 37549 - protein, 32 aa, Artificial Sequence
  Description of Artificial Sequence: Synthetic polypeptide
DEEEIRTTNPVATEQYGSVSDTELEINGEEDR

SEQ ID NO: 37550 - protein, 28 aa, Artificial Sequence
  Description of Artificial Sequence: Synthetic peptide
DEEEIRTTNPVATEQYGIASTAGEVGDL

SEQ ID NO: 37551 - protein, 28 aa, Artificial Sequence
  Description of Artificial Sequence: Synthetic peptide
DEEEVAATNIVASEIYGWVATNLQRGNR

SEQ ID NO: 37552 - protein, 28 aa, Artificial Sequence
  Description of Artificial Sequence: Synthetic peptide
DEEEIRTTNIVQTFIVGSRSTNLGRGNS

SEQ ID NO: 37553 - protein, 28 aa, Artificial Sequence
  Description of Artificial Sequence: Synthetic peptide
DEAEIVTTNPVATEQYGSVSMEEEVGNY

SEQ ID NO: 37554 - protein, 34 aa, Artificial Sequence
  Description of Artificial Sequence: Synthetic polypeptide
DEEEIRTTNPVATEQYGSVASTTDPLLDRNGDNR

SEQ ID NO: 37555 - protein, 28 aa, Artificial Sequence
  Description of Artificial Sequence: Synthetic peptide
MEEEIATTNPVATEQYGSASEDLQYGDD

SEQ ID NO: 37556 - protein, 32 aa, Artificial Sequence
  Description of Artificial Sequence: Synthetic polypeptide
DEEEIRTTNPVATMQYGSVSDTNLELPKGNED

SEQ ID NO: 37557 - protein, 34 aa, Artificial Sequence
  Description of Artificial Sequence: Synthetic polypeptide
DEEEIRTTNPVATEQYGSVSETEGLQVREGEEDR

SEQ ID NO: 37558 - protein, 33 aa, Artificial Sequence
  Description of Artificial Sequence: Synthetic polypeptide
DEEEIRTTNPVATEQYGSVDDVTNGGERKGINR

SEQ ID NO: 37559 - protein, 28 aa, Artificial Sequence
  Description of Artificial Sequence: Synthetic peptide
SEEEIRTTNPEATETYGCVSTNVQGGPI

SEQ ID NO: 37560 - protein, 28 aa, Artificial Sequence
  Description of Artificial Sequence: Synthetic peptide
DTEEIRITNEVATEQLGSTSTNMQNGNT

SEQ ID NO: 37561 - protein, 28 aa, Artificial Sequence
  Description of Artificial Sequence: Synthetic peptide
EEEEIRTTNIVAQEQVGSDSTNLQISNS

SEQ ID NO: 37562 - protein, 28 aa, Artificial Sequence
  Description of Artificial Sequence: Synthetic peptide
DEEEIAQTNPVATEQYGVVSENLEVGED

SEQ ID NO: 37563 - protein, 28 aa, Artificial Sequence
  Description of Artificial Sequence: Synthetic peptide
DEEEIETTNIVGMEQYTSVSTHLQGGNM

SEQ ID NO: 37564 - protein, 28 aa, Artificial Sequence
  Description of Artificial Sequence: Synthetic peptide
TEQEIATTNPVATECYGSTSTNLLHGND

SEQ ID NO: 37565 - protein, 28 aa, Artificial Sequence
  Description of Artificial Sequence: Synthetic peptide
DEQEIRTTNIVSTETYGEAACNLQRGNR

SEQ ID NO: 37566 - protein, 30 aa, Artificial Sequence
  Description of Artificial Sequence: Synthetic polypeptide
DEEEIAATNPVATECYGSVSENLQDQGDDR

SEQ ID NO: 37567 - protein, 28 aa, Artificial Sequence
  Description of Artificial Sequence: Synthetic peptide
DEQEIRTTNPTATEIYGSVSTAPYRGEI

SEQ ID NO: 37568 - protein, 28 aa, Artificial Sequence
  Description of Artificial Sequence: Synthetic peptide
DEEEIKTNNIVATERYGSVSNNLQSSNT

SEQ ID NO: 37569 - protein, 28 aa, Artificial Sequence
  Description of Artificial Sequence: Synthetic peptide
VEEEITATNPVATEIYGVVAMNLQRGTR

SEQ ID NO: 37570 - protein, 28 aa, Artificial Sequence
  Description of Artificial Sequence: Synthetic peptide
DEQEIRTTNIVATEQYGSVSTDLDDEEN

SEQ ID NO: 37571 - protein, 28 aa, Artificial Sequence
  Description of Artificial Sequence: Synthetic peptide
DEEEIRTTSNVASEHLTCVSDNLQRGNR

SEQ ID NO: 37572 - protein, 30 aa, Artificial Sequence
  Description of Artificial Sequence: Synthetic polypeptide
DEEEIRCTNPVASEIYGCVAATNLEREGNR

SEQ ID NO: 37573 - protein, 28 aa, Artificial Sequence
  Description of Artificial Sequence: Synthetic peptide
DEEELACVNIVATEVYGSVAMNLQRGNR

SEQ ID NO: 37574 - protein, 28 aa, Artificial Sequence
  Description of Artificial Sequence: Synthetic peptide
TEEEIITTNIVATNQYGSTSTNLVIGNA

SEQ ID NO: 37575 - protein, 29 aa, Artificial Sequence
  Description of Artificial Sequence: Synthetic peptide
DEHEIRTTNPVATEQYGVVDTMDLEAGNA

SEQ ID NO: 37576 - protein, 28 aa, Artificial Sequence
  Description of Artificial Sequence: Synthetic peptide
DEEEIRQTNIVVTLQGGSVSTHNQNGNR

SEQ ID NO: 37577 - protein, 28 aa, Artificial Sequence
  Description of Artificial Sequence: Synthetic peptide
DGEEINTTNLVATTQTRSVSTNIQTGNR

SEQ ID NO: 37578 - protein, 31 aa, Artificial Sequence
  Description of Artificial Sequence: Synthetic polypeptide
DENEIRTTNPVATEQYGWVSTNLQEIEGEDC

SEQ ID NO: 37579 - protein, 31 aa, Artificial Sequence
  Description of Artificial Sequence: Synthetic polypeptide
DEEEIRTTNPVATEQYGSVSDNLQEHDEEDN

SEQ ID NO: 37580 - protein, 28 aa, Artificial Sequence
  Description of Artificial Sequence: Synthetic peptide
DEEEIRTTNISATDQFGSVAENLQRQGR

SEQ ID NO: 37581 - protein, 30 aa, Artificial Sequence
  Description of Artificial Sequence: Synthetic polypeptide
SEVEIRATNPVATELYGSVISTNEQDRGNF

SEQ ID NO: 37582 - protein, 28 aa, Artificial Sequence
  Description of Artificial Sequence: Synthetic peptide
DEEEIRTTNPVAHMFYGCVSTGLDIGNE

SEQ ID NO: 37583 - protein, 28 aa, Artificial Sequence
  Description of Artificial Sequence: Synthetic peptide
DEEEIRTTNPCATEQYGCVSSEDCRLNH

SEQ ID NO: 37584 - protein, 31 aa, Artificial Sequence
  Description of Artificial Sequence: Synthetic polypeptide
DEEEIRTTNPVATECYGSTSTEDLQEPKGNI

SEQ ID NO: 37585 - protein, 34 aa, Artificial Sequence
  Description of Artificial Sequence: Synthetic polypeptide
DEEEIRTTNPVATEQYGSVESCTYPGLQIYGENR

SEQ ID NO: 37586 - protein, 28 aa, Artificial Sequence
  Description of Artificial Sequence: Synthetic peptide
DEEEIRTTNIVATEIFGSVDEDEQQGNR

SEQ ID NO: 37587 - protein, 28 aa, Artificial Sequence
  Description of Artificial Sequence: Synthetic peptide
AEEEIAQTNPVATEQYGVVSENQERGDR

SEQ ID NO: 37588 - protein, 28 aa, Artificial Sequence
  Description of Artificial Sequence: Synthetic peptide
YEEEIATVNPVCTEQYGVVSDNLQSGNQ

SEQ ID NO: 37589 - protein, 32 aa, Artificial Sequence
  Description of Artificial Sequence: Synthetic polypeptide
DEEEIATTNPVATEQYGDVSATTNQQLRGEND

SEQ ID NO: 37590 - protein, 28 aa, Artificial Sequence
  Description of Artificial Sequence: Synthetic peptide
DEEEIRTTNIVATECYGWVSTDLEQGEF

SEQ ID NO: 37591 - protein, 29 aa, Artificial Sequence
  Description of Artificial Sequence: Synthetic peptide
DEQEIRTTNPVATECWGSVSENLMIQGNL

SEQ ID NO: 37592 - protein, 29 aa, Artificial Sequence
  Description of Artificial Sequence: Synthetic peptide
DENEIRTTNPVATECWGIVSENLENGGNR

SEQ ID NO: 37593 - protein, 30 aa, Artificial Sequence
  Description of Artificial Sequence: Synthetic polypeptide
DEEEIRTTNPVASEQYGTVSTMDWQESGNT

SEQ ID NO: 37594 - protein, 31 aa, Artificial Sequence
  Description of Artificial Sequence: Synthetic polypeptide
DEEEIRTTNPVATEQYGSVSTDLEDVNGEDN

SEQ ID NO: 37595 - protein, 32 aa, Artificial Sequence
  Description of Artificial Sequence: Synthetic polypeptide
QEEEIATTNPVATECYGSVSTNLQETNGENDR

SEQ ID NO: 37596 - protein, 28 aa, Artificial Sequence
  Description of Artificial Sequence: Synthetic peptide
DEQEVATTNPIAYMMYGSVSTNLERGNR

SEQ ID NO: 37597 - protein, 28 aa, Artificial Sequence
  Description of Artificial Sequence: Synthetic peptide
DEEEIRTTNPHATEQYGSVHEPEMTGNP

SEQ ID NO: 37598 - protein, 28 aa, Artificial Sequence
  Description of Artificial Sequence: Synthetic peptide
DEEEIRTTNIVATEQYGDVATNLTTNSA

SEQ ID NO: 37599 - protein, 28 aa, Artificial Sequence
  Description of Artificial Sequence: Synthetic peptide
DENEITCTNPVCTEPYGSVATNLQYGND

SEQ ID NO: 37600 - protein, 28 aa, Artificial Sequence
  Description of Artificial Sequence: Synthetic peptide
DENEIAQTNPVATEQYGSVSTDQEDGNA

SEQ ID NO: 37601 - protein, 32 aa, Artificial Sequence
  Description of Artificial Sequence: Synthetic polypeptide
DEEEIRTTNPVATEQYGSVSCEMDLQCVGNDS

SEQ ID NO: 37602 - protein, 29 aa, Artificial Sequence
  Description of Artificial Sequence: Synthetic peptide
DEDEIRTTNPVSSEIYGCVSASNLERGNR

SEQ ID NO: 37603 - protein, 28 aa, Artificial Sequence
  Description of Artificial Sequence: Synthetic peptide
DEDDILTTNGVATRQYGSTHTNLQQGNR

SEQ ID NO: 37604 - protein, 28 aa, Artificial Sequence
  Description of Artificial Sequence: Synthetic peptide
DEEEIRTVNPVATEMYGSVSEDLDAGDD

SEQ ID NO: 37605 - protein, 28 aa, Artificial Sequence
  Description of Artificial Sequence: Synthetic peptide
QEEEIRTVNPVSTEQYGEVSTLVQHGNI

SEQ ID NO: 37606 - protein, 31 aa, Artificial Sequence
  Description of Artificial Sequence: Synthetic polypeptide
SEEEIRTTNPVATEQYGSVSTGNGPQVGETL

SEQ ID NO: 37607 - protein, 31 aa, Artificial Sequence
  Description of Artificial Sequence: Synthetic polypeptide
DEVEIATTNPTATEQYGSVSTMNEQIEGDNR

SEQ ID NO: 37608 - protein, 28 aa, Artificial Sequence
  Description of Artificial Sequence: Synthetic peptide
SEVEIRTTNPTATEQFGSVSENEQNGNF

SEQ ID NO: 37609 - protein, 29 aa, Artificial Sequence
  Description of Artificial Sequence: Synthetic peptide
DEEEIRTTNPVATEQWGSVSDADMQGNDS

SEQ ID NO: 37610 - protein, 28 aa, Artificial Sequence
  Description of Artificial Sequence: Synthetic peptide
SEQEISTTNPVGTEQYGSVSTNLNLGDD

SEQ ID NO: 37611 - protein, 29 aa, Artificial Sequence
  Description of Artificial Sequence: Synthetic peptide
MENEIRTTNPVATEQYGSVATELQEVGEL

SEQ ID NO: 37612 - protein, 30 aa, Artificial Sequence
  Description of Artificial Sequence: Synthetic polypeptide
DEEEIRATNPVATEQYGSVAENLEERGDDW

SEQ ID NO: 37613 - protein, 28 aa, Artificial Sequence
  Description of Artificial Sequence: Synthetic peptide
SEVEIATTNPVATECFGSVSENLQNGNA

SEQ ID NO: 37614 - protein, 28 aa, Artificial Sequence
  Description of Artificial Sequence: Synthetic peptide
DEEEIRTTNLGAWEQYGSDSTNLGQGTN

SEQ ID NO: 37615 - protein, 28 aa, Artificial Sequence
  Description of Artificial Sequence: Synthetic peptide
DENEIAQTNPCATEQYGVVSEDLQRGNA

SEQ ID NO: 37616 - protein, 33 aa, Artificial Sequence
  Description of Artificial Sequence: Synthetic polypeptide
DEEEIRTTNPVATEQYGSVISTCNGPQNGINTV

SEQ ID NO: 37617 - protein, 29 aa, Artificial Sequence
  Description of Artificial Sequence: Synthetic peptide
MENEIRTTNPVATECYGSVSENLQDSGDM

SEQ ID NO: 37618 - protein, 28 aa, Artificial Sequence
  Description of Artificial Sequence: Synthetic peptide
YSEEVRTTNPMATMQYGSVSCNLQAGNV

SEQ ID NO: 37619 - protein, 28 aa, Artificial Sequence
  Description of Artificial Sequence: Synthetic peptide
VEEEIRTTNPCATEQFGSVGYNLMRGPI

SEQ ID NO: 37620 - protein, 30 aa, Artificial Sequence
  Description of Artificial Sequence: Synthetic polypeptide
DEEEIRTTNPVATEQYGDVSENLQIHEEDI

SEQ ID NO: 37621 - protein, 31 aa, Artificial Sequence
  Description of Artificial Sequence: Synthetic polypeptide
SEEEIRTTNPTATEMYGSVISEMNLQQGNTR

SEQ ID NO: 37622 - protein, 33 aa, Artificial Sequence
  Description of Artificial Sequence: Synthetic polypeptide
DEEEIRTTNPVATEQYGSVESDTPNLDPNGENP

SEQ ID NO: 37623 - protein, 28 aa, Artificial Sequence
  Description of Artificial Sequence: Synthetic peptide
SEEEIRTTNPEATETYGEVSTNLDIGLQ

SEQ ID NO: 37624 - protein, 28 aa, Artificial Sequence
  Description of Artificial Sequence: Synthetic peptide
MENEIRTTNPVATEQYGWVSEDEQNGNM

SEQ ID NO: 37625 - protein, 30 aa, Artificial Sequence
  Description of Artificial Sequence: Synthetic polypeptide
DEEEIATTNPVATECYGSVSATDLEDRGEL

SEQ ID NO: 37626 - protein, 31 aa, Artificial Sequence
  Description of Artificial Sequence: Synthetic polypeptide
DEEEIMTTNPVATEQYGGVNTGNLQMQGNTE

SEQ ID NO: 37627 - protein, 28 aa, Artificial Sequence
  Description of Artificial Sequence: Synthetic peptide
DEEEIRTTNPVATEQYGDVSECPCHGEM

SEQ ID NO: 37628 - protein, 29 aa, Artificial Sequence
  Description of Artificial Sequence: Synthetic peptide
DENEIRTTNPVATECWGSVSENEQNRGTF

SEQ ID NO: 37629 - protein, 28 aa, Artificial Sequence
  Description of Artificial Sequence: Synthetic peptide
QEVEIATTNPVSTEQYGDVSENLQRGEY

SEQ ID NO: 37630 - protein, 28 aa, Artificial Sequence
  Description of Artificial Sequence: Synthetic peptide
DEEEIATVNPVATEIYGEVGENIQRGNL

SEQ ID NO: 37631 - protein, 31 aa, Artificial Sequence
  Description of Artificial Sequence: Synthetic polypeptide
DEEEIRTTNPVATEQYGSVSTCDQDCNEFEF

SEQ ID NO: 37632 - protein, 30 aa, Artificial Sequence
  Description of Artificial Sequence: Synthetic polypeptide
DEEEIRTTNPVATEQYGDVSECLQCHAGEL

SEQ ID NO: 37633 - protein, 32 aa, Artificial Sequence
  Description of Artificial Sequence: Synthetic polypeptide
DEEEIRTTNPVATEQYGSVSITEELEDNDGNL

SEQ ID NO: 37634 - protein, 28 aa, Artificial Sequence
  Description of Artificial Sequence: Synthetic peptide
MEQEISTTNPVATEQYGSVSDDLQNGEY

SEQ ID NO: 37635 - protein, 30 aa, Artificial Sequence
  Description of Artificial Sequence: Synthetic polypeptide
QEEEIRATNPVATEQYGVVSTDLQESGNDN

SEQ ID NO: 37636 - protein, 32 aa, Artificial Sequence
  Description of Artificial Sequence: Synthetic polypeptide
DEEEIRTTNPVATEQYGSVSTDPLQDTDGDDE

SEQ ID NO: 37637 - protein, 35 aa, Artificial Sequence
  Description of Artificial Sequence: Synthetic polypeptide
DEEEIRTTNPVATEQYGSVASTTDPNLLDRNGDNR

SEQ ID NO: 37638 - protein, 28 aa, Artificial Sequence
  Description of Artificial Sequence: Synthetic peptide
DEEEIRTTNPFATEQYGSVETPDDDGEW

SEQ ID NO: 37639 - protein, 32 aa, Artificial Sequence
  Description of Artificial Sequence: Synthetic polypeptide
DEEEIRTTNPTATEQYGSVSTGNEQDNEGDNE

SEQ ID NO: 37640 - protein, 33 aa, Artificial Sequence
  Description of Artificial Sequence: Synthetic polypeptide
DEEEIRTTNPVATEQYGSVSETNLEERDGEEDS

SEQ ID NO: 37641 - protein, 28 aa, Artificial Sequence
  Description of Artificial Sequence: Synthetic peptide
DEEEIRTTNIFATEQYGSVFTIDDDGER

SEQ ID NO: 37642 - protein, 34 aa, Artificial Sequence
  Description of Artificial Sequence: Synthetic polypeptide
DEEEIRTTNPVATEQYGSVISTANEQDREGVNTF

SEQ ID NO: 37643 - protein, 29 aa, Artificial Sequence
  Description of Artificial Sequence: Synthetic peptide
DDQEIRTTNPIAYEHYGVVSASNLQRGNR

SEQ ID NO: 37644 - protein, 32 aa, Artificial Sequence
  Description of Artificial Sequence: Synthetic polypeptide
DEEEIRTTNPVATEQYGSVSLTDTLQIQENNI

SEQ ID NO: 37645 - protein, 28 aa, Artificial Sequence
  Description of Artificial Sequence: Synthetic peptide
DEEEIRPTNPVATEIYGSVSTEPGDGDN

SEQ ID NO: 37646 - protein, 31 aa, Artificial Sequence
  Description of Artificial Sequence: Synthetic polypeptide
DEEEIRTTNPVATEQYGIVNDCNLQAEGYNW

SEQ ID NO: 37647 - protein, 28 aa, Artificial Sequence
  Description of Artificial Sequence: Synthetic peptide
DEEEITTTNPVATEVYGAVSDNEEVGNT

SEQ ID NO: 37648 - protein, 28 aa, Artificial Sequence
  Description of Artificial Sequence: Synthetic peptide
CEDELRQTNPVATEQYGVVSENLQHGNH

SEQ ID NO: 37649 - protein, 30 aa, Artificial Sequence
  Description of Artificial Sequence: Synthetic polypeptide
DDEEIRTTNPVATEMYGSVSTELEEYEGNS

SEQ ID NO: 37650 - protein, 30 aa, Artificial Sequence
  Description of Artificial Sequence: Synthetic polypeptide
DEEEIRTVNPVATECYGSVSTEPDEMRGMR

SEQ ID NO: 37651 - protein, 30 aa, Artificial Sequence
  Description of Artificial Sequence: Synthetic polypeptide
KEEEIRTTNPVATECYGSVSTELQETEGEM

SEQ ID NO: 37652 - protein, 31 aa, Artificial Sequence
  Description of Artificial Sequence: Synthetic polypeptide
DEEEIRATNPVATECYGSVSEANLQRGPDTV

SEQ ID NO: 37653 - protein, 33 aa, Artificial Sequence
  Description of Artificial Sequence: Synthetic polypeptide
DEEEIRTTNPVATEQYGSVSETNLEDHEGEEDR

SEQ ID NO: 37654 - protein, 28 aa, Artificial Sequence
  Description of Artificial Sequence: Synthetic peptide
DENEIRTVNPVATEQYGEAAEVLQRGGR

SEQ ID NO: 37655 - protein, 28 aa, Artificial Sequence
  Description of Artificial Sequence: Synthetic peptide
DEQEVRCTNPVATEIYGCVAMNLERGNR

SEQ ID NO: 37656 - protein, 30 aa, Artificial Sequence
  Description of Artificial Sequence: Synthetic polypeptide
MENEIRTTNPVATEQYGSVSTDLQNEGEDS

SEQ ID NO: 37657 - protein, 31 aa, Artificial Sequence
  Description of Artificial Sequence: Synthetic polypeptide
DEEEIRTTNPVATEAYGNVPSTNNLDLDGNW

SEQ ID NO: 37658 - protein, 30 aa, Artificial Sequence
  Description of Artificial Sequence: Synthetic polypeptide
SEVEIACTNPVATEQYGSVSENEQREGNDR

SEQ ID NO: 37659 - protein, 33 aa, Artificial Sequence
  Description of Artificial Sequence: Synthetic polypeptide
DEEEIRTTNPVATEQYGSVSDTNLQEIEGEEEH

SEQ ID NO: 37660 - protein, 28 aa, Artificial Sequence
  Description of Artificial Sequence: Synthetic peptide
DEEEVYTTNGVHTENYGSVMTGLQRGNG

SEQ ID NO: 37661 - protein, 33 aa, Artificial Sequence
  Description of Artificial Sequence: Synthetic polypeptide
AEEEIRTTNPVATEQYGVVDDTTNGLVQLRGNR

SEQ ID NO: 37662 - protein, 28 aa, Artificial Sequence
  Description of Artificial Sequence: Synthetic peptide
DEEEICTTNPVATEQYGSAPTVIQGGTI

SEQ ID NO: 37663 - protein, 28 aa, Artificial Sequence
  Description of Artificial Sequence: Synthetic peptide
DEDEIRTTNPVATEQYGGCSDTLQHGTT

SEQ ID NO: 37664 - protein, 32 aa, Artificial Sequence
  Description of Artificial Sequence: Synthetic polypeptide
DESEIRTTNPVATEQWGSVSTINEPQDRGENG

SEQ ID NO: 37665 - protein, 29 aa, Artificial Sequence
  Description of Artificial Sequence: Synthetic peptide
SEEEIAATNPVSTEQFGSVDSTNLQQGTR

SEQ ID NO: 37666 - protein, 28 aa, Artificial Sequence
  Description of Artificial Sequence: Synthetic peptide
DEEEIRTTNPEATEQYGSVSTCEEADEV

SEQ ID NO: 37667 - protein, 28 aa, Artificial Sequence
  Description of Artificial Sequence: Synthetic peptide
DEEEIAQTNPVATEQYGDVSTEPQIGEY

SEQ ID NO: 37668 - protein, 33 aa, Artificial Sequence
  Description of Artificial Sequence: Synthetic polypeptide
DEEEIRTTNPVATEIYGSVSETNGLQLDGENEL

SEQ ID NO: 37669 - protein, 31 aa, Artificial Sequence
  Description of Artificial Sequence: Synthetic polypeptide
DEEEIRTTNPVATEQYGDVASMELCVDGENR

SEQ ID NO: 37670 - protein, 28 aa, Artificial Sequence
  Description of Artificial Sequence: Synthetic peptide
NDAEIAATNPVATEQYGSVANNLQRGTR

SEQ ID NO: 37671 - protein, 30 aa, Artificial Sequence
  Description of Artificial Sequence: Synthetic polypeptide
MEEEIATTNPVATEMYGSVSENLQDTEGNM

SEQ ID NO: 37672 - protein, 28 aa, Artificial Sequence
  Description of Artificial Sequence: Synthetic peptide
HEEEIRTTNPIATEAYGSVSCTPQGGNH

SEQ ID NO: 37673 - protein, 31 aa, Artificial Sequence
  Description of Artificial Sequence: Synthetic polypeptide
MENEIRTTNPVATEQYGSVSTDLQDNEGNDM

SEQ ID NO: 37674 - protein, 31 aa, Artificial Sequence
  Description of Artificial Sequence: Synthetic polypeptide
DEEEIRTTNPVATEQYGSVDTMDLCDTNGNC

SEQ ID NO: 37675 - protein, 28 aa, Artificial Sequence
  Description of Artificial Sequence: Synthetic peptide
DEEEIRTTNPVATECYGDVSECLQHEEN

SEQ ID NO: 37676 - protein, 31 aa, Artificial Sequence
  Description of Artificial Sequence: Synthetic polypeptide
QEEEIATTNPVATEQYGWVSTNLQDFKGDDR

SEQ ID NO: 37677 - protein, 28 aa, Artificial Sequence
  Description of Artificial Sequence: Synthetic peptide
DTEEIRTTNPYATEQYGSVHTGEIEGNP

SEQ ID NO: 37678 - protein, 29 aa, Artificial Sequence
  Description of Artificial Sequence: Synthetic peptide
NEEEIRTTNPIATEWFGCVSMNLQFRGND

SEQ ID NO: 37679 - protein, 33 aa, Artificial Sequence
  Description of Artificial Sequence: Synthetic polypeptide
DEEEIRTTNPVATEQYGSVSLTDTLQIQEGNNI

SEQ ID NO: 37680 - protein, 28 aa, Artificial Sequence
  Description of Artificial Sequence: Synthetic peptide
QEVEIRATNPVATEMYGSVSTDLQSGDD

SEQ ID NO: 37681 - protein, 31 aa, Artificial Sequence
  Description of Artificial Sequence: Synthetic polypeptide
DEEEIRTTNPVATECYGHVSTGNNQRKENEL

SEQ ID NO: 37682 - protein, 28 aa, Artificial Sequence
  Description of Artificial Sequence: Synthetic peptide
DTEEIRTTNPYATEQYGSVHTGDIEGNP

SEQ ID NO: 37683 - protein, 28 aa, Artificial Sequence
  Description of Artificial Sequence: Synthetic peptide
QEAEIAQTNPVATEQYGWASDNLQRGGR

SEQ ID NO: 37684 - protein, 32 aa, Artificial Sequence
  Description of Artificial Sequence: Synthetic polypeptide
DEEEIRTTNPVATEQYGSVSETDQELNNGNDT

SEQ ID NO: 37685 - protein, 28 aa, Artificial Sequence
  Description of Artificial Sequence: Synthetic peptide
DENEIATTNPVATECYGSVSTDLEVGEL

SEQ ID NO: 37686 - protein, 31 aa, Artificial Sequence
  Description of Artificial Sequence: Synthetic polypeptide
DEEEIATTNPVATEQYGSVISENEQREGDTF

SEQ ID NO: 37687 - protein, 29 aa, Artificial Sequence
  Description of Artificial Sequence: Synthetic peptide
DENEIRTTNPVATECWGSVSTEDENRGNT

SEQ ID NO: 37688 - protein, 28 aa, Artificial Sequence
  Description of Artificial Sequence: Synthetic peptide
DEQEIRTTNIVATEQYGSVSTGDEIGEM

SEQ ID NO: 37689 - protein, 28 aa, Artificial Sequence
  Description of Artificial Sequence: Synthetic peptide
DENEIAQTNPVATEQYGSVSTDQENGND

SEQ ID NO: 37690 - protein, 28 aa, Artificial Sequence
  Description of Artificial Sequence: Synthetic peptide
HETEICSTNPVATEQYGNVATLLQRGNI

SEQ ID NO: 37691 - protein, 31 aa, Artificial Sequence
  Description of Artificial Sequence: Synthetic polypeptide
DEEEIRTTNPDATEQYGSVSTDNDVEGDGER

SEQ ID NO: 37692 - protein, 28 aa, Artificial Sequence
  Description of Artificial Sequence: Synthetic peptide
DETEIRTTNPVATEQYGTTSTEDETGNI

SEQ ID NO: 37693 - protein, 30 aa, Artificial Sequence
  Description of Artificial Sequence: Synthetic polypeptide
DEEEIRTTNPVATECYGSVSTELEEPKGEI

SEQ ID NO: 37694 - protein, 34 aa, Artificial Sequence
  Description of Artificial Sequence: Synthetic polypeptide
DEEEIRTTNPYATEQYGSVCSSTENGLVDRGMNR

SEQ ID NO: 37695 - protein, 32 aa, Artificial Sequence
  Description of Artificial Sequence: Synthetic polypeptide
DEEEIRTTNPVATEQYGDVSCEMDLQCRGNDM

SEQ ID NO: 37696 - protein, 32 aa, Artificial Sequence
  Description of Artificial Sequence: Synthetic polypeptide
DEEEIRTTNPVATECYGSVSATNLQDQNGEDL

SEQ ID NO: 37697 - protein, 30 aa, Artificial Sequence
  Description of Artificial Sequence: Synthetic polypeptide
DEHEICTTNPCATECYGSVSTNLQETNGNM

SEQ ID NO: 37698 - protein, 30 aa, Artificial Sequence
  Description of Artificial Sequence: Synthetic polypeptide
CEEEIRTTNPVATEQYGSVSTDLEDLEGDQ

SEQ ID NO: 37699 - protein, 29 aa, Artificial Sequence
  Description of Artificial Sequence: Synthetic peptide
MENEIRATNPVATEQYGSVSTDLQNGEDS

SEQ ID NO: 37700 - protein, 28 aa, Artificial Sequence
  Description of Artificial Sequence: Synthetic peptide
KEEEIRTTNPVATEQYGDVSELLQNEEL

SEQ ID NO: 37701 - protein, 32 aa, Artificial Sequence
  Description of Artificial Sequence: Synthetic polypeptide
DEEEIRTTNPVATEQYGSVSTDLELVNGENDC

SEQ ID NO: 37702 - protein, 28 aa, Artificial Sequence
  Description of Artificial Sequence: Synthetic peptide
DEEEVRTTNPCASEHYGCVSTNLEPPNR

SEQ ID NO: 37703 - protein, 30 aa, Artificial Sequence
  Description of Artificial Sequence: Synthetic polypeptide
DEEEISATNPCATEQYGEVSTTNLQLQGNF

SEQ ID NO: 37704 - protein, 28 aa, Artificial Sequence
  Description of Artificial Sequence: Synthetic peptide
DEHEIRCTNPVATEHYGAVSDNEQVGNA

SEQ ID NO: 37705 - protein, 31 aa, Artificial Sequence
  Description of Artificial Sequence: Synthetic polypeptide
DEEEIRTTNPVATEQYGSVSTDQEENNGNDS

SEQ ID NO: 37706 - protein, 29 aa, Artificial Sequence
  Description of Artificial Sequence: Synthetic peptide
DEVEIRTTNPVATEQYGSASDDDQMGNDN

SEQ ID NO: 37707 - protein, 30 aa, Artificial Sequence
  Description of Artificial Sequence: Synthetic polypeptide
DEEEIRTTNPVATEQYGEVSENEQCQGDDF

SEQ ID NO: 37708 - protein, 28 aa, Artificial Sequence
  Description of Artificial Sequence: Synthetic peptide
DEQEIRTTNPVATELWGSVSENEMQGNP

SEQ ID NO: 37709 - protein, 32 aa, Artificial Sequence
  Description of Artificial Sequence: Synthetic polypeptide
DEEEIRTTNPVATEQYGSVSTGEGDEQDGNDC

SEQ ID NO: 37710 - protein, 29 aa, Artificial Sequence
  Description of Artificial Sequence: Synthetic peptide
DEQEIRTTNPVATECWGSVSENLMMQGTR

SEQ ID NO: 37711 - protein, 30 aa, Artificial Sequence
  Description of Artificial Sequence: Synthetic polypeptide
DEEEIRTTNPVAYEQYGSYSEHLQIGDNDS

SEQ ID NO: 37712 - protein, 31 aa, Artificial Sequence
  Description of Artificial Sequence: Synthetic polypeptide
DEEEIATTNPVATECYGSVSATDLQEHEGNL

SEQ ID NO: 37713 - protein, 33 aa, Artificial Sequence
  Description of Artificial Sequence: Synthetic polypeptide
DEEEIRTTNPVATEQYGSVSTTNLEDDEGENDL

SEQ ID NO: 37714 - protein, 32 aa, Artificial Sequence
  Description of Artificial Sequence: Synthetic polypeptide
DEEEIRTTNPFATEQYGSVSIELNPQDRKGNS

SEQ ID NO: 37715 - protein, 28 aa, Artificial Sequence
  Description of Artificial Sequence: Synthetic peptide
DEEEIRTTNPYATEQYGSVHEGEMEGNP

SEQ ID NO: 37716 - protein, 30 aa, Artificial Sequence
  Description of Artificial Sequence: Synthetic polypeptide
AEEEITTTNPVATEQYGSVSTELEPKGEAR

SEQ ID NO: 37717 - protein, 28 aa, Artificial Sequence
  Description of Artificial Sequence: Synthetic peptide
YEQEIRTTNPVATDQYGSVSTEDTIGNV

SEQ ID NO: 37718 - protein, 32 aa, Artificial Sequence
  Description of Artificial Sequence: Synthetic polypeptide
DEEEIRTTNPVATEQYGSVSTPNPLFIDKGEP

SEQ ID NO: 37719 - protein, 32 aa, Artificial Sequence
  Description of Artificial Sequence: Synthetic polypeptide
DEEEIRTTNPVATEQYGSVSTNLEEHEGEEDF

SEQ ID NO: 37720 - protein, 28 aa, Artificial Sequence
  Description of Artificial Sequence: Synthetic peptide
DEEEIRTTNPFATEQYWSVETPLDPGEP

SEQ ID NO: 37721 - protein, 34 aa, Artificial Sequence
  Description of Artificial Sequence: Synthetic polypeptide
DEEEIRTTNPVATEQYGSVDCTMNLQDDEGENDR

SEQ ID NO: 37722 - protein, 28 aa, Artificial Sequence
  Description of Artificial Sequence: Synthetic peptide
QEPEIRTTNPVATEQYGWASENQQMGNT

SEQ ID NO: 37723 - protein, 28 aa, Artificial Sequence
  Description of Artificial Sequence: Synthetic peptide
SEEEIRTTNPVATELYGIVSTNDMLGDY

SEQ ID NO: 37724 - protein, 31 aa, Artificial Sequence
  Description of Artificial Sequence: Synthetic polypeptide
DEQEIATTNPVATEQYGSVDTNLCCHNGNDR

SEQ ID NO: 37725 - protein, 30 aa, Artificial Sequence
  Description of Artificial Sequence: Synthetic polypeptide
DEEEIRTTNPVATEQYGSVSELDPVQLGDS

SEQ ID NO: 37726 - protein, 28 aa, Artificial Sequence
  Description of Artificial Sequence: Synthetic peptide
DDEEIRTTNPDATEQYGSVSTADFQDNV

SEQ ID NO: 37727 - protein, 28 aa, Artificial Sequence
  Description of Artificial Sequence: Synthetic peptide
DEEEIATTNPVATEQYGEVSEVLQHEEK

SEQ ID NO: 37728 - protein, 32 aa, Artificial Sequence
  Description of Artificial Sequence: Synthetic polypeptide
DEEEIRTTNPCATEQYGSVSTEELEPQEGENG

SEQ ID NO: 37729 - protein, 32 aa, Artificial Sequence
  Description of Artificial Sequence: Synthetic polypeptide
DENEIRTTNPVATEQYGSVSTTDLVQVNGEND

SEQ ID NO: 37730 - protein, 30 aa, Artificial Sequence
  Description of Artificial Sequence: Synthetic polypeptide
MENEIRTTNPVATEQYGSVSTDLEDRGTDM

SEQ ID NO: 37731 - protein, 28 aa, Artificial Sequence
  Description of Artificial Sequence: Synthetic peptide
DEEEIRTTNPVATEQWGDVSENEMQGDM

SEQ ID NO: 37732 - protein, 28 aa, Artificial Sequence
  Description of Artificial Sequence: Synthetic peptide
DENEIVTTNPCATEQYGDVSTGLQRPTD

SEQ ID NO: 37733 - protein, 32 aa, Artificial Sequence
  Description of Artificial Sequence: Synthetic polypeptide
DEEEIRTTNPVATEQYGSVISTMNEPQDQGDF

SEQ ID NO: 37734 - protein, 28 aa, Artificial Sequence
  Description of Artificial Sequence: Synthetic peptide
DEEEIRTTNPSATEQYGSVSEDDDTGEM

SEQ ID NO: 37735 - protein, 28 aa, Artificial Sequence
  Description of Artificial Sequence: Synthetic peptide
DEDEIRSTNPVSYEQYGSVSTALMPGTR

SEQ ID NO: 37736 - protein, 29 aa, Artificial Sequence
  Description of Artificial Sequence: Synthetic peptide
DEEEIVTTNPVATEQYGDVSENLMHAGQQ

SEQ ID NO: 37737 - protein, 28 aa, Artificial Sequence
  Description of Artificial Sequence: Synthetic peptide
DEGEIECTNPCATEQYGTVATNLQRGMM

SEQ ID NO: 37738 - protein, 29 aa, Artificial Sequence
  Description of Artificial Sequence: Synthetic peptide
QEGEITTTNPVATECYGSVSTGNLQQGDP

SEQ ID NO: 37739 - protein, 30 aa, Artificial Sequence
  Description of Artificial Sequence: Synthetic polypeptide
DEQEIRCTNPVASEIYGCVSATNLEREGNR

SEQ ID NO: 37740 - protein, 28 aa, Artificial Sequence
  Description of Artificial Sequence: Synthetic peptide
DEETIAGTNPEATECYGSVSTNEQHGNF

SEQ ID NO: 37741 - protein, 29 aa, Artificial Sequence
  Description of Artificial Sequence: Synthetic peptide
DEGEIRMTNPVATEQYGCVSTQLQQGLDN

SEQ ID NO: 37742 - protein, 30 aa, Artificial Sequence
  Description of Artificial Sequence: Synthetic polypeptide
DEDEIRTTNPVATEQYGAVSTEDLCGGENA

SEQ ID NO: 37743 - protein, 28 aa, Artificial Sequence
  Description of Artificial Sequence: Synthetic peptide
GEEEVACTNPVASEQYGSVAMNLQRGNQ

SEQ ID NO: 37744 - protein, 33 aa, Artificial Sequence
  Description of Artificial Sequence: Synthetic polypeptide
DEEEIRTTNPTATEQYGSVSTCNEQDREGDNTE

SEQ ID NO: 37745 - protein, 28 aa, Artificial Sequence
  Description of Artificial Sequence: Synthetic peptide
DEGEIRQTNPVATESYGNISTNPQGGNQ

SEQ ID NO: 37746 - protein, 28 aa, Artificial Sequence
  Description of Artificial Sequence: Synthetic peptide
AEVEIAATNPVATENYGWVATNLQRGTR

SEQ ID NO: 37747 - protein, 31 aa, Artificial Sequence
  Description of Artificial Sequence: Synthetic polypeptide
AEQEIVTTNPVATEQYGSVSTGNLEINGVNR

SEQ ID NO: 37748 - protein, 29 aa, Artificial Sequence
  Description of Artificial Sequence: Synthetic peptide
DEQEIRTTNPVATELWGSVSTNDMNQGNW

SEQ ID NO: 37749 - protein, 29 aa, Artificial Sequence
  Description of Artificial Sequence: Synthetic peptide
DEEEIRTTNPVATEQYGEASDDLQDQGEV

SEQ ID NO: 37750 - protein, 30 aa, Artificial Sequence
  Description of Artificial Sequence: Synthetic polypeptide
DEQEVRTTNPVATEIYGCVSAMNLERNGNR

SEQ ID NO: 37751 - protein, 30 aa, Artificial Sequence
  Description of Artificial Sequence: Synthetic polypeptide
DEEEIKTTNPVATEFYGSVSTMDIQHFGNQ

SEQ ID NO: 37752 - protein, 32 aa, Artificial Sequence
  Description of Artificial Sequence: Synthetic polypeptide
DEEEIRTTNPVATEQYGSVSTGLEDDEGENDL

SEQ ID NO: 37753 - protein, 28 aa, Artificial Sequence
  Description of Artificial Sequence: Synthetic peptide
QEEEITTTNPVATECYGWVSTDLEQGNA

SEQ ID NO: 37754 - protein, 31 aa, Artificial Sequence
  Description of Artificial Sequence: Synthetic polypeptide
DEEEIATTNPVATECYGSVSTDLQDTKGEDR

SEQ ID NO: 37755 - protein, 29 aa, Artificial Sequence
  Description of Artificial Sequence: Synthetic peptide
AENEIRTTNPVATEQYGIVSAENLQWMQR

SEQ ID NO: 37756 - protein, 30 aa, Artificial Sequence
  Description of Artificial Sequence: Synthetic polypeptide
DDDEIRTTNPVATELYGSVSMEDFQREGNR

SEQ ID NO: 37757 - protein, 28 aa, Artificial Sequence
  Description of Artificial Sequence: Synthetic peptide
DEEEIAATNPTATEQYGGVSENPQVGNA

SEQ ID NO: 37758 - protein, 28 aa, Artificial Sequence
  Description of Artificial Sequence: Synthetic peptide
DESEIAATNIVSTENYGCVGTNLQRGNR

SEQ ID NO: 37759 - protein, 28 aa, Artificial Sequence
  Description of Artificial Sequence: Synthetic peptide
DEEEIATTNPVAHEIYGIVSTNWQIGDF

SEQ ID NO: 37760 - protein, 28 aa, Artificial Sequence
  Description of Artificial Sequence: Synthetic peptide
QEQEITTTNPVATEQYGSVSTELEDGEL

SEQ ID NO: 37761 - protein, 28 aa, Artificial Sequence
  Description of Artificial Sequence: Synthetic peptide
DEEDLGTTNIVAREQYGSVSENLQRSNG

SEQ ID NO: 37762 - protein, 31 aa, Artificial Sequence
  Description of Artificial Sequence: Synthetic polypeptide
DEQEIRTTNPVATEQYGSVSATDLQDHEGEL

SEQ ID NO: 37763 - protein, 31 aa, Artificial Sequence
  Description of Artificial Sequence: Synthetic polypeptide
QEEEIRTTNPVATEQYGSVGTCDLQERDPMR

SEQ ID NO: 37764 - protein, 33 aa, Artificial Sequence
  Description of Artificial Sequence: Synthetic polypeptide
DEEEIRTTNPVATEQYGSVSETNLEDPDGENDH

SEQ ID NO: 37765 - protein, 32 aa, Artificial Sequence
  Description of Artificial Sequence: Synthetic polypeptide
DEEEIATTNPVATEQYGSVSTMNEQLNEGDNV

SEQ ID NO: 37766 - protein, 31 aa, Artificial Sequence
  Description of Artificial Sequence: Synthetic polypeptide
DEEEIRTTNPVATEQYGSVSENLQEHDEEDN

SEQ ID NO: 37767 - protein, 28 aa, Artificial Sequence
  Description of Artificial Sequence: Synthetic peptide
QEEEIATTNCVATEQYGVVSTNWQPGMD

SEQ ID NO: 37768 - protein, 28 aa, Artificial Sequence
  Description of Artificial Sequence: Synthetic peptide
DEEGWNTTNIVATEQYGSISDYLQRGNE

SEQ ID NO: 37769 - protein, 30 aa, Artificial Sequence
  Description of Artificial Sequence: Synthetic polypeptide
DEDEIRTTNPVASEQYGCVGAMNLERNGNR

SEQ ID NO: 37770 - protein, 30 aa, Artificial Sequence
  Description of Artificial Sequence: Synthetic polypeptide
DEEEICTTNPVATEQYGDVSEANLQHGPDI

SEQ ID NO: 37771 - protein, 28 aa, Artificial Sequence
  Description of Artificial Sequence: Synthetic peptide
CEQEINTTNPVATEGFGSISENLQRGER

SEQ ID NO: 37772 - protein, 28 aa, Artificial Sequence
  Description of Artificial Sequence: Synthetic peptide
MEEEIRTTNPVATEQYGDVSEELQHEEM

SEQ ID NO: 37773 - protein, 28 aa, Artificial Sequence
  Description of Artificial Sequence: Synthetic peptide
DEEEVATTNPIAYEMYGSVSTAYQRGPR

SEQ ID NO: 37774 - protein, 31 aa, Artificial Sequence
  Description of Artificial Sequence: Synthetic polypeptide
DEHEIRTTNPVATEQYGSVDCEMNLQHNGNA

SEQ ID NO: 37775 - protein, 28 aa, Artificial Sequence
  Description of Artificial Sequence: Synthetic peptide
DEEEIVTTNPDATEQYGSVSTVDENGDF

SEQ ID NO: 37776 - protein, 28 aa, Artificial Sequence
  Description of Artificial Sequence: Synthetic peptide
DEQEIMTTNPVATEQYGEVSENDQQLNA

SEQ ID NO: 37777 - protein, 28 aa, Artificial Sequence
  Description of Artificial Sequence: Synthetic peptide
DENEIRTTNPVATEWYGIVTEEEQRGNF

SEQ ID NO: 37778 - protein, 33 aa, Artificial Sequence
  Description of Artificial Sequence: Synthetic polypeptide
DEEEIATTNPVATEQYGSVDSTNGLVERGEEDR

SEQ ID NO: 37779 - protein, 28 aa, Artificial Sequence
  Description of Artificial Sequence: Synthetic peptide
DECEITCTNPVATEQYGSVSEALQWGDL

SEQ ID NO: 37780 - protein, 28 aa, Artificial Sequence
  Description of Artificial Sequence: Synthetic peptide
DEDEICTTNPTATEQFGGVSENWQQGNR

SEQ ID NO: 37781 - protein, 28 aa, Artificial Sequence
  Description of Artificial Sequence: Synthetic peptide
QEDVIRTTNIVATSQYGHVSTNLQRNDR

SEQ ID NO: 37782 - protein, 29 aa, Artificial Sequence
  Description of Artificial Sequence: Synthetic peptide
DEEEIRTTNPVATECWGSYSTNEMMQGNM

SEQ ID NO: 37783 - protein, 30 aa, Artificial Sequence
  Description of Artificial Sequence: Synthetic polypeptide
VEEEIRTTNPVATEQYGCVGMNLQDRLTER

SEQ ID NO: 37784 - protein, 29 aa, Artificial Sequence
  Description of Artificial Sequence: Synthetic peptide
DEEEIATTNPVATEQYGDVSENLMHAGQQ

SEQ ID NO: 37785 - protein, 30 aa, Artificial Sequence
  Description of Artificial Sequence: Synthetic polypeptide
DENEIRTVNPVATEQYGSMSTDLQDLEGNF

SEQ ID NO: 37786 - protein, 33 aa, Artificial Sequence
  Description of Artificial Sequence: Synthetic polypeptide
DEEEIRTTNPTATEQYGSVISTENGEPQRGINQ

SEQ ID NO: 37787 - protein, 31 aa, Artificial Sequence
  Description of Artificial Sequence: Synthetic polypeptide
DEEEIATTNPTATEQYGSVSTMNEQDNGDNL

SEQ ID NO: 37788 - protein, 31 aa, Artificial Sequence
  Description of Artificial Sequence: Synthetic polypeptide
QENEIRTTNPVATECYGVVSTNLQMREGEND

SEQ ID NO: 37789 - protein, 28 aa, Artificial Sequence
  Description of Artificial Sequence: Synthetic peptide
SDEEIATTNPVATEMYGSVNTNLMVGNS

SEQ ID NO: 37790 - protein, 30 aa, Artificial Sequence
  Description of Artificial Sequence: Synthetic polypeptide
DEEEIRTTNPVATEQWGSVDTNDMWVGNDF

SEQ ID NO: 37791 - protein, 29 aa, Artificial Sequence
  Description of Artificial Sequence: Synthetic peptide
DEAEIAQTNPVATEMYGSTSCNLQSRGNY

SEQ ID NO: 37792 - protein, 29 aa, Artificial Sequence
  Description of Artificial Sequence: Synthetic peptide
DEEEIATTNPVATEQYGEVSEVLQHAEER

SEQ ID NO: 37793 - protein, 28 aa, Artificial Sequence
  Description of Artificial Sequence: Synthetic peptide
DEEEIRTTNITIAKQYGSVSENLDGGNR

SEQ ID NO: 37794 - protein, 28 aa, Artificial Sequence
  Description of Artificial Sequence: Synthetic peptide
DEEEIEFTNITATDQYGSGSTNLYTGNR

SEQ ID NO: 37795 - protein, 28 aa, Artificial Sequence
  Description of Artificial Sequence: Synthetic peptide
DENEIRAVNPVATECYGSVSTDLQQGEM

SEQ ID NO: 37796 - protein, 30 aa, Artificial Sequence
  Description of Artificial Sequence: Synthetic polypeptide
DEEEIRATNPVATETYGSASMMDNLEAGNR

SEQ ID NO: 37797 - protein, 28 aa, Artificial Sequence
  Description of Artificial Sequence: Synthetic peptide
DENEIRTTNPVATECWGSVSENLMTGTF

SEQ ID NO: 37798 - protein, 33 aa, Artificial Sequence
  Description of Artificial Sequence: Synthetic polypeptide
DEEEIRTTNPVATEQYWSVETPNPLPQRGDEPR

SEQ ID NO: 37799 - protein, 28 aa, Artificial Sequence
  Description of Artificial Sequence: Synthetic peptide
DEEEIRTTNPVATEQYGDVWTTDQSEEA

SEQ ID NO: 37800 - protein, 30 aa, Artificial Sequence
  Description of Artificial Sequence: Synthetic polypeptide
DEEEIRTTNPVATEQYGSVSCEDWCHGNDA

SEQ ID NO: 37801 - protein, 28 aa, Artificial Sequence
  Description of Artificial Sequence: Synthetic peptide
DESEIATTNPVATEGYGVMASTLQRGNI

SEQ ID NO: 37802 - protein, 29 aa, Artificial Sequence
  Description of Artificial Sequence: Synthetic peptide
DENEIGTTNPVATEMYGTASCVLQRAGNR

SEQ ID NO: 37803 - protein, 31 aa, Artificial Sequence
  Description of Artificial Sequence: Synthetic polypeptide
QEEEIRTTNPVATECYGSVSANNLEERNGER

SEQ ID NO: 37804 - protein, 32 aa, Artificial Sequence
  Description of Artificial Sequence: Synthetic polypeptide
DEEEIRTTNPVATEQYGSVSATGLELVEGNDD

SEQ ID NO: 37805 - protein, 28 aa, Artificial Sequence
  Description of Artificial Sequence: Synthetic peptide
DEAEIATTNPVATEVYGDVSDNIQFGNF

SEQ ID NO: 37806 - protein, 28 aa, Artificial Sequence
  Description of Artificial Sequence: Synthetic peptide
DEEEIRCTNPVATEQYGSSSTPPEQGPS

SEQ ID NO: 37807 - protein, 34 aa, Artificial Sequence
  Description of Artificial Sequence: Synthetic polypeptide
DEEEIRTTNPVATEQYGSVDSITNPLPEDRDGER

SEQ ID NO: 37808 - protein, 33 aa, Artificial Sequence
  Description of Artificial Sequence: Synthetic polypeptide
DEEEIRTTNPVATEQYGSVSTMNPQLIEGDNDF

SEQ ID NO: 37809 - protein, 30 aa, Artificial Sequence
  Description of Artificial Sequence: Synthetic polypeptide
QEEEIRSTNPCATEQYGSVSTDLQLDNGND

SEQ ID NO: 37810 - protein, 28 aa, Artificial Sequence
  Description of Artificial Sequence: Synthetic peptide
SEVEIATTNPVATEMYGEVSTNEQQGNF

SEQ ID NO: 37811 - protein, 28 aa, Artificial Sequence
  Description of Artificial Sequence: Synthetic peptide
DDEEVACTNPVASEQYGSVSMNLQRLNQ

SEQ ID NO: 37812 - protein, 28 aa, Artificial Sequence
  Description of Artificial Sequence: Synthetic peptide
DEQEIRTTNPVATEQWGSVDENEMQGNW

SEQ ID NO: 37813 - protein, 29 aa, Artificial Sequence
  Description of Artificial Sequence: Synthetic peptide
DEEEISTTNPVATEQYGDVSEDLQDGEDA

SEQ ID NO: 37814 - protein, 30 aa, Artificial Sequence
  Description of Artificial Sequence: Synthetic polypeptide
DEEEIRTTNPVATEQYGDVSENLQTSEEDN

SEQ ID NO: 37815 - protein, 31 aa, Artificial Sequence
  Description of Artificial Sequence: Synthetic polypeptide
DEEEIRTTNPVATECYGVVSTEELQEINGNE

SEQ ID NO: 37816 - protein, 33 aa, Artificial Sequence
  Description of Artificial Sequence: Synthetic polypeptide
DEEEIRTTNPDATEQYGSVASTGLVIEREGVNR

SEQ ID NO: 37817 - protein, 28 aa, Artificial Sequence
  Description of Artificial Sequence: Synthetic peptide
DEEEIRSTNPVATEVYGGVSIELNVGPR

SEQ ID NO: 37818 - protein, 32 aa, Artificial Sequence
  Description of Artificial Sequence: Synthetic polypeptide
DEVEIATTNPTATEQYGSVSTGNPQLQEGDNR

SEQ ID NO: 37819 - protein, 28 aa, Artificial Sequence
  Description of Artificial Sequence: Synthetic peptide
DWEEIQTNNIVDTEQYGTVSTNLGRGNG

SEQ ID NO: 37820 - protein, 32 aa, Artificial Sequence
  Description of Artificial Sequence: Synthetic polypeptide
DEEEIRTTNPVATEQYGSVDSTNPDQDAGEPD

SEQ ID NO: 37821 - protein, 28 aa, Artificial Sequence
  Description of Artificial Sequence: Synthetic peptide
DETEIRATNPVATEQYGDVSTQEQLNNE

SEQ ID NO: 37822 - protein, 28 aa, Artificial Sequence
  Description of Artificial Sequence: Synthetic peptide
AEAEISTTNPVATECYGNVGTNLQRGTQ

SEQ ID NO: 37823 - protein, 32 aa, Artificial Sequence
  Description of Artificial Sequence: Synthetic polypeptide
DEEEIRTTNPVATEQYGNVSSTGNPGQDMGNF

SEQ ID NO: 37824 - protein, 33 aa, Artificial Sequence
  Description of Artificial Sequence: Synthetic polypeptide
DEEEITTTNPVATEQYGSVSETNLQVQNGENDH

SEQ ID NO: 37825 - protein, 28 aa, Artificial Sequence
  Description of Artificial Sequence: Synthetic peptide
DEEEIRTTNLFATEQYGSVDTIDEDGER

SEQ ID NO: 37826 - protein, 30 aa, Artificial Sequence
  Description of Artificial Sequence: Synthetic polypeptide
DEREIVATNPVSTEQYGSVSENLQRGGADR

SEQ ID NO: 37827 - protein, 28 aa, Artificial Sequence
  Description of Artificial Sequence: Synthetic peptide
DEVEIVTTNPVATECYGSASTDLQTGEI

SEQ ID NO: 37828 - protein, 28 aa, Artificial Sequence
  Description of Artificial Sequence: Synthetic peptide
DEEEIASTNPVATEMYGEVACILQRGGR

SEQ ID NO: 37829 - protein, 30 aa, Artificial Sequence
  Description of Artificial Sequence: Synthetic polypeptide
DEEEIRTTNPVATEQYGDVSENLQEHEEDM

SEQ ID NO: 37830 - protein, 28 aa, Artificial Sequence
  Description of Artificial Sequence: Synthetic peptide
DENEIRATNPVATECYGVVSTDLQQGEM

SEQ ID NO: 37831 - protein, 28 aa, Artificial Sequence
  Description of Artificial Sequence: Synthetic peptide
SEEEIAATNPVATEQFGGVSENLQQGNF

SEQ ID NO: 37832 - protein, 28 aa, Artificial Sequence
  Description of Artificial Sequence: Synthetic peptide
DEQEIRTTNPVATEQWGSVDENEELGNF

SEQ ID NO: 37833 - protein, 30 aa, Artificial Sequence
  Description of Artificial Sequence: Synthetic polypeptide
DEEEIATVNPVATEQYGEASTVLQSRAGGR

SEQ ID NO: 37834 - protein, 28 aa, Artificial Sequence
  Description of Artificial Sequence: Synthetic peptide
DEEEIRATNPECTELYGCVSTNLQSGDV

SEQ ID NO: 37835 - protein, 34 aa, Artificial Sequence
  Description of Artificial Sequence: Synthetic polypeptide
DEEEIRTTNPVATEQYGSVSCTGNLQYVDGENDC

SEQ ID NO: 37836 - protein, 28 aa, Artificial Sequence
  Description of Artificial Sequence: Synthetic peptide
DEVEIAATNPTATEQYGSVSENEQQGNF

SEQ ID NO: 37837 - protein, 31 aa, Artificial Sequence
  Description of Artificial Sequence: Synthetic polypeptide
DEEEIRTTNPVATEQYGSVSEENEQDEDGDH

SEQ ID NO: 37838 - protein, 28 aa, Artificial Sequence
  Description of Artificial Sequence: Synthetic peptide
AEEEIVTTNPFATEQYGEVSTDPQGGDR

SEQ ID NO: 37839 - protein, 28 aa, Artificial Sequence
  Description of Artificial Sequence: Synthetic peptide
DENEIATTNPVATECYGSVSTDLEHGEL

SEQ ID NO: 37840 - protein, 28 aa, Artificial Sequence
  Description of Artificial Sequence: Synthetic peptide
QEHEISQTNPVATEQYGWVSTNLQNGEG

SEQ ID NO: 37841 - protein, 30 aa, Artificial Sequence
  Description of Artificial Sequence: Synthetic polypeptide
DEEEIRTTNPVATEQYGEVSACQLQQSGQL

SEQ ID NO: 37842 - protein, 28 aa, Artificial Sequence
  Description of Artificial Sequence: Synthetic peptide
DEDEICCTNPVATEQFGSVSENWQQGNT

SEQ ID NO: 37843 - protein, 28 aa, Artificial Sequence
  Description of Artificial Sequence: Synthetic peptide
DEEEIRTTNIDATEQYWSVETNEDRGEI

SEQ ID NO: 37844 - protein, 32 aa, Artificial Sequence
  Description of Artificial Sequence: Synthetic polypeptide
DEEEIRTTNPVATEQYGSVSATDGPVEREGND

SEQ ID NO: 37845 - protein, 31 aa, Artificial Sequence
  Description of Artificial Sequence: Synthetic polypeptide
DEEEIRTTNPVATEQYGSVDTDGDPQPGEDR

SEQ ID NO: 37846 - protein, 28 aa, Artificial Sequence
  Description of Artificial Sequence: Synthetic peptide
SEEEIRTTNPTATEIFGSVSTNPQFGTE

SEQ ID NO: 37847 - protein, 31 aa, Artificial Sequence
  Description of Artificial Sequence: Synthetic polypeptide
DEEEIRTTNPVATEQYGDVSTANEQNLEPDR

SEQ ID NO: 37848 - protein, 35 aa, Artificial Sequence
  Description of Artificial Sequence: Synthetic polypeptide
DEEEIRTTNPVATEQYGSVDSETNLPLPREGLNDR

SEQ ID NO: 37849 - protein, 30 aa, Artificial Sequence
  Description of Artificial Sequence: Synthetic polypeptide
DEEEIRTTNPVATEQYGDVSECLQEHAGEL

SEQ ID NO: 37850 - protein, 28 aa, Artificial Sequence
  Description of Artificial Sequence: Synthetic peptide
DEEEIRTTNPFATEQYGSVETPDDPGEP

SEQ ID NO: 37851 - protein, 31 aa, Artificial Sequence
  Description of Artificial Sequence: Synthetic polypeptide
DEEEIRTTNPVATEQYGVVSCENEQQEGNDL

SEQ ID NO: 37852 - protein, 28 aa, Artificial Sequence
  Description of Artificial Sequence: Synthetic peptide
DENEIRCTNPVSTECYGSVSENLQLGTS

SEQ ID NO: 37853 - protein, 31 aa, Artificial Sequence
  Description of Artificial Sequence: Synthetic polypeptide
SEEEIRTTNPVATEQYGSVISDNLPQVGPTI

SEQ ID NO: 37854 - protein, 30 aa, Artificial Sequence
  Description of Artificial Sequence: Synthetic polypeptide
DEEEIRTTNPVATEQYGSVDDALCTGGNDE

SEQ ID NO: 37855 - protein, 34 aa, Artificial Sequence
  Description of Artificial Sequence: Synthetic polypeptide
DEEEIRTTNPVATEQYGSVSITCNDVQDRKGDNF

SEQ ID NO: 37856 - protein, 28 aa, Artificial Sequence
  Description of Artificial Sequence: Synthetic peptide
DDQEIRTTNPCATEQYGCVATNLERPND

SEQ ID NO: 37857 - protein, 32 aa, Artificial Sequence
  Description of Artificial Sequence: Synthetic polypeptide
DEEEIRTTNPVATEQYGSVSTNLEEIEGEEDF

SEQ ID NO: 37858 - protein, 34 aa, Artificial Sequence
  Description of Artificial Sequence: Synthetic polypeptide
DEEEIRTTNPFATEQYGSVSVTNGLVDLRGENPR

SEQ ID NO: 37859 - protein, 31 aa, Artificial Sequence
  Description of Artificial Sequence: Synthetic polypeptide
DENEIATTNPVATEQYGSVSTELQIDKGNDD

SEQ ID NO: 37860 - protein, 31 aa, Artificial Sequence
  Description of Artificial Sequence: Synthetic polypeptide
MEEEIRTTNPVATECYGSVSTDLQDNEGNDM

SEQ ID NO: 37861 - protein, 28 aa, Artificial Sequence
  Description of Artificial Sequence: Synthetic peptide
DEEEIRTTNPCATELYGSVGTDDEAGNM

SEQ ID NO: 37862 - protein, 28 aa, Artificial Sequence
  Description of Artificial Sequence: Synthetic peptide
DEQEIRTTNPVATEQYGSVETDDEHGEF

SEQ ID NO: 37863 - protein, 28 aa, Artificial Sequence
  Description of Artificial Sequence: Synthetic peptide
DEEEIRTTNPFATEQYGSVHTPDFDGEP

SEQ ID NO: 37864 - protein, 33 aa, Artificial Sequence
  Description of Artificial Sequence: Synthetic polypeptide
DEEEIRTTNPVATEQYGSVISTANLPCNGDNCF

SEQ ID NO: 37865 - protein, 30 aa, Artificial Sequence
  Description of Artificial Sequence: Synthetic polypeptide
QEAEIASTNPVATEQYGSVSEMNLQERGDR

SEQ ID NO: 37866 - protein, 28 aa, Artificial Sequence
  Description of Artificial Sequence: Synthetic peptide
QENEIGTTNPVSTEIYGDVSTNLQNGNH

SEQ ID NO: 37867 - protein, 28 aa, Artificial Sequence
  Description of Artificial Sequence: Synthetic peptide
DEEEIRTTNPVATEQYGDVSECPQHEEL

SEQ ID NO: 37868 - protein, 28 aa, Artificial Sequence
  Description of Artificial Sequence: Synthetic peptide
DEMEICTTNPVATEQYGQVSTPDQMGDQ

SEQ ID NO: 37869 - protein, 29 aa, Artificial Sequence
  Description of Artificial Sequence: Synthetic peptide
QEEEIATVNPVATEVYGSVSEVLQHAGNR

SEQ ID NO: 37870 - protein, 28 aa, Artificial Sequence
  Description of Artificial Sequence: Synthetic peptide
DEEEISTTNPVATEQYGFASTGQQHGME

SEQ ID NO: 37871 - protein, 28 aa, Artificial Sequence
  Description of Artificial Sequence: Synthetic peptide
DENEIMTTNPTATEQYGSVSTEVQSGDF

SEQ ID NO: 37872 - protein, 30 aa, Artificial Sequence
  Description of Artificial Sequence: Synthetic polypeptide
DEVEISTTNPVATEQYGSVSATADQIGENF

SEQ ID NO: 37873 - protein, 28 aa, Artificial Sequence
  Description of Artificial Sequence: Synthetic peptide
DEVEIRCTNPVATEQYGDVSTDPNPGNY

SEQ ID NO: 37874 - protein, 28 aa, Artificial Sequence
  Description of Artificial Sequence: Synthetic peptide
DEECIKTTNIVATEQTGSIHTNLQSGNT

SEQ ID NO: 37875 - protein, 29 aa, Artificial Sequence
  Description of Artificial Sequence: Synthetic peptide
DEQEIRTTNPVATELWGSVSENDMNQGNW

SEQ ID NO: 37876 - protein, 28 aa, Artificial Sequence
  Description of Artificial Sequence: Synthetic peptide
DEEQIETTNIVRQEQYGSVSTNKYRGHD

SEQ ID NO: 37877 - protein, 28 aa, Artificial Sequence
  Description of Artificial Sequence: Synthetic peptide
DEEEIRTTNNIALEQYGNISMGIQRDNR

SEQ ID NO: 37878 - protein, 31 aa, Artificial Sequence
  Description of Artificial Sequence: Synthetic polypeptide
DEEEIRTTNPEATEQYGSVSTEAQVEDEGDF

SEQ ID NO: 37879 - protein, 28 aa, Artificial Sequence
  Description of Artificial Sequence: Synthetic peptide
DEEEINTTSNITTEQTLRVSTNLQGGNR

SEQ ID NO: 37880 - protein, 31 aa, Artificial Sequence
  Description of Artificial Sequence: Synthetic polypeptide
DEEEIRTTNPEATEGYGSVSTGPPLGSGENH

SEQ ID NO: 37881 - protein, 28 aa, Artificial Sequence
  Description of Artificial Sequence: Synthetic peptide
DEEEIDTTNITATEIYLSVASRLGRGNR

SEQ ID NO: 37882 - protein, 33 aa, Artificial Sequence
  Description of Artificial Sequence: Synthetic polypeptide
DEEEIATTNPVATEQYGSVSTTPQELREGENDT

SEQ ID NO: 37883 - protein, 34 aa, Artificial Sequence
  Description of Artificial Sequence: Synthetic polypeptide
DEEEIRTTNPVATEQYGSVSDTTGLELDNGENDR

SEQ ID NO: 37884 - protein, 28 aa, Artificial Sequence
  Description of Artificial Sequence: Synthetic peptide
DEEEIRTTNIVANIQIGSVRTNETNLNR

SEQ ID NO: 37885 - protein, 28 aa, Artificial Sequence
  Description of Artificial Sequence: Synthetic peptide
DSREISTTNIVATRQYGENSTNIQRGNT

SEQ ID NO: 37886 - protein, 28 aa, Artificial Sequence
  Description of Artificial Sequence: Synthetic peptide
DGEEIITTLSVATEQYGEVSTNIGGGGR

SEQ ID NO: 37887 - protein, 28 aa, Artificial Sequence
  Description of Artificial Sequence: Synthetic peptide
DEWEIRGTNIVATEWIGSVWDYLQSGNR

SEQ ID NO: 37888 - protein, 30 aa, Artificial Sequence
  Description of Artificial Sequence: Synthetic polypeptide
KEEEIRTTNPVATECYGVVSTELQETEGEM

SEQ ID NO: 37889 - protein, 28 aa, Artificial Sequence
  Description of Artificial Sequence: Synthetic peptide
DEEEIRTTNIVRNEQYGNVSNNILASNR

SEQ ID NO: 37890 - protein, 28 aa, Artificial Sequence
  Description of Artificial Sequence: Synthetic peptide
DEETQRTTNIVATEQYGLVEDNIQRNNT

SEQ ID NO: 37891 - protein, 28 aa, Artificial Sequence
  Description of Artificial Sequence: Synthetic peptide
DEEEIRTTNPVATRPYGTTATNLQNSTT

SEQ ID NO: 37892 - protein, 28 aa, Artificial Sequence
  Description of Artificial Sequence: Synthetic peptide
DENEIACTNPVATEIYGVVSTELQIGEY

SEQ ID NO: 37893 - protein, 28 aa, Artificial Sequence
  Description of Artificial Sequence: Synthetic peptide
AEEEIRTTNIVATDQQGGVHQNFQRGSR

SEQ ID NO: 37894 - protein, 28 aa, Artificial Sequence
  Description of Artificial Sequence: Synthetic peptide
DEEDLKTANIVATEQYGQVSTNLQNQVR

SEQ ID NO: 37895 - protein, 28 aa, Artificial Sequence
  Description of Artificial Sequence: Synthetic peptide
QEEEICCTNPEATEQYGCVSTNDQLGPH

SEQ ID NO: 37896 - protein, 28 aa, Artificial Sequence
  Description of Artificial Sequence: Synthetic peptide
DEMDERTNNNVATEQYGSVSDNLQNGSG

SEQ ID NO: 37897 - protein, 28 aa, Artificial Sequence
  Description of Artificial Sequence: Synthetic peptide
DGEEIRNTNIVATEKYGGVSDNLQLGST

SEQ ID NO: 37898 - protein, 28 aa, Artificial Sequence
  Description of Artificial Sequence: Synthetic peptide
DEEEGRTTEVVDTEQYGTVSNNIQRRNA

SEQ ID NO: 37899 - protein, 32 aa, Artificial Sequence
  Description of Artificial Sequence: Synthetic polypeptide
DEEEIRCTNPDATEQYGWVASTTNLQDDGIND

SEQ ID NO: 37900 - protein, 28 aa, Artificial Sequence
  Description of Artificial Sequence: Synthetic peptide
DDETTRTTNDVTTEQYLLVMTNLQRGNT

SEQ ID NO: 37901 - protein, 28 aa, Artificial Sequence
  Description of Artificial Sequence: Synthetic peptide
SEEMIRTTNIFATEQYGSVTTNNQNSNC

SEQ ID NO: 37902 - protein, 28 aa, Artificial Sequence
  Description of Artificial Sequence: Synthetic peptide
DEEEISTTNPDATEQYGFASTGQQHGME

SEQ ID NO: 37903 - protein, 31 aa, Artificial Sequence
  Description of Artificial Sequence: Synthetic polypeptide
DEEEIRTTNPVATEQYGDVSCEADQCLKGNE

SEQ ID NO: 37904 - protein, 28 aa, Artificial Sequence
  Description of Artificial Sequence: Synthetic peptide
DEEEIAQTNIVATEQYGSVETIDDIGNF

SEQ ID NO: 37905 - protein, 30 aa, Artificial Sequence
  Description of Artificial Sequence: Synthetic polypeptide
DEAEIRTTNPVCTEQYGSACTNLEDNGNDA

SEQ ID NO: 37906 - protein, 28 aa, Artificial Sequence
  Description of Artificial Sequence: Synthetic peptide
NEEEIRTTNIVATEIFGAVATNLQIGVN

SEQ ID NO: 37907 - protein, 28 aa, Artificial Sequence
  Description of Artificial Sequence: Synthetic peptide
QEIGIRTTNIVHTEQGGSVATNLQATNR

SEQ ID NO: 37908 - protein, 28 aa, Artificial Sequence
  Description of Artificial Sequence: Synthetic peptide
DEEEIRNTNGVATEQKGITSTIFLRGGR

SEQ ID NO: 37909 - protein, 34 aa, Artificial Sequence
  Description of Artificial Sequence: Synthetic polypeptide
DEEEIRTTNPVATEQYGSVISTLNLPQLFEGVTQ

SEQ ID NO: 37910 - protein, 28 aa, Artificial Sequence
  Description of Artificial Sequence: Synthetic peptide
FEQEWRTTNIAATEEVGEVSTNLQRGNS

SEQ ID NO: 37911 - protein, 28 aa, Artificial Sequence
  Description of Artificial Sequence: Synthetic peptide
QEPEIRTTNPVATENYGWASENQQMGNT

SEQ ID NO: 37912 - protein, 35 aa, Artificial Sequence
  Description of Artificial Sequence: Synthetic polypeptide
DEEEIRTTNPVATEQYGSVADTTDPNLLDRNGDNR

SEQ ID NO: 37913 - protein, 28 aa, Artificial Sequence
  Description of Artificial Sequence: Synthetic peptide
DEGDWRTVNIVATEQLGTVSTNLQGMNR

SEQ ID NO: 37914 - protein, 28 aa, Artificial Sequence
  Description of Artificial Sequence: Synthetic peptide
DSESARDTNIMATEQYGSVGQNLQYGNR

SEQ ID NO: 37915 - protein, 28 aa, Artificial Sequence
  Description of Artificial Sequence: Synthetic peptide
DEEEIKTTNIVATEQYGLVSTINQNTTT

SEQ ID NO: 37916 - protein, 28 aa, Artificial Sequence
  Description of Artificial Sequence: Synthetic peptide
DEQEVRCTNIVSTENYGVVGSNLQRGNR

SEQ ID NO: 37917 - protein, 31 aa, Artificial Sequence
  Description of Artificial Sequence: Synthetic polypeptide
DEEEIRTTNPVATEQYGDVSECLQCHAGEDQ

SEQ ID NO: 37918 - protein, 28 aa, Artificial Sequence
  Description of Artificial Sequence: Synthetic peptide
DEQELRTSSNVATEQYGGVSTQLQTGAR

SEQ ID NO: 37919 - protein, 28 aa, Artificial Sequence
  Description of Artificial Sequence: Synthetic peptide
SEENIRITNIFAEEQYGSTSTNLIRGNS

SEQ ID NO: 37920 - protein, 31 aa, Artificial Sequence
  Description of Artificial Sequence: Synthetic polypeptide
DEEEIRTTNPVATEQYGSVGTCDQDCNEFEF

SEQ ID NO: 37921 - protein, 31 aa, Artificial Sequence
  Description of Artificial Sequence: Synthetic polypeptide
DEEEIRTTNPVATEQYGDVSECLQCHAGEDL

SEQ ID NO: 37922 - protein, 28 aa, Artificial Sequence
  Description of Artificial Sequence: Synthetic peptide
DIEETRTINIVTTENYGSTSQNLQRGNG

SEQ ID NO: 37923 - protein, 28 aa, Artificial Sequence
  Description of Artificial Sequence: Synthetic peptide
GAEENNTTNEIATEQYGSVDTENQRGNR

SEQ ID NO: 37924 - protein, 28 aa, Artificial Sequence
  Description of Artificial Sequence: Synthetic peptide
AENEIAQTNPVATEQYGVVSEDLQRGED

SEQ ID NO: 37925 - protein, 28 aa, Artificial Sequence
  Description of Artificial Sequence: Synthetic peptide
YEEEIASVNPVCTEQYGVVSDNLQSGNQ

SEQ ID NO: 37926 - protein, 31 aa, Artificial Sequence
  Description of Artificial Sequence: Synthetic polypeptide
QEEEIRATNPVATEQYGVVSTDLQESDGNDN

SEQ ID NO: 37927 - protein, 28 aa, Artificial Sequence
  Description of Artificial Sequence: Synthetic peptide
DGELIWTTNILATENYGEVSTNLQRQND

SEQ ID NO: 37928 - protein, 28 aa, Artificial Sequence
  Description of Artificial Sequence: Synthetic peptide
DESNIGNTNGVATETVNSVSTNLERGNR

SEQ ID NO: 37929 - protein, 28 aa, Artificial Sequence
  Description of Artificial Sequence: Synthetic peptide
DSEEIITTNGVKTEQYGSDGTRLYRSNR

SEQ ID NO: 37930 - protein, 28 aa, Artificial Sequence
  Description of Artificial Sequence: Synthetic peptide
DEEEIRTTNIDATEQYGSVETDDEMGEF

SEQ ID NO: 37931 - protein, 28 aa, Artificial Sequence
  Description of Artificial Sequence: Synthetic peptide
DEQEVRTTNGVATEQYGYVATNLQNTST

SEQ ID NO: 37932 - protein, 28 aa, Artificial Sequence
  Description of Artificial Sequence: Synthetic peptide
DWQEINFTNPVTTEQYGSPSDPLGRGNR

SEQ ID NO: 37933 - protein, 28 aa, Artificial Sequence
  Description of Artificial Sequence: Synthetic peptide
DEQEIATTNIVATEQYGSVETILEIGEA

SEQ ID NO: 37934 - protein, 30 aa, Artificial Sequence
  Description of Artificial Sequence: Synthetic polypeptide
DEEEIATTNPTATEQFGGVSATNGEYRGNF

SEQ ID NO: 37935 - protein, 28 aa, Artificial Sequence
  Description of Artificial Sequence: Synthetic peptide
DEEEIRTTNPVDTDRYGTTATNLQSSNT

SEQ ID NO: 37936 - protein, 28 aa, Artificial Sequence
  Description of Artificial Sequence: Synthetic peptide
DEEEIRQCNIGATEQYGMTSTRLYAGNR

SEQ ID NO: 37937 - protein, 28 aa, Artificial Sequence
  Description of Artificial Sequence: Synthetic peptide
QEVEITATNPVATEMYGSVSTDLQSGDD

SEQ ID NO: 37938 - protein, 33 aa, Artificial Sequence
  Description of Artificial Sequence: Synthetic polypeptide
DEEEIATTNPTATEQYGSVSTMNEQLQEGDNTF

SEQ ID NO: 37939 - protein, 28 aa, Artificial Sequence
  Description of Artificial Sequence: Synthetic peptide
HELEIATTNPVATECYGSASTNIQTGMM

SEQ ID NO: 37940 - protein, 28 aa, Artificial Sequence
  Description of Artificial Sequence: Synthetic peptide
DETEIRFINNLATENYGSVSTNERRGNT

SEQ ID NO: 37941 - protein, 28 aa, Artificial Sequence
  Description of Artificial Sequence: Synthetic peptide
DEQELRSTNIVSTEIYGTVANNLQRGNR

SEQ ID NO: 37942 - protein, 28 aa, Artificial Sequence
  Description of Artificial Sequence: Synthetic peptide
DEEEISTTQIIATEQWGSRSTQKQRGNT

SEQ ID NO: 37943 - protein, 32 aa, Artificial Sequence
  Description of Artificial Sequence: Synthetic polypeptide
DEEEIATTNPVATEQYGSVISENEQDREGDTF

SEQ ID NO: 37944 - protein, 28 aa, Artificial Sequence
  Description of Artificial Sequence: Synthetic peptide
DEEGIRTTNIVDTRRVGTVSSNLQRGND

SEQ ID NO: 37945 - protein, 28 aa, Artificial Sequence
  Description of Artificial Sequence: Synthetic peptide
DEEEIQTTNIVATKIYGTVASNLQHSNR

SEQ ID NO: 37946 - protein, 28 aa, Artificial Sequence
  Description of Artificial Sequence: Synthetic peptide
VEEEIRATNPVCTEQWGSCSDNLQYGQV

SEQ ID NO: 37947 - protein, 28 aa, Artificial Sequence
  Description of Artificial Sequence: Synthetic peptide
DDGETRTTNIVATEHYGSYTDNNQRGNR

SEQ ID NO: 37948 - protein, 28 aa, Artificial Sequence
  Description of Artificial Sequence: Synthetic peptide
DENEITTTNIIDTEQYGSVKTNLGQKNR

SEQ ID NO: 37949 - protein, 33 aa, Artificial Sequence
  Description of Artificial Sequence: Synthetic polypeptide
DEEEIRTTNPVATEQYGSVISTANPPCNGDNCF

SEQ ID NO: 37950 - protein, 28 aa, Artificial Sequence
  Description of Artificial Sequence: Synthetic peptide
FEEEINTTNIVGTEEYGTRSTNSQRGNH

SEQ ID NO: 37951 - protein, 28 aa, Artificial Sequence
  Description of Artificial Sequence: Synthetic peptide
DEEEIRTNNAIANENYGSVSNRSQRGNT

SEQ ID NO: 37952 - protein, 31 aa, Artificial Sequence
  Description of Artificial Sequence: Synthetic polypeptide
AEEEITTTNPVATEQYGSVSTELEPKGDEAR

SEQ ID NO: 37953 - protein, 30 aa, Artificial Sequence
  Description of Artificial Sequence: Synthetic polypeptide
SEEEIAATNPVSTEQFGSVDSTNLQQEGTR

SEQ ID NO: 37954 - protein, 32 aa, Artificial Sequence
  Description of Artificial Sequence: Synthetic polypeptide
DEEEIVTTNPVATEQYGSVSATDGPVEREGND

SEQ ID NO: 37955 - protein, 28 aa, Artificial Sequence
  Description of Artificial Sequence: Synthetic peptide
DEEEQTTTNIVILDQYGSVTTNMQAGNR

SEQ ID NO: 37956 - protein, 28 aa, Artificial Sequence
  Description of Artificial Sequence: Synthetic peptide
DEEEIRTTNPDATEQYGSVFEPPDNGEN

SEQ ID NO: 37957 - protein, 28 aa, Artificial Sequence
  Description of Artificial Sequence: Synthetic peptide
DCQEIKTTNIVATEQYGLVSTNLQDHTT

SEQ ID NO: 37958 - protein, 28 aa, Artificial Sequence
  Description of Artificial Sequence: Synthetic peptide
DEENIRTTNIVATDQYGSVETILDIGEI

SEQ ID NO: 37959 - protein, 28 aa, Artificial Sequence
  Description of Artificial Sequence: Synthetic peptide
DEQEGRTLLDVATEQQGGVRTNLQRGNN

SEQ ID NO: 37960 - protein, 28 aa, Artificial Sequence
  Description of Artificial Sequence: Synthetic peptide
SESEIATTNIVATEQYGSTATNLQIGSF

SEQ ID NO: 37961 - protein, 29 aa, Artificial Sequence
  Description of Artificial Sequence: Synthetic peptide
DEEEICATNPVATEQYGSCSDVLQHAGPM

SEQ ID NO: 37962 - protein, 28 aa, Artificial Sequence
  Description of Artificial Sequence: Synthetic peptide
DEEEIRTTNHVDQERYGSVSENLQASTT

SEQ ID NO: 37963 - protein, 33 aa, Artificial Sequence
  Description of Artificial Sequence: Synthetic polypeptide
DEEEIRTTNPVATEQYGSVSETNLEEHEGEEDF

SEQ ID NO: 37964 - protein, 34 aa, Artificial Sequence
  Description of Artificial Sequence: Synthetic polypeptide
DEEEIRTTNPFATEQYGSVSITPGPLVDLRGDNR

SEQ ID NO: 37965 - protein, 28 aa, Artificial Sequence
  Description of Artificial Sequence: Synthetic peptide
DEEEIKTTNSVCGEQYGQTATNLQRSTR

SEQ ID NO: 37966 - protein, 28 aa, Artificial Sequence
  Description of Artificial Sequence: Synthetic peptide
DEQEIACTNIVSTEIYGNVATNLQRGGR

SEQ ID NO: 37967 - protein, 28 aa, Artificial Sequence
  Description of Artificial Sequence: Synthetic peptide
DEEGIRTTNAYAIDQTGDVATNLQSGNR

SEQ ID NO: 37968 - protein, 28 aa, Artificial Sequence
  Description of Artificial Sequence: Synthetic peptide
DDENIMTTNIVANEQYGTVKNQLQRGNR

SEQ ID NO: 37969 - protein, 29 aa, Artificial Sequence
  Description of Artificial Sequence: Synthetic peptide
DETEIRATNPVATEQYGDVSTQEQLNPNE

SEQ ID NO: 37970 - protein, 28 aa, Artificial Sequence
  Description of Artificial Sequence: Synthetic peptide
DEEEIQTTNIVATEIYGTTATNEQYGSR

SEQ ID NO: 37971 - protein, 28 aa, Artificial Sequence
  Description of Artificial Sequence: Synthetic peptide
DEQEIACTNPVASEVYGCVGMNLQVGNR

SEQ ID NO: 37972 - protein, 34 aa, Artificial Sequence
  Description of Artificial Sequence: Synthetic polypeptide
DEEEIRTTNPVATEQYGSVSLTDTLQIQDEGNNI

SEQ ID NO: 37973 - protein, 28 aa, Artificial Sequence
  Description of Artificial Sequence: Synthetic peptide
DEEEGRTNNIVSTEQYTSWSLNLQGGNV

SEQ ID NO: 37974 - protein, 28 aa, Artificial Sequence
  Description of Artificial Sequence: Synthetic peptide
DEEGIRTTNIVATEVYGMVDDNEQYGSR

SEQ ID NO: 37975 - protein, 28 aa, Artificial Sequence
  Description of Artificial Sequence: Synthetic peptide
DVEEITTGNIVATEQYGLVHTNNQRAND

SEQ ID NO: 37976 - protein, 28 aa, Artificial Sequence
  Description of Artificial Sequence: Synthetic peptide
DEEEIRTTNPVATEQWGDVSEIEMQGDA

SEQ ID NO: 37977 - protein, 28 aa, Artificial Sequence
  Description of Artificial Sequence: Synthetic peptide
DEVEIRCTNPTATECFGEVSTNLQNGTA

SEQ ID NO: 37978 - protein, 28 aa, Artificial Sequence
  Description of Artificial Sequence: Synthetic peptide
DEEEISSTNIVATEQYDSVSTIMQDTNG

SEQ ID NO: 37979 - protein, 28 aa, Artificial Sequence
  Description of Artificial Sequence: Synthetic peptide
DEEEIRTTNIFATEQYGSVETIDEGGEA

SEQ ID NO: 37980 - protein, 33 aa, Artificial Sequence
  Description of Artificial Sequence: Synthetic polypeptide
DEEEIRTTNPTATEQFGSVSTANLQLIEGENDI

SEQ ID NO: 37981 - protein, 30 aa, Artificial Sequence
  Description of Artificial Sequence: Synthetic polypeptide
DEQEIATTNPVATECYGSVSATDLEDRGEL

SEQ ID NO: 37982 - protein, 30 aa, Artificial Sequence
  Description of Artificial Sequence: Synthetic polypeptide
DEQEIRCTNPVASEIYGCVAATNLERNGNR

SEQ ID NO: 37983 - protein, 28 aa, Artificial Sequence
  Description of Artificial Sequence: Synthetic peptide
DEEEIRATNIVNTEQYLAVSTNGQHLNN

SEQ ID NO: 37984 - protein, 28 aa, Artificial Sequence
  Description of Artificial Sequence: Synthetic peptide
DEEEIRTTNLIATEQFLRVSDNHQRGGA

SEQ ID NO: 37985 - protein, 31 aa, Artificial Sequence
  Description of Artificial Sequence: Synthetic polypeptide
DEEEIRTTNPVATEQYGSVSEELQEHDEEDN

SEQ ID NO: 37986 - protein, 31 aa, Artificial Sequence
  Description of Artificial Sequence: Synthetic polypeptide
DEEEIVTTNPVATEQYGEVSTGGDQITGDNY

SEQ ID NO: 37987 - protein, 32 aa, Artificial Sequence
  Description of Artificial Sequence: Synthetic polypeptide
DEEEIRATNPVATEIYGVVSETDLQVRGENDN

SEQ ID NO: 37988 - protein, 28 aa, Artificial Sequence
  Description of Artificial Sequence: Synthetic peptide
TSDEIRTTNIIATEQGGSVSTNLSAGNS

SEQ ID NO: 37989 - protein, 28 aa, Artificial Sequence
  Description of Artificial Sequence: Synthetic peptide
DEEEIRTTNDIANEIYGSVADELLYGNR

SEQ ID NO: 37990 - protein, 28 aa, Artificial Sequence
  Description of Artificial Sequence: Synthetic peptide
DEQEIASTNPVATECYGSVSTDLQEEEL

SEQ ID NO: 37991 - protein, 28 aa, Artificial Sequence
  Description of Artificial Sequence: Synthetic peptide
DEYEISTTNDVGTEQYTLVLTNLYGGNR

SEQ ID NO: 37992 - protein, 28 aa, Artificial Sequence
  Description of Artificial Sequence: Synthetic peptide
DEEEGRTTNGVATSNYGIVSDIIQRGND

SEQ ID NO: 37993 - protein, 28 aa, Artificial Sequence
  Description of Artificial Sequence: Synthetic peptide
DENEIATTNPVASECYGSVSTELEQGLI

SEQ ID NO: 37994 - protein, 33 aa, Artificial Sequence
  Description of Artificial Sequence: Synthetic polypeptide
DEEEIRTTNPVATEQYGSVSEMNPQLIEGDNDF

SEQ ID NO: 37995 - protein, 28 aa, Artificial Sequence
  Description of Artificial Sequence: Synthetic peptide
NEAEIAATNPVATENYGSVANNLQRGTQ

SEQ ID NO: 37996 - protein, 32 aa, Artificial Sequence
  Description of Artificial Sequence: Synthetic polypeptide
DEEEIRTTNPVATEQYGSVSTDPVQEIKGEDL

SEQ ID NO: 37997 - protein, 28 aa, Artificial Sequence
  Description of Artificial Sequence: Synthetic peptide
DEEEIRCTNPVATENYGNVSTPDEEGTL

SEQ ID NO: 37998 - protein, 28 aa, Artificial Sequence
  Description of Artificial Sequence: Synthetic peptide
SEEEIRATNIVGTEIYGYVSTNLQTANT

SEQ ID NO: 37999 - protein, 28 aa, Artificial Sequence
  Description of Artificial Sequence: Synthetic peptide
DQEEIRTTNIVGAEAYGTTSTNNQQGNR

SEQ ID NO: 38000 - protein, 29 aa, Artificial Sequence
  Description of Artificial Sequence: Synthetic peptide
DEDEIRTTNPVSSEIYGCVSASNLEPGNR

SEQ ID NO: 38001 - protein, 28 aa, Artificial Sequence
  Description of Artificial Sequence: Synthetic peptide
TEQEIATTNPVATECYGMTSTNLLHGND

SEQ ID NO: 38002 - protein, 28 aa, Artificial Sequence
  Description of Artificial Sequence: Synthetic peptide
DEEGQIFGNIVAQEQYGSVSTNCQRGNT

SEQ ID NO: 38003 - protein, 33 aa, Artificial Sequence
  Description of Artificial Sequence: Synthetic polypeptide
AEEEIATTNPVATEQYGSVDSTNGLVERGEEDR

SEQ ID NO: 38004 - protein, 29 aa, Artificial Sequence
  Description of Artificial Sequence: Synthetic peptide
DEEEIATTNPVATEQYGDVSENLMHAFQQ

SEQ ID NO: 38005 - protein, 28 aa, Artificial Sequence
  Description of Artificial Sequence: Synthetic peptide
DENEIRTTNIEATEQYGSVETGDELGER

SEQ ID NO: 38006 - protein, 33 aa, Artificial Sequence
  Description of Artificial Sequence: Synthetic polypeptide
DEEEIRTTNPVATEQYGSVSTTGLEDDEGENDL

SEQ ID NO: 38007 - protein, 32 aa, Artificial Sequence
  Description of Artificial Sequence: Synthetic polypeptide
DEEEIATTNPTATEQYGSVSTMNEQDQEGDNF

SEQ ID NO: 38008 - protein, 28 aa, Artificial Sequence
  Description of Artificial Sequence: Synthetic peptide
DEQEIATTNILGTEQYGAVSDNLQMGNF

SEQ ID NO: 38009 - protein, 28 aa, Artificial Sequence
  Description of Artificial Sequence: Synthetic peptide
DEEEISTTNIVNTEQYGRHHDNVQRGNT

SEQ ID NO: 38010 - protein, 28 aa, Artificial Sequence
  Description of Artificial Sequence: Synthetic peptide
DEDEIRTNNIVATEQQGSVSESFGNGNR

SEQ ID NO: 38011 - protein, 28 aa, Artificial Sequence
  Description of Artificial Sequence: Synthetic peptide
DEEEIRTTNIVATDVYGSLGTQLQVGDD

SEQ ID NO: 38012 - protein, 35 aa, Artificial Sequence
  Description of Artificial Sequence: Synthetic polypeptide
DEEEIRTTNPVATEQYGSVSDTMNGLVEIPDGNPR

SEQ ID NO: 38013 - protein, 28 aa, Artificial Sequence
  Description of Artificial Sequence: Synthetic peptide
DEEEVAATNIVSTEVYGNVGTNLQRGGR

SEQ ID NO: 38014 - protein, 28 aa, Artificial Sequence
  Description of Artificial Sequence: Synthetic peptide
DEEERTTTNIVANEYYGSTTDNLQGGNR

SEQ ID NO: 38015 - protein, 28 aa, Artificial Sequence
  Description of Artificial Sequence: Synthetic peptide
DEEEIRTTNPFATEQYGSVWEGDWDGEN

SEQ ID NO: 38016 - protein, 35 aa, Artificial Sequence
  Description of Artificial Sequence: Synthetic polypeptide
DEEEIRTTNPVATEQYGSVSSLTMNGLVEREGENQ

SEQ ID NO: 38017 - protein, 31 aa, Artificial Sequence
  Description of Artificial Sequence: Synthetic polypeptide
DEEEIRTTNPTATEQYGEVSENPQDSGDNDI

SEQ ID NO: 38018 - protein, 35 aa, Artificial Sequence
  Description of Artificial Sequence: Synthetic polypeptide
DEEEIRTTNPFATEQYGSVSVTNGLVDLRNGENPR

SEQ ID NO: 38019 - protein, 28 aa, Artificial Sequence
  Description of Artificial Sequence: Synthetic peptide
NDAEIAATNPVATEQYGSVANNLQRGTQ

SEQ ID NO: 38020 - protein, 28 aa, Artificial Sequence
  Description of Artificial Sequence: Synthetic peptide
DEEEIRTTNIDATQQYGSVETIDDRGEI

SEQ ID NO: 38021 - protein, 28 aa, Artificial Sequence
  Description of Artificial Sequence: Synthetic peptide
DEEEIAITNIRATEQYGGVETNKQTSNR

SEQ ID NO: 38022 - protein, 28 aa, Artificial Sequence
  Description of Artificial Sequence: Synthetic peptide
DEEEITATNIRATEEYGVVSTNEQSGNT

SEQ ID NO: 38023 - protein, 28 aa, Artificial Sequence
  Description of Artificial Sequence: Synthetic peptide
NEEEIRTTNGVATEAYGQLATNLQSANT

SEQ ID NO: 38024 - protein, 28 aa, Artificial Sequence
  Description of Artificial Sequence: Synthetic peptide
DENEIAQTNPVATEQYGVVSTDDEVGNL

SEQ ID NO: 38025 - protein, 31 aa, Artificial Sequence
  Description of Artificial Sequence: Synthetic polypeptide
QEEEIATTNPVATECYGSVSTDLQDTKGEDR

SEQ ID NO: 38026 - protein, 32 aa, Artificial Sequence
  Description of Artificial Sequence: Synthetic polypeptide
DEQEIATTNPVATEQYGSVSATNLENEGENDI

SEQ ID NO: 38027 - protein, 28 aa, Artificial Sequence
  Description of Artificial Sequence: Synthetic peptide
DEEEIATTNIVATEQYGFWATNLQNATT

SEQ ID NO: 38028 - protein, 31 aa, Artificial Sequence
  Description of Artificial Sequence: Synthetic polypeptide
DEEEIRTTNPVATECYGATSTEDLQEPKGNI

SEQ ID NO: 38029 - protein, 28 aa, Artificial Sequence
  Description of Artificial Sequence: Synthetic peptide
DVEEIRDTNLTATERYLSVSQNLQNGNN

SEQ ID NO: 38030 - protein, 28 aa, Artificial Sequence
  Description of Artificial Sequence: Synthetic peptide
DEAEIAATNIVASEVYGCVATNLQRGTR

SEQ ID NO: 38031 - protein, 33 aa, Artificial Sequence
  Description of Artificial Sequence: Synthetic polypeptide
DEEEIRTTNPVATEQYGSVYSTEDGLQQNGVTD

SEQ ID NO: 38032 - protein, 28 aa, Artificial Sequence
  Description of Artificial Sequence: Synthetic peptide
DENEIAQTNPVATEQYGVVSTDQENGND

SEQ ID NO: 38033 - protein, 31 aa, Artificial Sequence
  Description of Artificial Sequence: Synthetic polypeptide
SEEEIRTTNPVATEMYGSVSTGNGPQVGETL

SEQ ID NO: 38034 - protein, 28 aa, Artificial Sequence
  Description of Artificial Sequence: Synthetic peptide
DEEETQTSNIVAIRQYGSNSTNTQRGNS

SEQ ID NO: 38035 - protein, 31 aa, Artificial Sequence
  Description of Artificial Sequence: Synthetic polypeptide
DEEEIRTTNPVATEQWGSYSTNEMDYDGNDA

SEQ ID NO: 38036 - protein, 34 aa, Artificial Sequence
  Description of Artificial Sequence: Synthetic polypeptide
DEEEIRTTNPVATEQYGSVSTCCPLQLFKGDNDN

SEQ ID NO: 38037 - protein, 31 aa, Artificial Sequence
  Description of Artificial Sequence: Synthetic polypeptide
DEEEIATTNPVATEQYGSVSATDLEINGEDL

SEQ ID NO: 38038 - protein, 28 aa, Artificial Sequence
  Description of Artificial Sequence: Synthetic peptide
QEQEIAATNPVATEMYGSASTVLQHGMR

SEQ ID NO: 38039 - protein, 32 aa, Artificial Sequence
  Description of Artificial Sequence: Synthetic polypeptide
DEEEIATTNPVATECYGSVSATNLQEHNGEDD

SEQ ID NO: 38040 - protein, 28 aa, Artificial Sequence
  Description of Artificial Sequence: Synthetic peptide
DDWEIATTNIEITEQYGSVSDNLQRKNG

SEQ ID NO: 38041 - protein, 28 aa, Artificial Sequence
  Description of Artificial Sequence: Synthetic peptide
DEDEIRTTSIVSTESYGTVSDNDQRGDR

SEQ ID NO: 38042 - protein, 28 aa, Artificial Sequence
  Description of Artificial Sequence: Synthetic peptide
SEEEIRATNIVGTEQFGDVSENEQRGTR

SEQ ID NO: 38043 - protein, 34 aa, Artificial Sequence
  Description of Artificial Sequence: Synthetic polypeptide
DEEEIRTTNPFATEQYGSVPSETNNLFREGMNDD

SEQ ID NO: 38044 - protein, 28 aa, Artificial Sequence
  Description of Artificial Sequence: Synthetic peptide
DEEEIATTNIEATEQYGSVETNDEIGEL

SEQ ID NO: 38045 - protein, 28 aa, Artificial Sequence
  Description of Artificial Sequence: Synthetic peptide
DEEEINITNIVRTDQYGSVTENLQGGNT

SEQ ID NO: 38046 - protein, 28 aa, Artificial Sequence
  Description of Artificial Sequence: Synthetic peptide
DEEEVNTTNIVATERYGNVSTSLQGGGD

SEQ ID NO: 38047 - protein, 30 aa, Artificial Sequence
  Description of Artificial Sequence: Synthetic polypeptide
DEDEVKTTNPVATEPYGQVSADNLQRGPQR

SEQ ID NO: 38048 - protein, 32 aa, Artificial Sequence
  Description of Artificial Sequence: Synthetic polypeptide
DEEEIRTTNPVATEQYGSVDCTCALEEMGENS

SEQ ID NO: 38049 - protein, 28 aa, Artificial Sequence
  Description of Artificial Sequence: Synthetic peptide
DEEEIVTTSITAAEQYGSVDDNIQNGNR

SEQ ID NO: 38050 - protein, 28 aa, Artificial Sequence
  Description of Artificial Sequence: Synthetic peptide
DEEEIRTTNIVATDRYGSVRDNLQQNLA

SEQ ID NO: 38051 - protein, 29 aa, Artificial Sequence
  Description of Artificial Sequence: Synthetic peptide
DDQEIATTNPVATEIYGVVASNLEREGNR

SEQ ID NO: 38052 - protein, 30 aa, Artificial Sequence
  Description of Artificial Sequence: Synthetic polypeptide
DEQEIATVNPVATEQYGEASTVLQSRAGGR

SEQ ID NO: 38053 - protein, 31 aa, Artificial Sequence
  Description of Artificial Sequence: Synthetic polypeptide
MEEEIRATNPVATECYGSVSTDLQDNEGNDM

SEQ ID NO: 38054 - protein, 28 aa, Artificial Sequence
  Description of Artificial Sequence: Synthetic peptide
DEEEIAAVNIVASEIWGNVGTNLQRGNR

SEQ ID NO: 38055 - protein, 28 aa, Artificial Sequence
  Description of Artificial Sequence: Synthetic peptide
DEEEGRTTNIFATEQVGSLATNLQFSNT

SEQ ID NO: 38056 - protein, 28 aa, Artificial Sequence
  Description of Artificial Sequence: Synthetic peptide
DEEEVRTTNGYATENYGLISTYVQSGNR

SEQ ID NO: 38057 - protein, 28 aa, Artificial Sequence
  Description of Artificial Sequence: Synthetic peptide
DEEEIRTTNIVAWSQYGIVATNLQSAST

SEQ ID NO: 38058 - protein, 28 aa, Artificial Sequence
  Description of Artificial Sequence: Synthetic peptide
DEEEIRTTNIVATEEYGVVADNLQAQTT

SEQ ID NO: 38059 - protein, 28 aa, Artificial Sequence
  Description of Artificial Sequence: Synthetic peptide
DEEEIATTNIVATEQYGSVDTDDEYGEN

SEQ ID NO: 38060 - protein, 28 aa, Artificial Sequence
  Description of Artificial Sequence: Synthetic peptide
DESEIITNNIVADEQYGSVSTNIRGGHR

SEQ ID NO: 38061 - protein, 28 aa, Artificial Sequence
  Description of Artificial Sequence: Synthetic peptide
DEEHIRNENDVATEQSDSVDTNLQFGNS

SEQ ID NO: 38062 - protein, 28 aa, Artificial Sequence
  Description of Artificial Sequence: Synthetic peptide
DEEEIATTNPVATEVYGGVRDNLQNQTT

SEQ ID NO: 38063 - protein, 28 aa, Artificial Sequence
  Description of Artificial Sequence: Synthetic peptide
DEEEIRTTNPVDTRRYGTTATNLQSSNT

SEQ ID NO: 38064 - protein, 30 aa, Artificial Sequence
  Description of Artificial Sequence: Synthetic polypeptide
DEEEIWTTNPVATEQYGVVCSNCILQLGEQ

SEQ ID NO: 38065 - protein, 28 aa, Artificial Sequence
  Description of Artificial Sequence: Synthetic peptide
DEESIRTTNIVATERTGELSDNLRRGNT

SEQ ID NO: 38066 - protein, 28 aa, Artificial Sequence
  Description of Artificial Sequence: Synthetic peptide
DEECIRTTNIDATEQYGSVDTADMIGER

SEQ ID NO: 38067 - protein, 28 aa, Artificial Sequence
  Description of Artificial Sequence: Synthetic peptide
DEEEIKTTNIVATKQAGQTSTNLQNSNT

SEQ ID NO: 38068 - protein, 28 aa, Artificial Sequence
  Description of Artificial Sequence: Synthetic peptide
DEQEVAATNPVSTEIYGVVATNLQRGTR

SEQ ID NO: 38069 - protein, 28 aa, Artificial Sequence
  Description of Artificial Sequence: Synthetic peptide
DSEEIRTTNLNVTEQYGTVSTNLQYAGT

SEQ ID NO: 38070 - protein, 28 aa, Artificial Sequence
  Description of Artificial Sequence: Synthetic peptide
DEEEINTTNIVAWDQYGSVTTGLLETNR

SEQ ID NO: 38071 - protein, 29 aa, Artificial Sequence
  Description of Artificial Sequence: Synthetic peptide
DEEEIATTNPVATEQYGDVSENLMHAMQQ

SEQ ID NO: 38072 - protein, 28 aa, Artificial Sequence
  Description of Artificial Sequence: Synthetic peptide
DEEEIATTNPVATEVYGGTRDNLQNSNT

SEQ ID NO: 38073 - protein, 28 aa, Artificial Sequence
  Description of Artificial Sequence: Synthetic peptide
DEIEIRGTNIVANEQYGMVETNNQWGNN

SEQ ID NO: 38074 - protein, 28 aa, Artificial Sequence
  Description of Artificial Sequence: Synthetic peptide
DEEEIRTTNIFATEQYGSVETIDEIGEI

SEQ ID NO: 38075 - protein, 28 aa, Artificial Sequence
  Description of Artificial Sequence: Synthetic peptide
DEEEIKTTNIVATEQYGGTATNLQQTTT

SEQ ID NO: 38076 - protein, 28 aa, Artificial Sequence
  Description of Artificial Sequence: Synthetic peptide
DESEIRNTNIVATENYGNVSTLLQGKDR

SEQ ID NO: 38077 - protein, 30 aa, Artificial Sequence
  Description of Artificial Sequence: Synthetic polypeptide
DEHEIRTTNPVATEQYGVVDTMDLETAGNA

SEQ ID NO: 38078 - protein, 28 aa, Artificial Sequence
  Description of Artificial Sequence: Synthetic peptide
DNELISTTNNVTTEVYGTVSTNLQGGGR

SEQ ID NO: 38079 - protein, 28 aa, Artificial Sequence
  Description of Artificial Sequence: Synthetic peptide
DEQEIRSTNIVATEQYGEAGCVLQRGGR

SEQ ID NO: 38080 - protein, 28 aa, Artificial Sequence
  Description of Artificial Sequence: Synthetic peptide
DEEEIKTTNIVATEQYGSVVDNSQSSST

SEQ ID NO: 38081 - protein, 28 aa, Artificial Sequence
  Description of Artificial Sequence: Synthetic peptide
DEEEIRTQSLVATEIYGTVSDNNIRLNR

SEQ ID NO: 38082 - protein, 28 aa, Artificial Sequence
  Description of Artificial Sequence: Synthetic peptide
SEFEIYTTNPVATESYGSVSVNWQHGDS

SEQ ID NO: 38083 - protein, 28 aa, Artificial Sequence
  Description of Artificial Sequence: Synthetic peptide
DEEENRTTNIYATEQRGSVVDILIGGNR

SEQ ID NO: 38084 - protein, 28 aa, Artificial Sequence
  Description of Artificial Sequence: Synthetic peptide
DSEEINTTNKIATEQYGSTSQNISTGNR

SEQ ID NO: 38085 - protein, 28 aa, Artificial Sequence
  Description of Artificial Sequence: Synthetic peptide
DEQSTRFTNIVANEQYGSVSTNTQRSNG

SEQ ID NO: 38086 - protein, 30 aa, Artificial Sequence
  Description of Artificial Sequence: Synthetic polypeptide
DEEEIRTTNPVATEQYGDVSENEMNAAGDA

SEQ ID NO: 38087 - protein, 28 aa, Artificial Sequence
  Description of Artificial Sequence: Synthetic peptide
SEQSIATTNNVATEQYGTTSTQLQVGNR

SEQ ID NO: 38088 - protein, 28 aa, Artificial Sequence
  Description of Artificial Sequence: Synthetic peptide
DEEEGRTTNDVATRIYGNTSDNLQRQNS

SEQ ID NO: 38089 - protein, 32 aa, Artificial Sequence
  Description of Artificial Sequence: Synthetic polypeptide
DEEEIATTNPVATEQYGSVSETDQELNNGNDT

SEQ ID NO: 38090 - protein, 28 aa, Artificial Sequence
  Description of Artificial Sequence: Synthetic peptide
DEEEIRTTNVITTQQYGSWSTLLQGQNI

SEQ ID NO: 38091 - protein, 28 aa, Artificial Sequence
  Description of Artificial Sequence: Synthetic peptide
DEQEVAATNPVATEIYGVVATNLQRTTR

SEQ ID NO: 38092 - protein, 28 aa, Artificial Sequence
  Description of Artificial Sequence: Synthetic peptide
AEAEISTTNPVASECYGNVGTNLQRGTQ

SEQ ID NO: 38093 - protein, 28 aa, Artificial Sequence
  Description of Artificial Sequence: Synthetic peptide
DEEQIRTTNNVATENYGEIGTNEQRSTR

SEQ ID NO: 38094 - protein, 28 aa, Artificial Sequence
  Description of Artificial Sequence: Synthetic peptide
QENEIGTTNPVSTEIYGDVSDNLQNGNH

SEQ ID NO: 38095 - protein, 28 aa, Artificial Sequence
  Description of Artificial Sequence: Synthetic peptide
DEEEIRTTNNVTTELYGTVSTELHRSGT

SEQ ID NO: 38096 - protein, 31 aa, Artificial Sequence
  Description of Artificial Sequence: Synthetic polypeptide
QEEEIATTNPVATEQYGWVSTNLEDFKGDDR

SEQ ID NO: 38097 - protein, 28 aa, Artificial Sequence
  Description of Artificial Sequence: Synthetic peptide
SEQEIRTTNIVATESYGSVSDNHQNSNT

SEQ ID NO: 38098 - protein, 30 aa, Artificial Sequence
  Description of Artificial Sequence: Synthetic polypeptide
MENEIRTTNPVATEQYGVVSTDLEDRGTDM

SEQ ID NO: 38099 - protein, 28 aa, Artificial Sequence
  Description of Artificial Sequence: Synthetic peptide
EEEEIRTTNIVNTDEYGSVSNNLQVTNN

SEQ ID NO: 38100 - protein, 28 aa, Artificial Sequence
  Description of Artificial Sequence: Synthetic peptide
DEEEIRTTEGVDFEGYDAVWTNLQNGNR

SEQ ID NO: 38101 - protein, 28 aa, Artificial Sequence
  Description of Artificial Sequence: Synthetic peptide
DEEEIRTTNIVDTENYGTVTTNEQQNNT

SEQ ID NO: 38102 - protein, 28 aa, Artificial Sequence
  Description of Artificial Sequence: Synthetic peptide
DESEIDTANDVATSQYGIVRTTLQDGNR

SEQ ID NO: 38103 - protein, 28 aa, Artificial Sequence
  Description of Artificial Sequence: Synthetic peptide
DEEELRAVNIVSSEIYGEVSTNLQRGGR

SEQ ID NO: 38104 - protein, 28 aa, Artificial Sequence
  Description of Artificial Sequence: Synthetic peptide
DESEIRCTNIVSSEIYGAVGNNLQRGNR

SEQ ID NO: 38105 - protein, 30 aa, Artificial Sequence
  Description of Artificial Sequence: Synthetic polypeptide
DEEEIRATNPVASEQYGSVAENLEERGDDW

SEQ ID NO: 38106 - protein, 28 aa, Artificial Sequence
  Description of Artificial Sequence: Synthetic peptide
DEQEVAATNPVSSEIYGCVATNLQRGNR

SEQ ID NO: 38107 - protein, 28 aa, Artificial Sequence
  Description of Artificial Sequence: Synthetic peptide
DEEETRITNIVGTEEYGSVSNNLQSSNT

SEQ ID NO: 38108 - protein, 28 aa, Artificial Sequence
  Description of Artificial Sequence: Synthetic peptide
DEEEIRGTNIVALDQYGTASDKLQRGGR

SEQ ID NO: 38109 - protein, 28 aa, Artificial Sequence
  Description of Artificial Sequence: Synthetic peptide
DEQEIAATNIVATEGYGWVACNLQRGQR

SEQ ID NO: 38110 - protein, 28 aa, Artificial Sequence
  Description of Artificial Sequence: Synthetic peptide
DEQEVAATNPVSSEIYGVVATNLQRGNR

SEQ ID NO: 38111 - protein, 28 aa, Artificial Sequence
  Description of Artificial Sequence: Synthetic peptide
DEEEIRTTNIFATEQYGSVDTIDDDGEI

SEQ ID NO: 38112 - protein, 28 aa, Artificial Sequence
  Description of Artificial Sequence: Synthetic peptide
DEEEIRTTNIVHDEQYGTVSDNLLMKNT

SEQ ID NO: 38113 - protein, 31 aa, Artificial Sequence
  Description of Artificial Sequence: Synthetic polypeptide
MENEIRTTNPVATECYGSVSTDLQENEGNDM

SEQ ID NO: 38114 - protein, 30 aa, Artificial Sequence
  Description of Artificial Sequence: Synthetic polypeptide
DEEEIRATNPVASEQYGSCAENLQERGDDW

SEQ ID NO: 38115 - protein, 28 aa, Artificial Sequence
  Description of Artificial Sequence: Synthetic peptide
DEIEIITQNIVATEQYGSVSALQGTGNG

SEQ ID NO: 38116 - protein, 28 aa, Artificial Sequence
  Description of Artificial Sequence: Synthetic peptide
DEDGIRTTNIVATDQYGNVSDNDQRRLR

SEQ ID NO: 38117 - protein, 28 aa, Artificial Sequence
  Description of Artificial Sequence: Synthetic peptide
DEEEIRTTNIDATEQYGSVDTDDDIEER

SEQ ID NO: 38118 - protein, 28 aa, Artificial Sequence
  Description of Artificial Sequence: Synthetic peptide
SEEEIRATNPVATEMFGEVSENLQIGTQ

SEQ ID NO: 38119 - protein, 28 aa, Artificial Sequence
  Description of Artificial Sequence: Synthetic peptide
QEQEIATVNPVATEIYGSVSEVLQHGMR

SEQ ID NO: 38120 - protein, 31 aa, Artificial Sequence
  Description of Artificial Sequence: Synthetic polypeptide
DEEEICTTNPVATEQYGDVSEANLQLHGPDI

SEQ ID NO: 38121 - protein, 34 aa, Artificial Sequence
  Description of Artificial Sequence: Synthetic polypeptide
DEEEIRTTNPVATEQYGSVISTANEQDVEGVNTF

SEQ ID NO: 38122 - protein, 28 aa, Artificial Sequence
  Description of Artificial Sequence: Synthetic peptide
DEEEGRTTNIVATETFGQVSDRLQNGNT

SEQ ID NO: 38123 - protein, 28 aa, Artificial Sequence
  Description of Artificial Sequence: Synthetic peptide
NEDEIRTTNLVATEQYGCVGTNGQNDDR

SEQ ID NO: 38124 - protein, 28 aa, Artificial Sequence
  Description of Artificial Sequence: Synthetic peptide
DEEEIITTQIVNTEQLGMLSTNLQRGAW

SEQ ID NO: 38125 - protein, 28 aa, Artificial Sequence
  Description of Artificial Sequence: Synthetic peptide
DEEEIRTTNLVATEYYGHVSTQCARAST

SEQ ID NO: 38126 - protein, 28 aa, Artificial Sequence
  Description of Artificial Sequence: Synthetic peptide
DENEIRTTNPVATEVWGSVDTNEMIGDQ

SEQ ID NO: 38127 - protein, 33 aa, Artificial Sequence
  Description of Artificial Sequence: Synthetic polypeptide
DEQEIRTTNPVATEQYGSTVDSITNADDLRGNL

SEQ ID NO: 38128 - protein, 28 aa, Artificial Sequence
  Description of Artificial Sequence: Synthetic peptide
DEEEIRTENIIATESYGEVVDNIQNGNR

SEQ ID NO: 38129 - protein, 28 aa, Artificial Sequence
  Description of Artificial Sequence: Synthetic peptide
DSEEINTTNIKALEQYGSVYDNQQRGNS

SEQ ID NO: 38130 - protein, 28 aa, Artificial Sequence
  Description of Artificial Sequence: Synthetic peptide
DENETASVNPVAYEMYGSVSTNLQRPNF

SEQ ID NO: 38131 - protein, 28 aa, Artificial Sequence
  Description of Artificial Sequence: Synthetic peptide
DEEEIETTNIIATKIGGSVSTNNQSGMR

SEQ ID NO: 38132 - protein, 28 aa, Artificial Sequence
  Description of Artificial Sequence: Synthetic peptide
DEEETRTTNIVAWEQEGSVSSCLQNSNT

SEQ ID NO: 38133 - protein, 28 aa, Artificial Sequence
  Description of Artificial Sequence: Synthetic peptide
DEEEIETTNIVATEQAGTLSTIQQQLNR

SEQ ID NO: 38134 - protein, 28 aa, Artificial Sequence
  Description of Artificial Sequence: Synthetic peptide
DEMEIKTTNIVATEQYGVVSDNLQNAQE

SEQ ID NO: 38135 - protein, 28 aa, Artificial Sequence
  Description of Artificial Sequence: Synthetic peptide
DEVEIRCTNPCATEQYGDVSTDPNPGNY

SEQ ID NO: 38136 - protein, 28 aa, Artificial Sequence
  Description of Artificial Sequence: Synthetic peptide
DWEEIRDTNIVATEQYGSIATNMARNNV

SEQ ID NO: 38137 - protein, 32 aa, Artificial Sequence
  Description of Artificial Sequence: Synthetic polypeptide
DEEEIRTTNPDATEQYGSVSTDNDVEGDGEDR

SEQ ID NO: 38138 - protein, 28 aa, Artificial Sequence
  Description of Artificial Sequence: Synthetic peptide
DEQEVASVNIVATENYGCVGTNLQRGNR

SEQ ID NO: 38139 - protein, 33 aa, Artificial Sequence
  Description of Artificial Sequence: Synthetic polypeptide
DEEEIRTTNPVATEQYGSVSATGLELDNGENDD

SEQ ID NO: 38140 - protein, 32 aa, Artificial Sequence
  Description of Artificial Sequence: Synthetic polypeptide
DEEEIATTNPVATECYGSVSATNLQDHEGEDL

SEQ ID NO: 38141 - protein, 32 aa, Artificial Sequence
  Description of Artificial Sequence: Synthetic polypeptide
DEEEIATTNPTATEQYGSVSTMNEQLNEGDNV

SEQ ID NO: 38142 - protein, 32 aa, Artificial Sequence
  Description of Artificial Sequence: Synthetic polypeptide
DEEEIRTTNPVATEQYGSVSEMNPQENGDTDV

SEQ ID NO: 38143 - protein, 28 aa, Artificial Sequence
  Description of Artificial Sequence: Synthetic peptide
DEEEVSTTNIVATDQYDSTSTNLQSGTA

SEQ ID NO: 38144 - protein, 33 aa, Artificial Sequence
  Description of Artificial Sequence: Synthetic polypeptide
DEEEIRTTNPVATEQYGSVSETEPLQETDGDDY

SEQ ID NO: 38145 - protein, 29 aa, Artificial Sequence
  Description of Artificial Sequence: Synthetic peptide
AETEIVTTNPVATEQYGCVSEMNLQPLIR

SEQ ID NO: 38146 - protein, 28 aa, Artificial Sequence
  Description of Artificial Sequence: Synthetic peptide
DEEEIRTTNPVATEQYGDVSECPCHEEL

SEQ ID NO: 38147 - protein, 28 aa, Artificial Sequence
  Description of Artificial Sequence: Synthetic peptide
DEEEIRTTNPVATEQWGDVSEIEMQGDM

SEQ ID NO: 38148 - protein, 33 aa, Artificial Sequence
  Description of Artificial Sequence: Synthetic polypeptide
DEEEIRTTNPVATEQYGSVSDTLADQSKGEEPR

SEQ ID NO: 38149 - protein, 30 aa, Artificial Sequence
  Description of Artificial Sequence: Synthetic polypeptide
VEEEIRTTNPIATYQYGCVDSDTDLQIGLR

SEQ ID NO: 38150 - protein, 28 aa, Artificial Sequence
  Description of Artificial Sequence: Synthetic peptide
DEEEIRTTNPIASENYGSVGTGDQGGMF

SEQ ID NO: 38151 - protein, 29 aa, Artificial Sequence
  Description of Artificial Sequence: Synthetic peptide
GEEEIRTTNPVATECYGVMSTELQDAGES

SEQ ID NO: 38152 - protein, 29 aa, Artificial Sequence
  Description of Artificial Sequence: Synthetic peptide
DENEIRTTNPVATEIWGSVSENEQMTGTF

SEQ ID NO: 38153 - protein, 31 aa, Artificial Sequence
  Description of Artificial Sequence: Synthetic polypeptide
DEQEIRTTNPVATEQYGSVDTDGDPQPGEDR

SEQ ID NO: 38154 - protein, 31 aa, Artificial Sequence
  Description of Artificial Sequence: Synthetic polypeptide
SEEEIRTTNPTATEMYGSVISEMNEQQGNTR

SEQ ID NO: 38155 - protein, 32 aa, Artificial Sequence
  Description of Artificial Sequence: Synthetic polypeptide
DEEEIRTTNPFATEQYGQVSIELNPQDRKGNS

SEQ ID NO: 38156 - protein, 33 aa, Artificial Sequence
  Description of Artificial Sequence: Synthetic polypeptide
DEEEIRTTNPEATEQYGSVSTNGDQEIEGENDF

SEQ ID NO: 38157 - protein, 34 aa, Artificial Sequence
  Description of Artificial Sequence: Synthetic polypeptide
DEEEIRTTNPVATEQYGSVSITPNPLVQIDGDEP

SEQ ID NO: 38158 - protein, 28 aa, Artificial Sequence
  Description of Artificial Sequence: Synthetic peptide
SEVEIATTNPEATECFGSVSENLQNGNA

SEQ ID NO: 38159 - protein, 30 aa, Artificial Sequence
  Description of Artificial Sequence: Synthetic polypeptide
DEEEIRTTNPVATEQYGSVSDIPEQNEEPS

SEQ ID NO: 38160 - protein, 28 aa, Artificial Sequence
  Description of Artificial Sequence: Synthetic peptide
QEQEIACTNPVSTEQYGEASEVLQRGNR

SEQ ID NO: 38161 - protein, 30 aa, Artificial Sequence
  Description of Artificial Sequence: Synthetic polypeptide
SEEEIRTTNPVATECWGSVSTNDMLGGNDI

SEQ ID NO: 38162 - protein, 28 aa, Artificial Sequence
  Description of Artificial Sequence: Synthetic peptide
SEVEIAATNPTATEQYGSVSENEQQGNF

SEQ ID NO: 38163 - protein, 31 aa, Artificial Sequence
  Description of Artificial Sequence: Synthetic polypeptide
DEQEITTTNPCATEQYGVVSCTNLCEQGNDR

SEQ ID NO: 38164 - protein, 28 aa, Artificial Sequence
  Description of Artificial Sequence: Synthetic peptide
HEEEIRTTNPIATEAYGHVSCTPQGGNH

SEQ ID NO: 38165 - protein, 31 aa, Artificial Sequence
  Description of Artificial Sequence: Synthetic polypeptide
DEEEIRTTNPVATECYGSVSETELEEPKGEI

SEQ ID NO: 38166 - protein, 35 aa, Artificial Sequence
  Description of Artificial Sequence: Synthetic polypeptide
DEEEIRTTNPVATEQYGSVSTTDNGLVEIREGEND

SEQ ID NO: 38167 - protein, 31 aa, Artificial Sequence
  Description of Artificial Sequence: Synthetic polypeptide
DEQEIATTNPVATECYGSVSATDLQDHEGNL

SEQ ID NO: 38168 - protein, 30 aa, Artificial Sequence
  Description of Artificial Sequence: Synthetic polypeptide
DEEEISTTNPVATEQYGDASTMDIQQDGNV

SEQ ID NO: 38169 - protein, 30 aa, Artificial Sequence
  Description of Artificial Sequence: Synthetic polypeptide
DEEEIRTTNPVATEQYGSVDCEDWCHGNDA

SEQ ID NO: 38170 - protein, 28 aa, Artificial Sequence
  Description of Artificial Sequence: Synthetic peptide
DEEEIRPTNPDATENYGSVATCEDPGNG

SEQ ID NO: 38171 - protein, 28 aa, Artificial Sequence
  Description of Artificial Sequence: Synthetic peptide
SEVEIAATNPTATEMYGSVSTNEQQGNF

SEQ ID NO: 38172 - protein, 32 aa, Artificial Sequence
  Description of Artificial Sequence: Synthetic polypeptide
DEEEIATTNPVATECYGSVSATNLQDQNGEDL

SEQ ID NO: 38173 - protein, 28 aa, Artificial Sequence
  Description of Artificial Sequence: Synthetic peptide
GEEEIASTNPVATEMYGEVACILQRGGR

SEQ ID NO: 38174 - protein, 31 aa, Artificial Sequence
  Description of Artificial Sequence: Synthetic polypeptide
DEVEIATTNPVATEQYGDVSCTDLQCQAGNA

SEQ ID NO: 38175 - protein, 28 aa, Artificial Sequence
  Description of Artificial Sequence: Synthetic peptide
DENEISAVNPVATEQYGWVSDNLQEGEA

SEQ ID NO: 38176 - protein, 29 aa, Artificial Sequence
  Description of Artificial Sequence: Synthetic peptide
DENEIKTTNPVATECYGSVSENEQNLGTF

SEQ ID NO: 38177 - protein, 28 aa, Artificial Sequence
  Description of Artificial Sequence: Synthetic peptide
VEEEIRTTNPVSTEQYGEAGDNLQQQTR

SEQ ID NO: 38178 - protein, 28 aa, Artificial Sequence
  Description of Artificial Sequence: Synthetic peptide
DEEEITTTNPEATEHWGSVSTELELGDF

SEQ ID NO: 38179 - protein, 31 aa, Artificial Sequence
  Description of Artificial Sequence: Synthetic polypeptide
DEQEIATTNPVATEQYGSVSATDLQDHEGEL

SEQ ID NO: 38180 - protein, 30 aa, Artificial Sequence
  Description of Artificial Sequence: Synthetic polypeptide
DEEEIRTVNPVATECYGSVSEEPDEMRGMR

SEQ ID NO: 38181 - protein, 28 aa, Artificial Sequence
  Description of Artificial Sequence: Synthetic peptide
DEVEISTTNPEATFIYGCVSANLQQGNF

SEQ ID NO: 38182 - protein, 33 aa, Artificial Sequence
  Description of Artificial Sequence: Synthetic polypeptide
DEEEIRTTNPVATEQYGSVSTCAPVQEAKGNDT

SEQ ID NO: 38183 - protein, 32 aa, Artificial Sequence
  Description of Artificial Sequence: Synthetic polypeptide
DEEEIATTNPVATECYGSVSATNLQEHEGEDL

SEQ ID NO: 38184 - protein, 29 aa, Artificial Sequence
  Description of Artificial Sequence: Synthetic peptide
AETEIRTVNPVATEGYGWVSENLQHAGGR

SEQ ID NO: 38185 - protein, 28 aa, Artificial Sequence
  Description of Artificial Sequence: Synthetic peptide
DEQEIRTTNPTATEIYGSVSTAPYMGEI

SEQ ID NO: 38186 - protein, 32 aa, Artificial Sequence
  Description of Artificial Sequence: Synthetic polypeptide
DEVEIATTNPTATEQYGSVSTGNPQLQEGDNN

SEQ ID NO: 38187 - protein, 33 aa, Artificial Sequence
  Description of Artificial Sequence: Synthetic polypeptide
DEEEIRTTNPVATEQYGSVSVENEGGGRDGINH

SEQ ID NO: 38188 - protein, 28 aa, Artificial Sequence
  Description of Artificial Sequence: Synthetic peptide
DEEEIATTNPVATEQYGDASENLMHMQQ

SEQ ID NO: 38189 - protein, 28 aa, Artificial Sequence
  Description of Artificial Sequence: Synthetic peptide
QEVEIVTTNPVATECYGSASTDLQTGEI

SEQ ID NO: 38190 - protein, 31 aa, Artificial Sequence
  Description of Artificial Sequence: Synthetic polypeptide
DEEEIRTTNPEATEQYGSVSTEALVEDEGDF

SEQ ID NO: 38191 - protein, 31 aa, Artificial Sequence
  Description of Artificial Sequence: Synthetic polypeptide
DENEIRTTNPVATEQWGSYSTTNEMDRGNDA

SEQ ID NO: 38192 - protein, 28 aa, Artificial Sequence
  Description of Artificial Sequence: Synthetic peptide
SEEEIRTTNPVSTEQWGSVSTAEEVGDY

SEQ ID NO: 38193 - protein, 31 aa, Artificial Sequence
  Description of Artificial Sequence: Synthetic polypeptide
DEEEIRTTNPVATECYGHVSTGQNQRKENEL

SEQ ID NO: 38194 - protein, 28 aa, Artificial Sequence
  Description of Artificial Sequence: Synthetic peptide
VEEEIRATNPVCSEQYGCTSMNLQRGTQ

SEQ ID NO: 38195 - protein, 31 aa, Artificial Sequence
  Description of Artificial Sequence: Synthetic polypeptide
DEQEIATTNPVATEQYGDVSCTMDLQCHGNA

SEQ ID NO: 38196 - protein, 28 aa, Artificial Sequence
  Description of Artificial Sequence: Synthetic peptide
QEGEIATTNPCASEQYGIVSCNLQSGTR

SEQ ID NO: 38197 - protein, 31 aa, Artificial Sequence
  Description of Artificial Sequence: Synthetic polypeptide
DEQEIRTTNPDATEQYGSVSTLNGEESGNPI

SEQ ID NO: 38198 - protein, 33 aa, Artificial Sequence
  Description of Artificial Sequence: Synthetic polypeptide
DEEEIRTTNPVATEQYGSVSATDLELDNGENDD

SEQ ID NO: 38199 - protein, 29 aa, Artificial Sequence
  Description of Artificial Sequence: Synthetic peptide
DEEEISTTNPVATEQWGSVSDADMQGNDS

SEQ ID NO: 38200 - protein, 28 aa, Artificial Sequence
  Description of Artificial Sequence: Synthetic peptide
DENEITCTNPVCTEPYGSVATNDQYGND

SEQ ID NO: 38201 - protein, 28 aa, Artificial Sequence
  Description of Artificial Sequence: Synthetic peptide
DENEIRCTNPVSTECYGSVSENLELGTS

SEQ ID NO: 38202 - protein, 31 aa, Artificial Sequence
  Description of Artificial Sequence: Synthetic polypeptide
MENEIRTTNPVATEQYGSVSEDLQDNEGNDM

SEQ ID NO: 38203 - protein, 28 aa, Artificial Sequence
  Description of Artificial Sequence: Synthetic peptide
FEEEIRAVNPVATEPWGCVSENVQRGNT

SEQ ID NO: 38204 - protein, 32 aa, Artificial Sequence
  Description of Artificial Sequence: Synthetic polypeptide
DEEEIRTTNPVATEQYGDVSCEMDLQCTGNDV

SEQ ID NO: 38205 - protein, 33 aa, Artificial Sequence
  Description of Artificial Sequence: Synthetic polypeptide
DEEEIRTTNPVATEQYGSVDSTDDVEDHEGNDR

SEQ ID NO: 38206 - protein, 28 aa, Artificial Sequence
  Description of Artificial Sequence: Synthetic peptide
DEEEICTVNPVATEQYGSAPTVIQGGTI

SEQ ID NO: 38207 - protein, 32 aa, Artificial Sequence
  Description of Artificial Sequence: Synthetic polypeptide
SEEEIRTTNPVATEQYGSVISDNLPQLVGPTI

SEQ ID NO: 38208 - protein, 31 aa, Artificial Sequence
  Description of Artificial Sequence: Synthetic polypeptide
DEEEIRTTNPVATEQYGDVSCEMELCHGNDS

SEQ ID NO: 38209 - protein, 28 aa, Artificial Sequence
  Description of Artificial Sequence: Synthetic peptide
SEEEIRTTNPEATETYGCVSNNVQGGPI

SEQ ID NO: 38210 - protein, 28 aa, Artificial Sequence
  Description of Artificial Sequence: Synthetic peptide
DESEIATTNPVATEGYGVMASTLQHGNI

SEQ ID NO: 38211 - protein, 31 aa, Artificial Sequence
  Description of Artificial Sequence: Synthetic polypeptide
QEEEITTTNPVATEQYGVVSETELQVVEGNG

SEQ ID NO: 38212 - protein, 33 aa, Artificial Sequence
  Description of Artificial Sequence: Synthetic polypeptide
DEEEIRTTNPVATEQYGSVSETNLEDHEGEEDF

SEQ ID NO: 38213 - protein, 29 aa, Artificial Sequence
  Description of Artificial Sequence: Synthetic peptide
DEEEIAATNPCATEQYGCVSATTVQRGQF

SEQ ID NO: 38214 - protein, 33 aa, Artificial Sequence
  Description of Artificial Sequence: Synthetic polypeptide
DEEEIRTTNPTATEQYGSVSTGNEQDNEGDNDE

SEQ ID NO: 38215 - protein, 33 aa, Artificial Sequence
  Description of Artificial Sequence: Synthetic polypeptide
DEEEIRTTNPVATEQYGSVSETNLEEIEGEEDF

SEQ ID NO: 38216 - protein, 31 aa, Artificial Sequence
  Description of Artificial Sequence: Synthetic polypeptide
DEQEIATTNPVATEQYGSVSATDLEDREGEL

SEQ ID NO: 38217 - protein, 35 aa, Artificial Sequence
  Description of Artificial Sequence: Synthetic polypeptide
DEEEIRTTNPVATEQYGSVSVTIPLVQDRKGDEPR

SEQ ID NO: 38218 - protein, 31 aa, Artificial Sequence
  Description of Artificial Sequence: Synthetic polypeptide
DEEEIRTTNPVATEAYGNVPSTNNVDLDGNW

SEQ ID NO: 38219 - protein, 30 aa, Artificial Sequence
  Description of Artificial Sequence: Synthetic polypeptide
MENEIRATNPVATEQYGSVSTDLQNEGEDS

SEQ ID NO: 38220 - protein, 28 aa, Artificial Sequence
  Description of Artificial Sequence: Synthetic peptide
DEEEIAQTNPVATEQYGVVSEDLEVGED

SEQ ID NO: 38221 - protein, 30 aa, Artificial Sequence
  Description of Artificial Sequence: Synthetic polypeptide
DEQEIRCTNPVASEIYGCVAATNLEREGNR

SEQ ID NO: 38222 - protein, 29 aa, Artificial Sequence
  Description of Artificial Sequence: Synthetic peptide
DEEEINSVNPVATETYGTVATNLQHAGMR

SEQ ID NO: 38223 - protein, 28 aa, Artificial Sequence
  Description of Artificial Sequence: Synthetic peptide
DEEEIRTTNPVATECWGIVDTNDETGTM

SEQ ID NO: 38224 - protein, 28 aa, Artificial Sequence
  Description of Artificial Sequence: Synthetic peptide
DENEIMTTNPTATEQYGDVSTEVQSGDF

SEQ ID NO: 38225 - protein, 28 aa, Artificial Sequence
  Description of Artificial Sequence: Synthetic peptide
SEVEIAATNPVATEIFGSVSTNEQRGDF

SEQ ID NO: 38226 - protein, 30 aa, Artificial Sequence
  Description of Artificial Sequence: Synthetic polypeptide
ESNEIRTTNPCATEQYGNVSSENLQRNGNH

SEQ ID NO: 38227 - protein, 30 aa, Artificial Sequence
  Description of Artificial Sequence: Synthetic polypeptide
DEEEIRTTNPVATEQYGSVDCDMDDCNGNC

SEQ ID NO: 38228 - protein, 29 aa, Artificial Sequence
  Description of Artificial Sequence: Synthetic peptide
QEQEIAATNPVATEQYGEASAENLQRGGR

SEQ ID NO: 38229 - protein, 31 aa, Artificial Sequence
  Description of Artificial Sequence: Synthetic polypeptide
SEVEIACTNPVATEQYGSVSEMNEQREGNDR

SEQ ID NO: 38230 - protein, 31 aa, Artificial Sequence
  Description of Artificial Sequence: Synthetic polypeptide
DEEEIRTTNPVATEQYGSVSELDPVQLNGDS

SEQ ID NO: 38231 - protein, 30 aa, Artificial Sequence
  Description of Artificial Sequence: Synthetic polypeptide
MENEIRTTNPVATECYGSVSTNEQDHEGEQ

SEQ ID NO: 38232 - protein, 31 aa, Artificial Sequence
  Description of Artificial Sequence: Synthetic polypeptide
DEVEIATTNPTATEQYGSVSTMNEQIEGDNE

SEQ ID NO: 38233 - protein, 28 aa, Artificial Sequence
  Description of Artificial Sequence: Synthetic peptide
DEQELATTNPVATECYGSTSTDLQHGEN

SEQ ID NO: 38234 - protein, 28 aa, Artificial Sequence
  Description of Artificial Sequence: Synthetic peptide
DENEIVTTNPCATEQYGDVPTGLQRPTD

SEQ ID NO: 38235 - protein, 31 aa, Artificial Sequence
  Description of Artificial Sequence: Synthetic polypeptide
DEEEIRTTNPVATEQYGSVSDDLQEHDEEDM

SEQ ID NO: 38236 - protein, 33 aa, Artificial Sequence
  Description of Artificial Sequence: Synthetic polypeptide
DEEEIRTTNPVATEQYGSVSETNLEDNEGDEDD

SEQ ID NO: 38237 - protein, 29 aa, Artificial Sequence
  Description of Artificial Sequence: Synthetic peptide
DEEEIATTNPVATEQYGEVSEVLQHAEEK

SEQ ID NO: 38238 - protein, 33 aa, Artificial Sequence
  Description of Artificial Sequence: Synthetic polypeptide
DEEEIATTNPVATEQYGSVSTTNQELREGENDT

SEQ ID NO: 38239 - protein, 28 aa, Artificial Sequence
  Description of Artificial Sequence: Synthetic peptide
DEEEITATNPVGTEQYGSVSENPAVGPH

SEQ ID NO: 38240 - protein, 28 aa, Artificial Sequence
  Description of Artificial Sequence: Synthetic peptide
DEGEIVATNPVATEVYGDVSTNIQHGPF

SEQ ID NO: 38241 - protein, 32 aa, Artificial Sequence
  Description of Artificial Sequence: Synthetic polypeptide
DEEEIRTTNPVATEQYGSVSCENPLDCNEGEN

SEQ ID NO: 38242 - protein, 34 aa, Artificial Sequence
  Description of Artificial Sequence: Synthetic polypeptide
DEEEIRTTNPVATEQYGSVSETEGLQVREGEEDS

SEQ ID NO: 38243 - protein, 32 aa, Artificial Sequence
  Description of Artificial Sequence: Synthetic polypeptide
DEEEIRTTNPVATEQYGNVSSEGNPGQDMGNF

SEQ ID NO: 38244 - protein, 28 aa, Artificial Sequence
  Description of Artificial Sequence: Synthetic peptide
YEQEIRTTNPVATDQYGSVSTEDTIGFV

SEQ ID NO: 38245 - protein, 28 aa, Artificial Sequence
  Description of Artificial Sequence: Synthetic peptide
DEQEIRTTNIDATEQYGSVETILEEGEW

SEQ ID NO: 38246 - protein, 28 aa, Artificial Sequence
  Description of Artificial Sequence: Synthetic peptide
QEVEIATTNPVSTEQYGDVSENLQTGEY

SEQ ID NO: 38247 - protein, 31 aa, Artificial Sequence
  Description of Artificial Sequence: Synthetic polypeptide
DEEEIRTTNPVATEQWGSYDTNLMLTNGNDM

SEQ ID NO: 38248 - protein, 28 aa, Artificial Sequence
  Description of Artificial Sequence: Synthetic peptide
DEVEIATTNPVGTEQYGSIPTNEQHFNG

SEQ ID NO: 38249 - protein, 29 aa, Artificial Sequence
  Description of Artificial Sequence: Synthetic peptide
DENEIRTTNPVATECWGSVSENEQNLGTF

SEQ ID NO: 38250 - protein, 28 aa, Artificial Sequence
  Description of Artificial Sequence: Synthetic peptide
DEHEITCTNPVATEHYGAVSDNEQVGNA

SEQ ID NO: 38251 - protein, 28 aa, Artificial Sequence
  Description of Artificial Sequence: Synthetic peptide
SEVEIATTNPTATEMYGEVSTNEQQGNF

SEQ ID NO: 38252 - protein, 28 aa, Artificial Sequence
  Description of Artificial Sequence: Synthetic peptide
DENEIATTNPSASEQYGVVSTNFQIDNN

SEQ ID NO: 38253 - protein, 28 aa, Artificial Sequence
  Description of Artificial Sequence: Synthetic peptide
QEHEISQTNPVATEQYGWVSTNDQNGEG

SEQ ID NO: 38254 - protein, 30 aa, Artificial Sequence
  Description of Artificial Sequence: Synthetic polypeptide
DDQEVRTTNPVATEVYGCVAATNLEREGNR

SEQ ID NO: 38255 - protein, 28 aa, Artificial Sequence
  Description of Artificial Sequence: Synthetic peptide
AENEIAQTNPVATEQYGVVSENQERGDR

SEQ ID NO: 38256 - protein, 30 aa, Artificial Sequence
  Description of Artificial Sequence: Synthetic polypeptide
DEDEIRTTNPVCTEQYGAVSTEDLCGGENA

SEQ ID NO: 38257 - protein, 30 aa, Artificial Sequence
  Description of Artificial Sequence: Synthetic polypeptide
DEQEVRSTNPVATEIYGCVSAMNLERNGNR

SEQ ID NO: 38258 - protein, 31 aa, Artificial Sequence
  Description of Artificial Sequence: Synthetic polypeptide
NETEIRTTNPVATEQYGSVSYCPPPQARGNS

SEQ ID NO: 38259 - protein, 34 aa, Artificial Sequence
  Description of Artificial Sequence: Synthetic polypeptide
DEEEIRTTNPDATEQYGSVSITPGPLVQLPGDNR

SEQ ID NO: 38260 - protein, 28 aa, Artificial Sequence
  Description of Artificial Sequence: Synthetic peptide
DEEEVRTTNPCASEHYGCVATNLEPPNR

SEQ ID NO: 38261 - protein, 28 aa, Artificial Sequence
  Description of Artificial Sequence: Synthetic peptide
DENEIRTTNPVATECWGSVSENEMTGTF

SEQ ID NO: 38262 - protein, 28 aa, Artificial Sequence
  Description of Artificial Sequence: Synthetic peptide
DEEEIRTTNPDATEQYWSWETPDDPGNP

SEQ ID NO: 38263 - protein, 31 aa, Artificial Sequence
  Description of Artificial Sequence: Synthetic polypeptide
DEEEIRTTNPVSTEQYGTVSMENIQQQNGNH

SEQ ID NO: 38264 - protein, 28 aa, Artificial Sequence
  Description of Artificial Sequence: Synthetic peptide
AEVEIAATNPVATENYGWVASNLQRGTR

SEQ ID NO: 38265 - protein, 30 aa, Artificial Sequence
  Description of Artificial Sequence: Synthetic polypeptide
DEVEISTTNPVSTEQYGSVSATADQIGENF

SEQ ID NO: 38266 - protein, 32 aa, Artificial Sequence
  Description of Artificial Sequence: Synthetic polypeptide
DENEIRTTNPVASEIYGSVSTENQVQNNGDNR

SEQ ID NO: 38267 - protein, 29 aa, Artificial Sequence
  Description of Artificial Sequence: Synthetic peptide
MENEIRATNPVATEIYGSVSTDLQNGEDS

SEQ ID NO: 38268 - protein, 28 aa, Artificial Sequence
  Description of Artificial Sequence: Synthetic peptide
DEQEVATTNPIAYMMYGSVSTNYERGNR

SEQ ID NO: 38269 - protein, 31 aa, Artificial Sequence
  Description of Artificial Sequence: Synthetic polypeptide
DEVEIATTNPAATEIYGSVSTCNGLQNGPNE

SEQ ID NO: 38270 - protein, 30 aa, Artificial Sequence
  Description of Artificial Sequence: Synthetic polypeptide
VEDEIRTTNPVASEQYGCVGAMNLERNGNR

SEQ ID NO: 38271 - protein, 32 aa, Artificial Sequence
  Description of Artificial Sequence: Synthetic polypeptide
QEEEIATTNPVATECYGVVSTNLQETNGENDR

SEQ ID NO: 38272 - protein, 33 aa, Artificial Sequence
  Description of Artificial Sequence: Synthetic polypeptide
DEEEIRTTNPVATEQYGSVSATTGLELVEGNDD

SEQ ID NO: 38273 - protein, 28 aa, Artificial Sequence
  Description of Artificial Sequence: Synthetic peptide
AESELASTNPVSTELYGIVATNLQRGNR

SEQ ID NO: 38274 - protein, 34 aa, Artificial Sequence
  Description of Artificial Sequence: Synthetic polypeptide
DEEEIRTTNPVATEQYGSVDCTMNGLCCRGENDD

SEQ ID NO: 38275 - protein, 32 aa, Artificial Sequence
  Description of Artificial Sequence: Synthetic polypeptide
DEEEIRTTNPVATEQYGSVSCENPLDEIDGES

SEQ ID NO: 38276 - protein, 31 aa, Artificial Sequence
  Description of Artificial Sequence: Synthetic polypeptide
DEQEISSTNPVATEQYGDVISTNLQLNGLNA

SEQ ID NO: 38277 - protein, 28 aa, Artificial Sequence
  Description of Artificial Sequence: Synthetic peptide
DENEIRAVNPVATECYGVVSTDLQQGEM

SEQ ID NO: 38278 - protein, 32 aa, Artificial Sequence
  Description of Artificial Sequence: Synthetic polypeptide
DEEEIRTTNPVATEQYGSVDCTMALEHAGNDD

SEQ ID NO: 38279 - protein, 34 aa, Artificial Sequence
  Description of Artificial Sequence: Synthetic polypeptide
DEEEIRQTNPVATEQYGSVSVTGGLVEDRGDNDR

SEQ ID NO: 38280 - protein, 32 aa, Artificial Sequence
  Description of Artificial Sequence: Synthetic polypeptide
DEEEIRTTNPVATEQYGSVSDTELEINGEEDA

SEQ ID NO: 38281 - protein, 33 aa, Artificial Sequence
  Description of Artificial Sequence: Synthetic polypeptide
DEEEIRTTNPTATEQYGSVSTANEQEIEGDNTV

SEQ ID NO: 38282 - protein, 33 aa, Artificial Sequence
  Description of Artificial Sequence: Synthetic polypeptide
DEVEIRTTNPVATEQYGSVSTMNEQEIEGDNDE

SEQ ID NO: 38283 - protein, 33 aa, Artificial Sequence
  Description of Artificial Sequence: Synthetic polypeptide
DEEEIRTTNPIATEIYGSVSETNGLQLDGENEL

SEQ ID NO: 38284 - protein, 28 aa, Artificial Sequence
  Description of Artificial Sequence: Synthetic peptide
DEMEICTTNPVATEIYGQVSTPDQMGDQ

SEQ ID NO: 38285 - protein, 33 aa, Artificial Sequence
  Description of Artificial Sequence: Synthetic polypeptide
DEEEIRQTNPVATEQYGSVDETGGLQRNGEEDR

SEQ ID NO: 38286 - protein, 33 aa, Artificial Sequence
  Description of Artificial Sequence: Synthetic polypeptide
DEEEIRTTNPVATEQYGSVISATENPQINGTHG

SEQ ID NO: 38287 - protein, 30 aa, Artificial Sequence
  Description of Artificial Sequence: Synthetic polypeptide
DEGEITATNPVATECFGSVSTGNLQQGDDR

SEQ ID NO: 38288 - protein, 28 aa, Artificial Sequence
  Description of Artificial Sequence: Synthetic peptide
SEEEIRATNPEATEQYGSVSTGPQHETV

SEQ ID NO: 38289 - protein, 30 aa, Artificial Sequence
  Description of Artificial Sequence: Synthetic polypeptide
DEEEIATTNPVATELYGIVSDDLQYANGNI

SEQ ID NO: 38290 - protein, 34 aa, Artificial Sequence
  Description of Artificial Sequence: Synthetic polypeptide
DEEEIRCTNPVATEAYDGSVYSTNNNLVRGVNER

SEQ ID NO: 38291 - protein, 31 aa, Artificial Sequence
  Description of Artificial Sequence: Synthetic polypeptide
DEEEIRTTNPVATEQYGDVSENLQEHQEEDM

SEQ ID NO: 38292 - protein, 28 aa, Artificial Sequence
  Description of Artificial Sequence: Synthetic peptide
SEQEISTTNPVGTEQYGQVSTNLNLGDD

SEQ ID NO: 38293 - protein, 31 aa, Artificial Sequence
  Description of Artificial Sequence: Synthetic polypeptide
QENEIRATNPVATECYGVVSTNLQMREGEND

SEQ ID NO: 38294 - protein, 28 aa, Artificial Sequence
  Description of Artificial Sequence: Synthetic peptide
DEEEIRSTNPVATEVYGGVCIELNVGPR

SEQ ID NO: 38295 - protein, 28 aa, Artificial Sequence
  Description of Artificial Sequence: Synthetic peptide
DEQEIACTNPTATEVYGCVGMNLQVGNR

SEQ ID NO: 38296 - protein, 30 aa, Artificial Sequence
  Description of Artificial Sequence: Synthetic polypeptide
DEEEIAATNPTATEQFGGVSTNPQREGTTR

SEQ ID NO: 38297 - protein, 31 aa, Artificial Sequence
  Description of Artificial Sequence: Synthetic polypeptide
DEEEIRPTNPDATEQYGEVSMTGDPQTGNER

SEQ ID NO: 38298 - protein, 33 aa, Artificial Sequence
  Description of Artificial Sequence: Synthetic polypeptide
DEEEIRTTNPVATEQYGSVSETNLEEPDGDEDF

SEQ ID NO: 38299 - protein, 31 aa, Artificial Sequence
  Description of Artificial Sequence: Synthetic polypeptide
QEEEIRTTNPVATECYGSVSANDLEEHNGER

SEQ ID NO: 38300 - protein, 31 aa, Artificial Sequence
  Description of Artificial Sequence: Synthetic polypeptide
DEEEIVTTNPVATEQYGVVSCENEQQEGNDL

SEQ ID NO: 38301 - protein, 31 aa, Artificial Sequence
  Description of Artificial Sequence: Synthetic polypeptide
DEGEIRTTNPVATECYGWVSTELQIVNGNDT

SEQ ID NO: 38302 - protein, 28 aa, Artificial Sequence
  Description of Artificial Sequence: Synthetic peptide
AEEEIAQTNPFATEQYGVVSTDLERGED

SEQ ID NO: 38303 - protein, 28 aa, Artificial Sequence
  Description of Artificial Sequence: Synthetic peptide
DENEIAQTNPCATEQYGVVSEDLERGNA

SEQ ID NO: 38304 - protein, 30 aa, Artificial Sequence
  Description of Artificial Sequence: Synthetic polypeptide
MENEIATTNPVATEMYGSVSENLQDTEGNM

SEQ ID NO: 38305 - protein, 29 aa, Artificial Sequence
  Description of Artificial Sequence: Synthetic peptide
DEGEIRMTNPVATEMYGCVSTQLQQGLDN

SEQ ID NO: 38306 - protein, 30 aa, Artificial Sequence
  Description of Artificial Sequence: Synthetic polypeptide
DEEEIRTTNPTATEQYGEVSENPQELGDTH

SEQ ID NO: 38307 - protein, 29 aa, Artificial Sequence
  Description of Artificial Sequence: Synthetic peptide
DEQEIRTTNPVATECWGSYSTNEMMQGNM

SEQ ID NO: 38308 - protein, 31 aa, Artificial Sequence
  Description of Artificial Sequence: Synthetic polypeptide
DEEEIMTTNPVATEQYGGVNTGNWQMQGNTE

SEQ ID NO: 38309 - protein, 32 aa, Artificial Sequence
  Description of Artificial Sequence: Synthetic polypeptide
DEEEIRTTNPVATEHFGGVSTANLPQIGNNWQ

SEQ ID NO: 38310 - protein, 31 aa, Artificial Sequence
  Description of Artificial Sequence: Synthetic polypeptide
DEEEISATNPCATEQYGEVSTTNLNQLQGNF

SEQ ID NO: 38311 - protein, 32 aa, Artificial Sequence
  Description of Artificial Sequence: Synthetic polypeptide
DEEEIAQTNPVATEQYGSVSTGLVEDRGDNDI

SEQ ID NO: 38312 - protein, 29 aa, Artificial Sequence
  Description of Artificial Sequence: Synthetic peptide
DEAEIAQTNPVATEMYGVTSCNLQSRGNY

SEQ ID NO: 38313 - protein, 33 aa, Artificial Sequence
  Description of Artificial Sequence: Synthetic polypeptide
DEEEIRTTNPVATEQYGSVFCEMNLCCRDGFNC

SEQ ID NO: 38314 - protein, 29 aa, Artificial Sequence
  Description of Artificial Sequence: Synthetic peptide
QDEEIRATNPVATEFFGSVSTNEQQGDNP

SEQ ID NO: 38315 - protein, 33 aa, Artificial Sequence
  Description of Artificial Sequence: Synthetic polypeptide
DEEEIRTTNPVATEQYGSVSETNLEDPDGEEDH

SEQ ID NO: 38316 - protein, 29 aa, Artificial Sequence
  Description of Artificial Sequence: Synthetic peptide
DEEEINATNPVSTEQYGVVGTILQSRGGH

SEQ ID NO: 38317 - protein, 29 aa, Artificial Sequence
  Description of Artificial Sequence: Synthetic peptide
MENEIRTTNPVATECYGSVSEDLQDSGDM

SEQ ID NO: 38318 - protein, 33 aa, Artificial Sequence
  Description of Artificial Sequence: Synthetic polypeptide
DEEEIRSTNPVATEQYGSVSDTEALQQEGENDI

SEQ ID NO: 38319 - protein, 33 aa, Artificial Sequence
  Description of Artificial Sequence: Synthetic polypeptide
DEEEIRTTNPVATEQYGSVSITPNPLFIDGDEP

SEQ ID NO: 38320 - protein, 28 aa, Artificial Sequence
  Description of Artificial Sequence: Synthetic peptide
DENEIAQTNPVATEQYGVVSTDQEDGNA

SEQ ID NO: 38321 - protein, 32 aa, Artificial Sequence
  Description of Artificial Sequence: Synthetic polypeptide
DEQEIATTNPVATEQYGSVSITLNPDRKGNPS

SEQ ID NO: 38322 - protein, 29 aa, Artificial Sequence
  Description of Artificial Sequence: Synthetic peptide
QEGEITTTNPVATECYGSVSVGNLQQGDP

SEQ ID NO: 38323 - protein, 31 aa, Artificial Sequence
  Description of Artificial Sequence: Synthetic polypeptide
DEEEIRTTNPVATEQYGSVDTMDECDTNGNC

SEQ ID NO: 38324 - protein, 29 aa, Artificial Sequence
  Description of Artificial Sequence: Synthetic peptide
DENEIRCTNPVATEQWGIVSTNLMMQGTA

SEQ ID NO: 38325 - protein, 32 aa, Artificial Sequence
  Description of Artificial Sequence: Synthetic polypeptide
DEQEIRTTNPVATEQYGVVSCEMNLQCQGNDY

SEQ ID NO: 38326 - protein, 31 aa, Artificial Sequence
  Description of Artificial Sequence: Synthetic polypeptide
DEQEIATTNPVATECYGSVSATDLQRNGEDL

SEQ ID NO: 38327 - protein, 31 aa, Artificial Sequence
  Description of Artificial Sequence: Synthetic polypeptide
DEVEITTTNPVATEHYGSVSATGNPEIRGNF

SEQ ID NO: 38328 - protein, 31 aa, Artificial Sequence
  Description of Artificial Sequence: Synthetic polypeptide
DEEEIRTTNPCATEQYGDVSCTMELCYVGNV

SEQ ID NO: 38329 - protein, 28 aa, Artificial Sequence
  Description of Artificial Sequence: Synthetic peptide
QEQEIVTVNPVATEQYGSVAEVLQHGNM

SEQ ID NO: 38330 - protein, 31 aa, Artificial Sequence
  Description of Artificial Sequence: Synthetic polypeptide
DEEEIRTTNPVATEQYGDVSENLQDTSEEDN

SEQ ID NO: 38331 - protein, 31 aa, Artificial Sequence
  Description of Artificial Sequence: Synthetic polypeptide
DNEEIRSTNPVATEQYGSVNTNGEQREGDPQ

SEQ ID NO: 38332 - protein, 33 aa, Artificial Sequence
  Description of Artificial Sequence: Synthetic polypeptide
DEEEIRTTNPVATEQYGSVETLNPDQDEGDEPR

SEQ ID NO: 38333 - protein, 28 aa, Artificial Sequence
  Description of Artificial Sequence: Synthetic peptide
DENEIAQTNPVATEQYGDVSTGDEHGNQ

SEQ ID NO: 38334 - protein, 28 aa, Artificial Sequence
  Description of Artificial Sequence: Synthetic peptide
DEEEIRTTNPFATEQYWSVSPDLEAEED

SEQ ID NO: 38335 - protein, 30 aa, Artificial Sequence
  Description of Artificial Sequence: Synthetic polypeptide
DEREIVATNPVSTDQYGSVSENLQRGGADR

SEQ ID NO: 38336 - protein, 33 aa, Artificial Sequence
  Description of Artificial Sequence: Synthetic polypeptide
DEEEIRTTNPTATEQYGSVISTMNEQESGDNDG

SEQ ID NO: 38337 - protein, 28 aa, Artificial Sequence
  Description of Artificial Sequence: Synthetic peptide
YEHEIATTNPVSTEQYGAVSTDLEAGNV

SEQ ID NO: 38338 - protein, 28 aa, Artificial Sequence
  Description of Artificial Sequence: Synthetic peptide
SEEEIRCTNPIATEIFGSVSTDLQSGLL

SEQ ID NO: 38339 - protein, 33 aa, Artificial Sequence
  Description of Artificial Sequence: Synthetic polypeptide
DEEEIRTTNPVATEQYGSVSETNLEEVEGDEDF

SEQ ID NO: 38340 - protein, 34 aa, Artificial Sequence
  Description of Artificial Sequence: Synthetic polypeptide
DEEEIRTTNPVATEQYGSVSITGDLVENNGDNDR

SEQ ID NO: 38341 - protein, 34 aa, Artificial Sequence
  Description of Artificial Sequence: Synthetic polypeptide
DEEEIRTTNPVATEQYGSVESDTPNPLDPEGENP

SEQ ID NO: 38342 - protein, 31 aa, Artificial Sequence
  Description of Artificial Sequence: Synthetic polypeptide
GEEEIATTNPVATEQYGSVAEDLQESEGNDR

SEQ ID NO: 38343 - protein, 33 aa, Artificial Sequence
  Description of Artificial Sequence: Synthetic polypeptide
DEEEIRTTNPVATEQYGSVSTEDNGLEYKEENE

SEQ ID NO: 38344 - protein, 30 aa, Artificial Sequence
  Description of Artificial Sequence: Synthetic polypeptide
DENEIATTNPVATECYGSVSTDLEIHNGNQ

SEQ ID NO: 38345 - protein, 34 aa, Artificial Sequence
  Description of Artificial Sequence: Synthetic polypeptide
DEEEIRTTNPVATEQYGSVSITTDLEEVEGDNDR

SEQ ID NO: 38346 - protein, 28 aa, Artificial Sequence
  Description of Artificial Sequence: Synthetic peptide
QEEEITATNPVATECFGSVSTNWQQGTS

SEQ ID NO: 38347 - protein, 28 aa, Artificial Sequence
  Description of Artificial Sequence: Synthetic peptide
DEEEIATTNPVATECYGDVSECLQHEEL

SEQ ID NO: 38348 - protein, 31 aa, Artificial Sequence
  Description of Artificial Sequence: Synthetic polypeptide
DEEEIATTNPVATEQYGDVSCEEPLQLGDNV

SEQ ID NO: 38349 - protein, 32 aa, Artificial Sequence
  Description of Artificial Sequence: Synthetic polypeptide
DEEEIRTTNPVATEQYGSVFITMALEPVGNDS

SEQ ID NO: 38350 - protein, 34 aa, Artificial Sequence
  Description of Artificial Sequence: Synthetic polypeptide
DEEEIRTTNPVATEQYGSVSCTGNWQYVDGENDC

SEQ ID NO: 38351 - protein, 34 aa, Artificial Sequence
  Description of Artificial Sequence: Synthetic polypeptide
DEEEIRTTNPVATEQYGSVSTPNPLQEDDGDEDE

SEQ ID NO: 38352 - protein, 28 aa, Artificial Sequence
  Description of Artificial Sequence: Synthetic peptide
NEEEIRTTNPVCTEIYGTVSMADQMGND

SEQ ID NO: 38353 - protein, 31 aa, Artificial Sequence
  Description of Artificial Sequence: Synthetic polypeptide
DEQEIRTTNPVATEWYGWVSTNLQEVEGDDN

SEQ ID NO: 38354 - protein, 29 aa, Artificial Sequence
  Description of Artificial Sequence: Synthetic peptide
DDEEIRTTNPIAYEIYGAVGSNLERNGNR

SEQ ID NO: 38355 - protein, 32 aa, Artificial Sequence
  Description of Artificial Sequence: Synthetic polypeptide
DEEEIRTTNPVATEQYGDVSCENLCCHAGNDQ

SEQ ID NO: 38356 - protein, 33 aa, Artificial Sequence
  Description of Artificial Sequence: Synthetic polypeptide
DEEEIRTTNPVATEQYGHSVHQTPPLLIRGENP

SEQ ID NO: 38357 - protein, 30 aa, Artificial Sequence
  Description of Artificial Sequence: Synthetic polypeptide
CEEEIRTTNPVATEQYGSASTDLEDLEGDQ

SEQ ID NO: 38358 - protein, 31 aa, Artificial Sequence
  Description of Artificial Sequence: Synthetic polypeptide
DEQEIRTTNPVATEQYGDVSCEMDLQTGNDM

SEQ ID NO: 38359 - protein, 30 aa, Artificial Sequence
  Description of Artificial Sequence: Synthetic polypeptide
DEEEIRATNPFATEQYGSVSEVGNPEDGNP

SEQ ID NO: 38360 - protein, 29 aa, Artificial Sequence
  Description of Artificial Sequence: Synthetic peptide
AEVEITATNPVSTEQYGSVSENLQHAGMR

SEQ ID NO: 38361 - protein, 33 aa, Artificial Sequence
  Description of Artificial Sequence: Synthetic polypeptide
SEGEIYTTNPVATEQYGSVSATCNGLPQSGPNR

SEQ ID NO: 38362 - protein, 32 aa, Artificial Sequence
  Description of Artificial Sequence: Synthetic polypeptide
DEEEIRTTNPVATEQYGSVSTDPEQDTDGDDE

SEQ ID NO: 38363 - protein, 34 aa, Artificial Sequence
  Description of Artificial Sequence: Synthetic polypeptide
DEEEIRTTNPVATEQYGSYVTSETNDTEIRGENP

SEQ ID NO: 38364 - protein, 28 aa, Artificial Sequence
  Description of Artificial Sequence: Synthetic peptide
DDSEIRSTNPVSTEGYGNVANNLQRGQR

SEQ ID NO: 38365 - protein, 32 aa, Artificial Sequence
  Description of Artificial Sequence: Synthetic polypeptide
DEEEIRTTNPVATEQYGSVSEENEQDEDGDPH

SEQ ID NO: 38366 - protein, 28 aa, Artificial Sequence
  Description of Artificial Sequence: Synthetic peptide
DEEEIVTTNPVATEQYGEASEVLQHEEK

SEQ ID NO: 38367 - protein, 33 aa, Artificial Sequence
  Description of Artificial Sequence: Synthetic polypeptide
DEEEIRTTNPVATEQYGVVDSVTIDPGQRKGNS

SEQ ID NO: 38368 - protein, 35 aa, Artificial Sequence
  Description of Artificial Sequence: Synthetic polypeptide
DEEEIRTTNPVATEQYGSVCSETCPLVLDRKGTNR

SEQ ID NO: 38369 - protein, 28 aa, Artificial Sequence
  Description of Artificial Sequence: Synthetic peptide
SEGEIAATNPTATEQFGSVSENLQVGNA

SEQ ID NO: 38370 - protein, 30 aa, Artificial Sequence
  Description of Artificial Sequence: Synthetic polypeptide
VENEIRTTNPVATECYGSVSDTELEIHGNH

SEQ ID NO: 38371 - protein, 31 aa, Artificial Sequence
  Description of Artificial Sequence: Synthetic polypeptide
QEEEIRTTNPVATEQYGVVGTCDLQERDPMR

SEQ ID NO: 38372 - protein, 28 aa, Artificial Sequence
  Description of Artificial Sequence: Synthetic peptide
AEAEINTTNPVATECYGEVSTNVQRPPH

SEQ ID NO: 38373 - protein, 28 aa, Artificial Sequence
  Description of Artificial Sequence: Synthetic peptide
DETEIRTTNPVATEQYGTTGTEDETGNI

SEQ ID NO: 38374 - protein, 34 aa, Artificial Sequence
  Description of Artificial Sequence: Synthetic polypeptide
DEEEIRTTNPVATEQYGSVSTTDNLVEEVEGDNC

SEQ ID NO: 38375 - protein, 31 aa, Artificial Sequence
  Description of Artificial Sequence: Synthetic polypeptide
QENEIATTNPVATECYGSVSDTDLERNGENR

SEQ ID NO: 38376 - protein, 29 aa, Artificial Sequence
  Description of Artificial Sequence: Synthetic peptide
NEEEIRTTNPIATEWFGCVSMNLQFRGTD

SEQ ID NO: 38377 - protein, 28 aa, Artificial Sequence
  Description of Artificial Sequence: Synthetic peptide
DENEIAQTNPVATEQYGDVSTDQEVGND

SEQ ID NO: 38378 - protein, 30 aa, Artificial Sequence
  Description of Artificial Sequence: Synthetic polypeptide
DEEEIGTTNPVATEQYGEVSACQLQQSGQL

SEQ ID NO: 38379 - protein, 28 aa, Artificial Sequence
  Description of Artificial Sequence: Synthetic peptide
DEDEISTTNPVATEMWGFISENLQHFNR

SEQ ID NO: 38380 - protein, 28 aa, Artificial Sequence
  Description of Artificial Sequence: Synthetic peptide
DEAEIVTTNPVCTEQYGSVSMEEEVGNY

SEQ ID NO: 38381 - protein, 28 aa, Artificial Sequence
  Description of Artificial Sequence: Synthetic peptide
DENEIAQTNPVATEQYGQVSTPQELGND

SEQ ID NO: 38382 - protein, 30 aa, Artificial Sequence
  Description of Artificial Sequence: Synthetic polypeptide
DEQEIRTTNPVATECYGSVSEDLQDQGDDS

SEQ ID NO: 38383 - protein, 28 aa, Artificial Sequence
  Description of Artificial Sequence: Synthetic peptide
DEEEVATTNPIAYEMYGSVSTAYERGPR

SEQ ID NO: 38384 - protein, 28 aa, Artificial Sequence
  Description of Artificial Sequence: Synthetic peptide
SEEEICTTNPTATEQYGEVSENEQNGTE

SEQ ID NO: 38385 - protein, 29 aa, Artificial Sequence
  Description of Artificial Sequence: Synthetic peptide
DENEIRTTNPVATECWGIVSENLENGGDR

SEQ ID NO: 38386 - protein, 29 aa, Artificial Sequence
  Description of Artificial Sequence: Synthetic peptide
DENEIRTTNPVATECWGSVSTEDENRGDT

SEQ ID NO: 38387 - protein, 31 aa, Artificial Sequence
  Description of Artificial Sequence: Synthetic polypeptide
DEEEIRATNPSATEQYGSVSCTFECYQVGER

SEQ ID NO: 38388 - protein, 33 aa, Artificial Sequence
  Description of Artificial Sequence: Synthetic polypeptide
DEEEIRTTNPVATEQYGSVSITEELEDNDGNEL

SEQ ID NO: 38389 - protein, 28 aa, Artificial Sequence
  Description of Artificial Sequence: Synthetic peptide
QESEIYTTNPVATEIYGEVSYNLEDGNM

SEQ ID NO: 38390 - protein, 28 aa, Artificial Sequence
  Description of Artificial Sequence: Synthetic peptide
DEEEIRTTNPVATEQYGDVWETDQSEEA

SEQ ID NO: 38391 - protein, 30 aa, Artificial Sequence
  Description of Artificial Sequence: Synthetic polypeptide
DEHEICTTNPCATECYGSVSTDLQETNGNM

SEQ ID NO: 38392 - protein, 34 aa, Artificial Sequence
  Description of Artificial Sequence: Synthetic polypeptide
DEEEIRTTNPTATEQYGSVYSTLNLQDIEGDNTG

SEQ ID NO: 38393 - protein, 28 aa, Artificial Sequence
  Description of Artificial Sequence: Synthetic peptide
SEGEIRCTNPVATECFGGVSTNPQHGNG

SEQ ID NO: 38394 - protein, 31 aa, Artificial Sequence
  Description of Artificial Sequence: Synthetic polypeptide
DEEEIGTTNPVATEQYGSVQLANSEQIGITR

SEQ ID NO: 38395 - protein, 28 aa, Artificial Sequence
  Description of Artificial Sequence: Synthetic peptide
DEDEIRATNPVATEQYGGCSDTLQHGTT

SEQ ID NO: 38396 - protein, 28 aa, Artificial Sequence
  Description of Artificial Sequence: Synthetic peptide
DEGEIATTNPVATECYGAVSTDLEPGEN

SEQ ID NO: 38397 - protein, 28 aa, Artificial Sequence
  Description of Artificial Sequence: Synthetic peptide
SEGEIRATNPTATEMFGSVSTNPQNGNF

SEQ ID NO: 38398 - protein, 33 aa, Artificial Sequence
  Description of Artificial Sequence: Synthetic polypeptide
DEEEIRTTNPVATEQYGSVDCTCALQEEMGENS

SEQ ID NO: 38399 - protein, 28 aa, Artificial Sequence
  Description of Artificial Sequence: Synthetic peptide
DEEEIAATNPVATEMFGTVSDNEQIGTR

SEQ ID NO: 38400 - protein, 32 aa, Artificial Sequence
  Description of Artificial Sequence: Synthetic polypeptide
DEEEIRTTNPVATEQYGSVDTMDEQCDTNGNC

SEQ ID NO: 38401 - protein, 28 aa, Artificial Sequence
  Description of Artificial Sequence: Synthetic peptide
DENEIRTVNPVATEMYGEAAEVLQRGGR

SEQ ID NO: 38402 - protein, 32 aa, Artificial Sequence
  Description of Artificial Sequence: Synthetic polypeptide
DEEEIRTTNPVATEQYGSVDCEMDLQCHGNDA

SEQ ID NO: 38403 - protein, 28 aa, Artificial Sequence
  Description of Artificial Sequence: Synthetic peptide
YEEEIVCTNPVCTEQYGSVSTEEEVGNY

SEQ ID NO: 38404 - protein, 28 aa, Artificial Sequence
  Description of Artificial Sequence: Synthetic peptide
QEQEITTTNPVATECYGWVSTDLEQGNA

SEQ ID NO: 38405 - protein, 30 aa, Artificial Sequence
  Description of Artificial Sequence: Synthetic polypeptide
DEEEIRTTNPVAYEQYGSYSEHLMIGDNDS

SEQ ID NO: 38406 - protein, 34 aa, Artificial Sequence
  Description of Artificial Sequence: Synthetic polypeptide
DEEEIRTTNPVATEQYGSVCSDTGNLQDQGDEEY

SEQ ID NO: 38407 - protein, 28 aa, Artificial Sequence
  Description of Artificial Sequence: Synthetic peptide
QENEIATTNPVATECYGSVSTDLEVGEL

SEQ ID NO: 38408 - protein, 30 aa, Artificial Sequence
  Description of Artificial Sequence: Synthetic polypeptide
QENEIVTTNPVATECYGSVSTELQVTGENQ

SEQ ID NO: 38409 - protein, 28 aa, Artificial Sequence
  Description of Artificial Sequence: Synthetic peptide
DEEEIATTNPTATEQYGEVSENEQQEDF

SEQ ID NO: 38410 - protein, 34 aa, Artificial Sequence
  Description of Artificial Sequence: Synthetic polypeptide
DEEEIRTTNPDATEQYGSVSDTPNPLQIPEGDNP

SEQ ID NO: 38411 - protein, 28 aa, Artificial Sequence
  Description of Artificial Sequence: Synthetic peptide
DEEEIRTTNPVATEQYGDVSECPCHEEM

SEQ ID NO: 38412 - protein, 28 aa, Artificial Sequence
  Description of Artificial Sequence: Synthetic peptide
DENEIRTTNPVATEWYGIVTEEEQSGNF

SEQ ID NO: 38413 - protein, 29 aa, Artificial Sequence
  Description of Artificial Sequence: Synthetic peptide
DEEEISTTNPVASEQYGECSEQLQQNGNQ

SEQ ID NO: 38414 - protein, 28 aa, Artificial Sequence
  Description of Artificial Sequence: Synthetic peptide
YDEEIATTNPVSTESYGCVCTNWQRENR

SEQ ID NO: 38415 - protein, 32 aa, Artificial Sequence
  Description of Artificial Sequence: Synthetic polypeptide
DEEEIRTTNPVATEQYGSVFCEMNLCCAGDNC

SEQ ID NO: 38416 - protein, 31 aa, Artificial Sequence
  Description of Artificial Sequence: Synthetic polypeptide
DEEEIRTTNPVATECYGSVSTDLEDVNGEDN

SEQ ID NO: 38417 - protein, 34 aa, Artificial Sequence
  Description of Artificial Sequence: Synthetic polypeptide
DEEEIRTTNPVATEQYGSVTSDTPNPLDPEGENP

SEQ ID NO: 38418 - protein, 29 aa, Artificial Sequence
  Description of Artificial Sequence: Synthetic peptide
DENEIGCTNPVSTEQYGTASATVLQRGGR

SEQ ID NO: 38419 - protein, 28 aa, Artificial Sequence
  Description of Artificial Sequence: Synthetic peptide
DEEEIRTTNPIATEQYGTTGTELEREMI

SEQ ID NO: 38420 - protein, 28 aa, Artificial Sequence
  Description of Artificial Sequence: Synthetic peptide
AENEIACTNPVATEQYGEASEVLQRGGR

SEQ ID NO: 38421 - protein, 32 aa, Artificial Sequence
  Description of Artificial Sequence: Synthetic polypeptide
DEEEIRTTNPVATEQYGSVDSCEMNEQTKGEI

SEQ ID NO: 38422 - protein, 31 aa, Artificial Sequence
  Description of Artificial Sequence: Synthetic polypeptide
DEQEIRTTNPVATEQYGVVSCEMNLCQGNDY

SEQ ID NO: 38423 - protein, 28 aa, Artificial Sequence
  Description of Artificial Sequence: Synthetic peptide
SENETASVNPVAYEQYGSVSTNLQRPNF

SEQ ID NO: 38424 - protein, 33 aa, Artificial Sequence
  Description of Artificial Sequence: Synthetic polypeptide
DEEEIRTTNPVATEQYGVVCSTEDLQRKGEEDI

SEQ ID NO: 38425 - protein, 30 aa, Artificial Sequence
  Description of Artificial Sequence: Synthetic polypeptide
DEEEVRCTNPVASEIYGCVAATNLEREGNR

SEQ ID NO: 38426 - protein, 33 aa, Artificial Sequence
  Description of Artificial Sequence: Synthetic polypeptide
DEEEIRTTNPVATEQYWSVETPNPLPDRGDEPR

SEQ ID NO: 38427 - protein, 32 aa, Artificial Sequence
  Description of Artificial Sequence: Synthetic polypeptide
DEEEIRTTNPVATEQYGSVDCTMELCDSGNDC

SEQ ID NO: 38428 - protein, 31 aa, Artificial Sequence
  Description of Artificial Sequence: Synthetic polypeptide
DEEEIRTTNPVATEQYGDVSENLQIHAEEDI

SEQ ID NO: 38429 - protein, 32 aa, Artificial Sequence
  Description of Artificial Sequence: Synthetic polypeptide
DEDEIRATNPVATEQYGEVISTMNGLQQEGNI

SEQ ID NO: 38430 - protein, 28 aa, Artificial Sequence
  Description of Artificial Sequence: Synthetic peptide
DEDEIRSTNPVSYEQYGSVSTALMPGTM

SEQ ID NO: 38431 - protein, 33 aa, Artificial Sequence
  Description of Artificial Sequence: Synthetic polypeptide
DEEEIRTTNPTATEQYGSVSTCNEQDLEGDNTE

SEQ ID NO: 38432 - protein, 33 aa, Artificial Sequence
  Description of Artificial Sequence: Synthetic polypeptide
DEEEIRTTNPVATEQYGSVSETVGNDTDERGEF

SEQ ID NO: 38433 - protein, 28 aa, Artificial Sequence
  Description of Artificial Sequence: Synthetic peptide
QEQEITTTNPVATEGYGSVSTELEDGEL

SEQ ID NO: 38434 - protein, 28 aa, Artificial Sequence
  Description of Artificial Sequence: Synthetic peptide
DEEEIRATNPVATEQYGIASTAGEVGDL

SEQ ID NO: 38435 - protein, 31 aa, Artificial Sequence
  Description of Artificial Sequence: Synthetic polypeptide
DDQEIRTTNPVATECYGSVSTNGLQEDKGET

SEQ ID NO: 38436 - protein, 34 aa, Artificial Sequence
  Description of Artificial Sequence: Synthetic polypeptide
DEEEIRTTNPVATEQYGSVDDVTQNGGERKGINR

SEQ ID NO: 38437 - protein, 28 aa, Artificial Sequence
  Description of Artificial Sequence: Synthetic peptide
DEEEIATTNPVATECYGDVSECLQHEEN

SEQ ID NO: 38438 - protein, 28 aa, Artificial Sequence
  Description of Artificial Sequence: Synthetic peptide
SEEEIRATNPEATETYGEVSTNLDIGLQ

SEQ ID NO: 38439 - protein, 28 aa, Artificial Sequence
  Description of Artificial Sequence: Synthetic peptide
SEEEIAATNPTATEQYGGVSENPQVGNA

SEQ ID NO: 38440 - protein, 28 aa, Artificial Sequence
  Description of Artificial Sequence: Synthetic peptide
DEEEIRTTNPVATEQYGDVSECDEHEEQ

SEQ ID NO: 38441 - protein, 31 aa, Artificial Sequence
  Description of Artificial Sequence: Synthetic polypeptide
SEEEIRATNPTATEQYGSVISEMNEQQEGNR

SEQ ID NO: 38442 - protein, 30 aa, Artificial Sequence
  Description of Artificial Sequence: Synthetic polypeptide
DEQEIVTTNPVATEMYGSVSGEELTHGDNR

SEQ ID NO: 38443 - protein, 32 aa, Artificial Sequence
  Description of Artificial Sequence: Synthetic polypeptide
DEEEIRTTNPVATEQYGSVISEMNEPQDQGDF

SEQ ID NO: 38444 - protein, 33 aa, Artificial Sequence
  Description of Artificial Sequence: Synthetic polypeptide
DEEEIRTTNPTATEQYGSVISTENGEPQIGINQ

SEQ ID NO: 38445 - protein, 28 aa, Artificial Sequence
  Description of Artificial Sequence: Synthetic peptide
HETEICSTNPVATEQYGNVAMLLQRGNI

SEQ ID NO: 38446 - protein, 30 aa, Artificial Sequence
  Description of Artificial Sequence: Synthetic polypeptide
QEAEIASTNPVATEQYGSVSEMNLQERGDP

SEQ ID NO: 38447 - protein, 32 aa, Artificial Sequence
  Description of Artificial Sequence: Synthetic polypeptide
DEEEIRTTNPIATEQYGVVAATNLPQMRKELR

SEQ ID NO: 38448 - protein, 35 aa, Artificial Sequence
  Description of Artificial Sequence: Synthetic polypeptide
DEEEIRTTNPVATEQYGSVSSITGPLNQVRGDNPN

SEQ ID NO: 38449 - protein, 28 aa, Artificial Sequence
  Description of Artificial Sequence: Synthetic peptide
DEVEIACTNPVCTECYGTVSTDWQHGNR

SEQ ID NO: 38450 - protein, 32 aa, Artificial Sequence
  Description of Artificial Sequence: Synthetic polypeptide
DEEEIRTTNPVCTEQYGSVSTGNDEVYNGENS

SEQ ID NO: 38451 - protein, 32 aa, Artificial Sequence
  Description of Artificial Sequence: Synthetic polypeptide
DEEEIRTTNPVATEQYGSVSITDQEENNGNDS

SEQ ID NO: 38452 - protein, 34 aa, Artificial Sequence
  Description of Artificial Sequence: Synthetic polypeptide
DEEEIRTTNPYATEQYGSVCSSTENGLVDGGMNR

SEQ ID NO: 38453 - protein, 32 aa, Artificial Sequence
  Description of Artificial Sequence: Synthetic polypeptide
DEEEIRQTNPVATEQYGSVSTNPVQENKGEDF

SEQ ID NO: 38454 - protein, 28 aa, Artificial Sequence
  Description of Artificial Sequence: Synthetic peptide
GEEEIASTNPVATEMYGEVACNIQRGGR

SEQ ID NO: 38455 - protein, 31 aa, Artificial Sequence
  Description of Artificial Sequence: Synthetic polypeptide
DEEEIRATNPFATEQYGSVSEVGNPEQDGNP

SEQ ID NO: 38456 - protein, 33 aa, Artificial Sequence
  Description of Artificial Sequence: Synthetic polypeptide
DEEEIRTTNPVATEQYWSVSTPNPLQDDGDEPP

SEQ ID NO: 38457 - protein, 28 aa, Artificial Sequence
  Description of Artificial Sequence: Synthetic peptide
SEVEIRTTNPTATEQFGEVSENEQNGNF

SEQ ID NO: 38458 - protein, 28 aa, Artificial Sequence
  Description of Artificial Sequence: Synthetic peptide
DDSEIRTTNPCAYEFYGVVASNLERGNR

SEQ ID NO: 38459 - protein, 30 aa, Artificial Sequence
  Description of Artificial Sequence: Synthetic polypeptide
DEEEIRTTNPVATEQYGDVSECLQIHEEDN

SEQ ID NO: 38460 - protein, 30 aa, Artificial Sequence
  Description of Artificial Sequence: Synthetic polypeptide
DENEINSTNPVATEQYGSVSTNLEDMNGEA

SEQ ID NO: 38461 - protein, 34 aa, Artificial Sequence
  Description of Artificial Sequence: Synthetic polypeptide
DEEEIRTTNPVATEQYGSVTDLTAPGLLPRGTNR

SEQ ID NO: 38462 - protein, 31 aa, Artificial Sequence
  Description of Artificial Sequence: Synthetic polypeptide
DEEEIRTTNPVATEQYGDVSECLQEHAGEDL

SEQ ID NO: 38463 - protein, 31 aa, Artificial Sequence
  Description of Artificial Sequence: Synthetic polypeptide
DEQEIRTTNPEATEQYGSVSTNPEQEKGEEN

SEQ ID NO: 38464 - protein, 34 aa, Artificial Sequence
  Description of Artificial Sequence: Synthetic polypeptide
DEEEIRTTNPVATEQYGSVDCTMNGLCCRGDNDD

SEQ ID NO: 38465 - protein, 30 aa, Artificial Sequence
  Description of Artificial Sequence: Synthetic polypeptide
MEEEIRATNPVATESYGVCVSTLPLERGND

SEQ ID NO: 38466 - protein, 28 aa, Artificial Sequence
  Description of Artificial Sequence: Synthetic peptide
QEQEIAATNPVSTEQYGEASEVLQRGNR

SEQ ID NO: 38467 - protein, 29 aa, Artificial Sequence
  Description of Artificial Sequence: Synthetic peptide
DEEEIAAVNPVATEQYGWVSTELQFEGDH

SEQ ID NO: 38468 - protein, 31 aa, Artificial Sequence
  Description of Artificial Sequence: Synthetic polypeptide
SEEEIRTTNPVATECWGSVSTNDMLGAGNDI

SEQ ID NO: 38469 - protein, 28 aa, Artificial Sequence
  Description of Artificial Sequence: Synthetic peptide
DEVEIATTNPVAHEIYGIVSTNWQIGDF

SEQ ID NO: 38470 - protein, 28 aa, Artificial Sequence
  Description of Artificial Sequence: Synthetic peptide
DEEEIATTNPVATEQYGEASEVLQHEEK

SEQ ID NO: 38471 - protein, 32 aa, Artificial Sequence
  Description of Artificial Sequence: Synthetic polypeptide
DEEEIATTNPVATECYGSVSATDLQEHEGNDL

SEQ ID NO: 38472 - protein, 32 aa, Artificial Sequence
  Description of Artificial Sequence: Synthetic polypeptide
DESEIRTTNPVATEQWGSVSCINEPQDRGENG

SEQ ID NO: 38473 - protein, 34 aa, Artificial Sequence
  Description of Artificial Sequence: Synthetic polypeptide
DEEEIRTTNPVATEQYGSVDCTMALQDDEGENDR

SEQ ID NO: 38474 - protein, 29 aa, Artificial Sequence
  Description of Artificial Sequence: Synthetic peptide
AEQEIVTTNPVATECYGFVSATNEQRQPR

SEQ ID NO: 38475 - protein, 30 aa, Artificial Sequence
  Description of Artificial Sequence: Synthetic polypeptide
QEEEIRSTNPCATEQYGSTSTDLQLDNGND

SEQ ID NO: 38476 - protein, 29 aa, Artificial Sequence
  Description of Artificial Sequence: Synthetic peptide
DDQEIRTTNPCATEQYGCVATNLEREPND

SEQ ID NO: 38477 - protein, 34 aa, Artificial Sequence
  Description of Artificial Sequence: Synthetic polypeptide
DEEEIRTTNPVATEQWGHSNVSYTNYLQHRPGGF

SEQ ID NO: 38478 - protein, 33 aa, Artificial Sequence
  Description of Artificial Sequence: Synthetic polypeptide
DEEEIRTTNPVATEQYGSVSETNLEDNDGDEEL

SEQ ID NO: 38479 - protein, 28 aa, Artificial Sequence
  Description of Artificial Sequence: Synthetic peptide
DEGEIATTNPVATENYGEVSVNLIQGPQ

SEQ ID NO: 38480 - protein, 30 aa, Artificial Sequence
  Description of Artificial Sequence: Synthetic polypeptide
DEEEIRTTNPVASEQYGTVSTMDWQESGDT

SEQ ID NO: 38481 - protein, 30 aa, Artificial Sequence
  Description of Artificial Sequence: Synthetic polypeptide
DEEEIAATNPVATECYGSVSTEPLETGDNI

SEQ ID NO: 38482 - protein, 32 aa, Artificial Sequence
  Description of Artificial Sequence: Synthetic polypeptide
DEEEIATTNPVATECYGSVSTNLQEHEGEEDL

SEQ ID NO: 38483 - protein, 31 aa, Artificial Sequence
  Description of Artificial Sequence: Synthetic polypeptide
SEEEIRTTNPVATECYGSVSTELQDYEGEDD

SEQ ID NO: 38484 - protein, 29 aa, Artificial Sequence
  Description of Artificial Sequence: Synthetic peptide
MEQEIRTTNPVATEMYGSVSEELQDIGEM

SEQ ID NO: 38485 - protein, 28 aa, Artificial Sequence
  Description of Artificial Sequence: Synthetic peptide
DEEEIRTTNPFATEQYGSVHEPDFDGEP

SEQ ID NO: 38486 - protein, 33 aa, Artificial Sequence
  Description of Artificial Sequence: Synthetic polypeptide
DEEEIRTTNPVATEQYGSVSETNLEEGDGEEDS

SEQ ID NO: 38487 - protein, 30 aa, Artificial Sequence
  Description of Artificial Sequence: Synthetic polypeptide
VEEEIRTTNPVATEAYGCVGMNLQDRLTER

SEQ ID NO: 38488 - protein, 28 aa, Artificial Sequence
  Description of Artificial Sequence: Synthetic peptide
VESEIRTTNPVATEMYGWASTDLQVGDH

SEQ ID NO: 38489 - protein, 33 aa, Artificial Sequence
  Description of Artificial Sequence: Synthetic polypeptide
DEQEIRTTNPVATEQYGSVDSTEPPLEETGNDR

SEQ ID NO: 38490 - protein, 32 aa, Artificial Sequence
  Description of Artificial Sequence: Synthetic polypeptide
DEEEIRTTNPTATEQYGSVSTANEQEFGDTTG

SEQ ID NO: 38491 - protein, 28 aa, Artificial Sequence
  Description of Artificial Sequence: Synthetic peptide
QEVEIYTTNPVATEIFGSVSTALQGGDN

SEQ ID NO: 38492 - protein, 34 aa, Artificial Sequence
  Description of Artificial Sequence: Synthetic polypeptide
AEEEIRTTNPVATEQYGVVDDTTNGLVQLRGNDR

SEQ ID NO: 38493 - protein, 33 aa, Artificial Sequence
  Description of Artificial Sequence: Synthetic polypeptide
DEEEIRTTNPVATEQYGSVSETNLEEVEGEEDF

SEQ ID NO: 38494 - protein, 32 aa, Artificial Sequence
  Description of Artificial Sequence: Synthetic polypeptide
DEEEIRTTNPCATEQYGSVSTEEWEPQEGENG

SEQ ID NO: 38495 - protein, 35 aa, Artificial Sequence
  Description of Artificial Sequence: Synthetic polypeptide
DEEEIRTTNPVATEQYGSVSSTTPNLPNRNGMNPV

SEQ ID NO: 38496 - protein, 35 aa, Artificial Sequence
  Description of Artificial Sequence: Synthetic polypeptide
DEEEIRTTNPVATEQYGSVSITCNDVQDRKGDNDF

SEQ ID NO: 38497 - protein, 28 aa, Artificial Sequence
  Description of Artificial Sequence: Synthetic peptide
DEDEICCTNPVATEIFGSVSENWQQGNT

SEQ ID NO: 38498 - protein, 31 aa, Artificial Sequence
  Description of Artificial Sequence: Synthetic polypeptide
DEEEIRTTNPVATEQYGSVSDELQEHDEEDN

SEQ ID NO: 38499 - protein, 28 aa, Artificial Sequence
  Description of Artificial Sequence: Synthetic peptide
QEEEIAATNPVATETYGSVSTALQQETY

SEQ ID NO: 38500 - protein, 33 aa, Artificial Sequence
  Description of Artificial Sequence: Synthetic polypeptide
DEEEIRTTNPVATEQYGSVSETNLEDHEGEEDV

SEQ ID NO: 38501 - protein, 33 aa, Artificial Sequence
  Description of Artificial Sequence: Synthetic polypeptide
DEEEIRTTNPVATEQYGSVSDTELQEIEGEEEH

SEQ ID NO: 38502 - protein, 31 aa, Artificial Sequence
  Description of Artificial Sequence: Synthetic polypeptide
DEEEIVTTNPVATECYGWVSETNLERKGDEV

SEQ ID NO: 38503 - protein, 34 aa, Artificial Sequence
  Description of Artificial Sequence: Synthetic polypeptide
DEEEIRTTNPVATEQYGSVDCTMNGLCCRGDNDG

SEQ ID NO: 38504 - protein, 31 aa, Artificial Sequence
  Description of Artificial Sequence: Synthetic polypeptide
DEEEIRTTNPVATELYGSVSCMEDLEEWGNE

SEQ ID NO: 38505 - protein, 28 aa, Artificial Sequence
  Description of Artificial Sequence: Synthetic peptide
QEEEIATTNCVATEQYGVVSTNWLPGMD

SEQ ID NO: 38506 - protein, 29 aa, Artificial Sequence
  Description of Artificial Sequence: Synthetic peptide
DEQEIRTTNPVATECWGSVSENLMMQGTA

SEQ ID NO: 38507 - protein, 31 aa, Artificial Sequence
  Description of Artificial Sequence: Synthetic polypeptide
DEEEIRTTNPVATEQYGSVSEDLQEHDEEDN

SEQ ID NO: 38508 - protein, 28 aa, Artificial Sequence
  Description of Artificial Sequence: Synthetic peptide
AEEEIVTTNPFATEQYGEVSTDPQGGDP

SEQ ID NO: 38509 - protein, 30 aa, Artificial Sequence
  Description of Artificial Sequence: Synthetic polypeptide
SEDEIRATNPVATETYGEVSENLQREGDDR

SEQ ID NO: 38510 - protein, 31 aa, Artificial Sequence
  Description of Artificial Sequence: Synthetic polypeptide
DEEEIRTTNPVATEQYGSVSTPPDQVTEEDV

SEQ ID NO: 38511 - protein, 34 aa, Artificial Sequence
  Description of Artificial Sequence: Synthetic polypeptide
DEREIRTTNPVATEQYGSSVSSPTLNLSRVENNR

SEQ ID NO: 38512 - protein, 30 aa, Artificial Sequence
  Description of Artificial Sequence: Synthetic polypeptide
DEIEICTTNPVATEQYGTCASVTALQGGNI

SEQ ID NO: 38513 - protein, 30 aa, Artificial Sequence
  Description of Artificial Sequence: Synthetic polypeptide
DEEEIAAVNPVATECYGSVSENLQDQGDDR

SEQ ID NO: 38514 - protein, 33 aa, Artificial Sequence
  Description of Artificial Sequence: Synthetic polypeptide
DEEEIRTTNPVATEQYGSVCSTTGGLVLCEGND

SEQ ID NO: 38515 - protein, 28 aa, Artificial Sequence
  Description of Artificial Sequence: Synthetic peptide
AEEEIAQTNPDATEQYGDVSTGDERGER

SEQ ID NO: 38516 - protein, 32 aa, Artificial Sequence
  Description of Artificial Sequence: Synthetic polypeptide
DEQEIRTTNPVATEQYGSVSTLDPDQDHGEDR

SEQ ID NO: 38517 - protein, 28 aa, Artificial Sequence
  Description of Artificial Sequence: Synthetic peptide
DEQEIMTTNPVATEQYGEVSEDDQQLNA

SEQ ID NO: 38518 - protein, 31 aa, Artificial Sequence
  Description of Artificial Sequence: Synthetic polypeptide
DEHEIATTNPVATEQYGSVDCEMNLQHNGNA

SEQ ID NO: 38519 - protein, 28 aa, Artificial Sequence
  Description of Artificial Sequence: Synthetic peptide
DENEIASTNPVASEQYGVVSTDLQQGEL

SEQ ID NO: 38520 - protein, 31 aa, Artificial Sequence
  Description of Artificial Sequence: Synthetic polypeptide
DEEEIRTTNPVATEQYGEVSENLQEAQEEDM

SEQ ID NO: 38521 - protein, 28 aa, Artificial Sequence
  Description of Artificial Sequence: Synthetic peptide
AENEIRTTNPVATESYGNVSENLMYGEA

SEQ ID NO: 38522 - protein, 33 aa, Artificial Sequence
  Description of Artificial Sequence: Synthetic polypeptide
DEEEIRTTNPVATEQYGSVDCSCALQEEMGENS

SEQ ID NO: 38523 - protein, 31 aa, Artificial Sequence
  Description of Artificial Sequence: Synthetic polypeptide
GEEEIATTNPVATENYGSVSTDLQENEGNDF

SEQ ID NO: 38524 - protein, 32 aa, Artificial Sequence
  Description of Artificial Sequence: Synthetic polypeptide
NEEEIRTTNPVCTEQYGSVSTEELQQAGENDT

SEQ ID NO: 38525 - protein, 33 aa, Artificial Sequence
  Description of Artificial Sequence: Synthetic polypeptide
DEEEIRTTNPVATEQYGEVISTMNLPQIGIDTA

SEQ ID NO: 38526 - protein, 32 aa, Artificial Sequence
  Description of Artificial Sequence: Synthetic polypeptide
SEEEIRTTNPVATEQYGSHVSEALQDQYGANP

SEQ ID NO: 38527 - protein, 32 aa, Artificial Sequence
  Description of Artificial Sequence: Synthetic polypeptide
DENEIRTTNPFATEQYGSVSTTDLVQVNGEND

SEQ ID NO: 38528 - protein, 32 aa, Artificial Sequence
  Description of Artificial Sequence: Synthetic polypeptide
DEEEIRTTNPVATEQYGDVSCEMDLQCHGNDA

SEQ ID NO: 38529 - protein, 28 aa, Artificial Sequence
  Description of Artificial Sequence: Synthetic peptide
DENEIAQTNPVATEQYGVVSTDQEVGND

SEQ ID NO: 38530 - protein, 28 aa, Artificial Sequence
  Description of Artificial Sequence: Synthetic peptide
YEEEIRSTNPCATEPYGTVSTAEQWGNE

SEQ ID NO: 38531 - protein, 32 aa, Artificial Sequence
  Description of Artificial Sequence: Synthetic polypeptide
AEQEIVTTNPVATEQYGSVSTGNLESINGVNR

SEQ ID NO: 38532 - protein, 33 aa, Artificial Sequence
  Description of Artificial Sequence: Synthetic polypeptide
DEEEIRTTNPVATEQYGSVSTPNPLPFIDKGEP

SEQ ID NO: 38533 - protein, 28 aa, Artificial Sequence
  Description of Artificial Sequence: Synthetic peptide
DEEEIRTTNPCAHMFYGCVSTGLDIGNE

SEQ ID NO: 38534 - protein, 31 aa, Artificial Sequence
  Description of Artificial Sequence: Synthetic polypeptide
DEEEIRATNPVATETYGSASMMDNLETAGNR

SEQ ID NO: 38535 - protein, 33 aa, Artificial Sequence
  Description of Artificial Sequence: Synthetic polypeptide
DEEEIRTTNPVATEQYGSVSATDLELVNGENDD

SEQ ID NO: 38536 - protein, 31 aa, Artificial Sequence
  Description of Artificial Sequence: Synthetic polypeptide
DEEEIRTTNPVATEQYGDASTTCLQQVAGEY

SEQ ID NO: 38537 - protein, 28 aa, Artificial Sequence
  Description of Artificial Sequence: Synthetic peptide
DEGEIECTNPCATEQWGTVATNLQRGMM

SEQ ID NO: 38538 - protein, 30 aa, Artificial Sequence
  Description of Artificial Sequence: Synthetic polypeptide
DEVEIATTNPTATEQFGSVSTNEQLEGDNQ

SEQ ID NO: 38539 - protein, 32 aa, Artificial Sequence
  Description of Artificial Sequence: Synthetic polypeptide
DEEEIATTNPVATEQYGDVSATTDQQLRGEND

SEQ ID NO: 38540 - protein, 33 aa, Artificial Sequence
  Description of Artificial Sequence: Synthetic polypeptide
DEEEIRTTNPVATEQYGSVSTEPLQEHDGDEDW

SEQ ID NO: 38541 - protein, 30 aa, Artificial Sequence
  Description of Artificial Sequence: Synthetic polypeptide
DEEEIRTTNPVATEQWGDVSENEMNQAGDA

SEQ ID NO: 38542 - protein, 28 aa, Artificial Sequence
  Description of Artificial Sequence: Synthetic peptide
SEEEISQTNPDATEQYGSASTGENRGNN

SEQ ID NO: 38543 - protein, 28 aa, Artificial Sequence
  Description of Artificial Sequence: Synthetic peptide
DEEEIATVNPVCTETYGSVVTNFQSGSQ

SEQ ID NO: 38544 - protein, 33 aa, Artificial Sequence
  Description of Artificial Sequence: Synthetic polypeptide
DEEEIRTTNPVATEQFGSVISTCNGPQNGINTV

SEQ ID NO: 38545 - protein, 31 aa, Artificial Sequence
  Description of Artificial Sequence: Synthetic polypeptide
YEHELRTTNPVATEQYGSVSTMNLQQTNGTQ

SEQ ID NO: 38546 - protein, 28 aa, Artificial Sequence
  Description of Artificial Sequence: Synthetic peptide
DEEEIRTTNPFATEQYWSVETPDDPGEP

SEQ ID NO: 38547 - protein, 29 aa, Artificial Sequence
  Description of Artificial Sequence: Synthetic peptide
MENEIRTTNPVATECYGSVATELQEVGEL

SEQ ID NO: 38548 - protein, 31 aa, Artificial Sequence
  Description of Artificial Sequence: Synthetic polypeptide
DEEEIRTTNPAATEQYGSVSENPQEFGPDDI

SEQ ID NO: 38549 - protein, 29 aa, Artificial Sequence
  Description of Artificial Sequence: Synthetic peptide
KEEEIRTTNPVATECYGIVSTVPQSREDL

SEQ ID NO: 38550 - protein, 28 aa, Artificial Sequence
  Description of Artificial Sequence: Synthetic peptide
DEQEIVSTNPVSTEMYGSVSNNDQLGNQ

SEQ ID NO: 38551 - protein, 28 aa, Artificial Sequence
  Description of Artificial Sequence: Synthetic peptide
DEVEIAATNPTATEQYGGVSENEQQGNF

SEQ ID NO: 38552 - protein, 31 aa, Artificial Sequence
  Description of Artificial Sequence: Synthetic polypeptide
DENEIRTTNPVATEQYGWMSTNLQEIEGEDC

SEQ ID NO: 38553 - protein, 34 aa, Artificial Sequence
  Description of Artificial Sequence: Synthetic polypeptide
DEEEIRTTNPVATEQYGECVSTCNLEQLMGDNDW

SEQ ID NO: 38554 - protein, 31 aa, Artificial Sequence
  Description of Artificial Sequence: Synthetic polypeptide
DEEIIYTTNPVATENYGSVSITNLQILGEEP

SEQ ID NO: 38555 - protein, 33 aa, Artificial Sequence
  Description of Artificial Sequence: Synthetic polypeptide
DEEEIRTTNPVATEQYGSVSTTDNGLEYKEENE

SEQ ID NO: 38556 - protein, 29 aa, Artificial Sequence
  Description of Artificial Sequence: Synthetic peptide
DEQEIRTTNPVATECWGSVSENLMIQGTL

SEQ ID NO: 38557 - protein, 28 aa, Artificial Sequence
  Description of Artificial Sequence: Synthetic peptide
SDEEIATTNPTATEMYGSVNTNLMVGNS

SEQ ID NO: 38558 - protein, 33 aa, Artificial Sequence
  Description of Artificial Sequence: Synthetic polypeptide
DEEEIRTTNPVATEQYGSVYSTEDGLQQNEVTD

SEQ ID NO: 38559 - protein, 34 aa, Artificial Sequence
  Description of Artificial Sequence: Synthetic polypeptide
DEEEIRTTNPVATEQYGSVSITCAPVQEAKGNDT

SEQ ID NO: 38560 - protein, 28 aa, Artificial Sequence
  Description of Artificial Sequence: Synthetic peptide
DESEVAATNIVSTEVYGVVATNLQRGTR

SEQ ID NO: 38561 - protein, 28 aa, Artificial Sequence
  Description of Artificial Sequence: Synthetic peptide
DEEEIETTNIIATERYGSGGTNIQGAAR

SEQ ID NO: 38562 - protein, 32 aa, Artificial Sequence
  Description of Artificial Sequence: Synthetic polypeptide
DEEEIRTTNPTATEQYGEVSEGNPQDSGDNDI

SEQ ID NO: 38563 - protein, 28 aa, Artificial Sequence
  Description of Artificial Sequence: Synthetic peptide
DNEEWRDTNIIATEQYGGVSTNIQNKNG

SEQ ID NO: 38564 - protein, 29 aa, Artificial Sequence
  Description of Artificial Sequence: Synthetic peptide
DENEIRTTNPVATEIWGSVSENEEMTGTF

SEQ ID NO: 38565 - protein, 33 aa, Artificial Sequence
  Description of Artificial Sequence: Synthetic polypeptide
DENEIRTTNPVASEIYGSVSTENQVQLNNGDNR

SEQ ID NO: 38566 - protein, 28 aa, Artificial Sequence
  Description of Artificial Sequence: Synthetic peptide
SENETASVNPVAYEMYGSVSTNLQRPNF

SEQ ID NO: 38567 - protein, 32 aa, Artificial Sequence
  Description of Artificial Sequence: Synthetic polypeptide
DEQEIATTNPFATEQYGSVSITLNPDRKGNPS

SEQ ID NO: 38568 - protein, 28 aa, Artificial Sequence
  Description of Artificial Sequence: Synthetic peptide
DEENIDFNQNVATEQYTVVSTNILRGNR

SEQ ID NO: 38569 - protein, 28 aa, Artificial Sequence
  Description of Artificial Sequence: Synthetic peptide
DDEEIRATNIVATEQVDEVDTEVQSGNR

SEQ ID NO: 38570 - protein, 28 aa, Artificial Sequence
  Description of Artificial Sequence: Synthetic peptide
QEEEIATTNPVATECYGDVSECLQHEEN

SEQ ID NO: 38571 - protein, 34 aa, Artificial Sequence
  Description of Artificial Sequence: Synthetic polypeptide
DEEEIRTTNPTATEQYGSVYSTLDLQDIEGDNTG

SEQ ID NO: 38572 - protein, 28 aa, Artificial Sequence
  Description of Artificial Sequence: Synthetic peptide
AEEEIAQTNPDATEQYGDVSTGDEHGER

SEQ ID NO: 38573 - protein, 32 aa, Artificial Sequence
  Description of Artificial Sequence: Synthetic polypeptide
DEHEIATTNPVATEQYGSVDCEMNLQCHNGNA

SEQ ID NO: 38574 - protein, 28 aa, Artificial Sequence
  Description of Artificial Sequence: Synthetic peptide
DEEEIRTNNIVSLEQYGTAADNSTRGNR

SEQ ID NO: 38575 - protein, 28 aa, Artificial Sequence
  Description of Artificial Sequence: Synthetic peptide
DENEIATTNPVATEQYGDASENLMHMQQ

SEQ ID NO: 38576 - protein, 32 aa, Artificial Sequence
  Description of Artificial Sequence: Synthetic polypeptide
DEEEISTTNPVATEHFGGVSTANLPQIGNNWQ

SEQ ID NO: 38577 - protein, 28 aa, Artificial Sequence
  Description of Artificial Sequence: Synthetic peptide
DEEEVATTNIVATENYGCVATNLEHLGR

SEQ ID NO: 38578 - protein, 28 aa, Artificial Sequence
  Description of Artificial Sequence: Synthetic peptide
DEEEIVTTNIYKTEMYGSRSDQLGRGNE

SEQ ID NO: 38579 - protein, 30 aa, Artificial Sequence
  Description of Artificial Sequence: Synthetic polypeptide
DEQEIATTNPVATECYGSVSEDLQDQGDDS

SEQ ID NO: 38580 - protein, 31 aa, Artificial Sequence
  Description of Artificial Sequence: Synthetic polypeptide
DEEEIRTTNPCATEQYGDVSCSMELCYVGNV

SEQ ID NO: 38581 - protein, 28 aa, Artificial Sequence
  Description of Artificial Sequence: Synthetic peptide
DEEEIRITNIVDWRVYGDTSDNLQAGNR

SEQ ID NO: 38582 - protein, 28 aa, Artificial Sequence
  Description of Artificial Sequence: Synthetic peptide
DEEEIRTTNGFASEIWGETSTNLQRKAN

SEQ ID NO: 38583 - protein, 28 aa, Artificial Sequence
  Description of Artificial Sequence: Synthetic peptide
DEEEITTTNPVDTRPYGTTSTNLQSSTT

SEQ ID NO: 38584 - protein, 28 aa, Artificial Sequence
  Description of Artificial Sequence: Synthetic peptide
DEVEIGTTNPTGTETFGEVSTALQNGGR

SEQ ID NO: 38585 - protein, 28 aa, Artificial Sequence
  Description of Artificial Sequence: Synthetic peptide
QEGEIAPTNPCASEQYGIVSCNLQSGTR

SEQ ID NO: 38586 - protein, 28 aa, Artificial Sequence
  Description of Artificial Sequence: Synthetic peptide
DEQELACTNICSSEMYGSVGTNLQRGNR

SEQ ID NO: 38587 - protein, 28 aa, Artificial Sequence
  Description of Artificial Sequence: Synthetic peptide
DESEIITTNDVHTEQYGQVNTNLTGINQ

SEQ ID NO: 38588 - protein, 32 aa, Artificial Sequence
  Description of Artificial Sequence: Synthetic polypeptide
DEEEIATTNPVATEQYGSVISEMNEPQDQGDF

SEQ ID NO: 38589 - protein, 32 aa, Artificial Sequence
  Description of Artificial Sequence: Synthetic polypeptide
SEEEIRATNPTATEQYGSVISEMNEQDQEGNR

SEQ ID NO: 38590 - protein, 28 aa, Artificial Sequence
  Description of Artificial Sequence: Synthetic peptide
SEEEIKTTNIVGTEKYGAVSTNLQNTTD

SEQ ID NO: 38591 - protein, 28 aa, Artificial Sequence
  Description of Artificial Sequence: Synthetic peptide
DEEELRTQNKVDNEQWGVTSTNIQRGNN

SEQ ID NO: 38592 - protein, 28 aa, Artificial Sequence
  Description of Artificial Sequence: Synthetic peptide
SEGEIAATNPTATEQFGSVSENPQVGNA

SEQ ID NO: 38593 - protein, 34 aa, Artificial Sequence
  Description of Artificial Sequence: Synthetic polypeptide
DEEEIRTTNPEATEQYGSVSTNGDVQEIEGENDF

SEQ ID NO: 38594 - protein, 34 aa, Artificial Sequence
  Description of Artificial Sequence: Synthetic polypeptide
DEEEIRTTNPVATEQYGSVSATTGLELDNGENDD

SEQ ID NO: 38595 - protein, 28 aa, Artificial Sequence
  Description of Artificial Sequence: Synthetic peptide
DEEEIRTTNIVATEEYGTTADDLQSSNT

SEQ ID NO: 38596 - protein, 28 aa, Artificial Sequence
  Description of Artificial Sequence: Synthetic peptide
AEEEIAQTNPFATEQYGVVSTDQERGED

SEQ ID NO: 38597 - protein, 28 aa, Artificial Sequence
  Description of Artificial Sequence: Synthetic peptide
DEMEICTVNPVATEIYGQVSTPDQMGDQ

SEQ ID NO: 38598 - protein, 31 aa, Artificial Sequence
  Description of Artificial Sequence: Synthetic polypeptide
DEEEIGTTNPVATEQYGCVQLANSEQIGITR

SEQ ID NO: 38599 - protein, 30 aa, Artificial Sequence
  Description of Artificial Sequence: Synthetic polypeptide
DEEEIRTTNPVATEQWGDVSEIEMNQAGDA

SEQ ID NO: 38600 - protein, 33 aa, Artificial Sequence
  Description of Artificial Sequence: Synthetic polypeptide
DEEEIRQTNPVATEQYGSVSTNPVQENKGDEDF

SEQ ID NO: 38601 - protein, 35 aa, Artificial Sequence
  Description of Artificial Sequence: Synthetic polypeptide
DEEEIRTTNPVATEQYGSVSVTIPPVQDRKGDEPR

SEQ ID NO: 38602 - protein, 31 aa, Artificial Sequence
  Description of Artificial Sequence: Synthetic polypeptide
DEEEIRTTNPVATEQYGSVSCDIPEQNEEPS

SEQ ID NO: 38603 - protein, 31 aa, Artificial Sequence
  Description of Artificial Sequence: Synthetic polypeptide
QEEEIRATNPVASEQYGVVSTDLQESDGNDN

SEQ ID NO: 38604 - protein, 30 aa, Artificial Sequence
  Description of Artificial Sequence: Synthetic polypeptide
QEAEIASTNPVATECYGSVSEMNLQERGDP

SEQ ID NO: 38605 - protein, 34 aa, Artificial Sequence
  Description of Artificial Sequence: Synthetic polypeptide
DEEEIRTTNPVATEQYGSVSTGEGDQEQQDGNDC

SEQ ID NO: 38606 - protein, 32 aa, Artificial Sequence
  Description of Artificial Sequence: Synthetic polypeptide
DEEEIRTTNPVATEQYGSVSELDPVQLNGIDS

SEQ ID NO: 38607 - protein, 32 aa, Artificial Sequence
  Description of Artificial Sequence: Synthetic polypeptide
DEEEIATTNPVATECYGSVSATDLQEHEGEDL

SEQ ID NO: 38608 - protein, 28 aa, Artificial Sequence
  Description of Artificial Sequence: Synthetic peptide
DEDEIRSTNPVSYEWYGSVSTALMPGTM

SEQ ID NO: 38609 - protein, 31 aa, Artificial Sequence
  Description of Artificial Sequence: Synthetic polypeptide
DENEIATTNPVATECYGSVSTDLEIHNGENQ

SEQ ID NO: 38610 - protein, 28 aa, Artificial Sequence
  Description of Artificial Sequence: Synthetic peptide
SDEEIITTNIVFTESYGSTSDYLQRGNT

SEQ ID NO: 38611 - protein, 35 aa, Artificial Sequence
  Description of Artificial Sequence: Synthetic polypeptide
DEEEIRTTNPVATEQYGESYVTSETNDTEIRGENP

SEQ ID NO: 38612 - protein, 32 aa, Artificial Sequence
  Description of Artificial Sequence: Synthetic polypeptide
DEEEIRTTNPVATEQYGSVGTCDNQDCNEFEF

SEQ ID NO: 38613 - protein, 29 aa, Artificial Sequence
  Description of Artificial Sequence: Synthetic peptide
DEDEIATTNPVSSEIYGCVSASNLEPGNR

SEQ ID NO: 38614 - protein, 28 aa, Artificial Sequence
  Description of Artificial Sequence: Synthetic peptide
DEVEISCTNPVCTEIYGVVSENDQMGNF

SEQ ID NO: 38615 - protein, 28 aa, Artificial Sequence
  Description of Artificial Sequence: Synthetic peptide
DEEEIASVNPVCTETYGSVVTNFQSGSQ

SEQ ID NO: 38616 - protein, 28 aa, Artificial Sequence
  Description of Artificial Sequence: Synthetic peptide
DEEEGRTTLIVTTNTYGSNSTVLQQGNG

SEQ ID NO: 38617 - protein, 28 aa, Artificial Sequence
  Description of Artificial Sequence: Synthetic peptide
AEEEIAQTNPVATEQYGDVSTEPLIGEY

SEQ ID NO: 38618 - protein, 28 aa, Artificial Sequence
  Description of Artificial Sequence: Synthetic peptide
DEQEIKTTNIVANEQYGQTATNLQSTNT

SEQ ID NO: 38619 - protein, 28 aa, Artificial Sequence
  Description of Artificial Sequence: Synthetic peptide
DEEEIRTTNIDAFEQYGSWETIDERGEG

SEQ ID NO: 38620 - protein, 28 aa, Artificial Sequence
  Description of Artificial Sequence: Synthetic peptide
DEFEICTVNPVATEQYGSAPTVIQGGTI

SEQ ID NO: 38621 - protein, 33 aa, Artificial Sequence
  Description of Artificial Sequence: Synthetic polypeptide
DEEEIRTTNPVATEQYGSVSETDLEEHEGEEDF

SEQ ID NO: 38622 - protein, 28 aa, Artificial Sequence
  Description of Artificial Sequence: Synthetic peptide
DEEEIRTTNIGAQEQYGLTSTNIFSKNY

SEQ ID NO: 38623 - protein, 28 aa, Artificial Sequence
  Description of Artificial Sequence: Synthetic peptide
DEVEISTENNVATERYSSVSGDLQRQSR

SEQ ID NO: 38624 - protein, 34 aa, Artificial Sequence
  Description of Artificial Sequence: Synthetic polypeptide
DEEEIRTTNPYATEQYGSVCSSTENGLVDGGMNI

SEQ ID NO: 38625 - protein, 28 aa, Artificial Sequence
  Description of Artificial Sequence: Synthetic peptide
DEENIRNTEITAQEQYGSVITNDQSGQR

SEQ ID NO: 38626 - protein, 28 aa, Artificial Sequence
  Description of Artificial Sequence: Synthetic peptide
DEVEIATTNPVAHEIYGIVSTAWQIGDF

SEQ ID NO: 38627 - protein, 33 aa, Artificial Sequence
  Description of Artificial Sequence: Synthetic polypeptide
DDEEIRTTNPIATEIYGSVSETNGLQLDGENEL

SEQ ID NO: 38628 - protein, 28 aa, Artificial Sequence
  Description of Artificial Sequence: Synthetic peptide
DEEEIRTTNPIASENYGAVGTGDQGGMF

SEQ ID NO: 38629 - protein, 28 aa, Artificial Sequence
  Description of Artificial Sequence: Synthetic peptide
SEEEIKTTNRFATEVYGSTATNLQNYNT

SEQ ID NO: 38630 - protein, 28 aa, Artificial Sequence
  Description of Artificial Sequence: Synthetic peptide
DEEGIMTTTGVGTEQYGSTSNSLQRSNC

SEQ ID NO: 38631 - protein, 28 aa, Artificial Sequence
  Description of Artificial Sequence: Synthetic peptide
DEEEIRITNIVATEIFGSTIDNEQGQNR

SEQ ID NO: 38632 - protein, 28 aa, Artificial Sequence
  Description of Artificial Sequence: Synthetic peptide
SEEEVRTTNIAGTEMWGVVSTNLQRANT

SEQ ID NO: 38633 - protein, 34 aa, Artificial Sequence
  Description of Artificial Sequence: Synthetic polypeptide
DEEEIRTTNPVATEQYGSVSDTLADQMSKGEEPR

SEQ ID NO: 38634 - protein, 28 aa, Artificial Sequence
  Description of Artificial Sequence: Synthetic peptide
DEEEISTTNIVATRIYGSISNNLQNASG

SEQ ID NO: 38635 - protein, 28 aa, Artificial Sequence
  Description of Artificial Sequence: Synthetic peptide
REEEIATTNDVRTGQQGSVWTNETRGNT

SEQ ID NO: 38636 - protein, 29 aa, Artificial Sequence
  Description of Artificial Sequence: Synthetic peptide
AEQEIVTTNPVATECYGFVSATLEQRQPR

SEQ ID NO: 38637 - protein, 28 aa, Artificial Sequence
  Description of Artificial Sequence: Synthetic peptide
DEVEISTTNPEATFIYGCVSANWQQGNF

SEQ ID NO: 38638 - protein, 28 aa, Artificial Sequence
  Description of Artificial Sequence: Synthetic peptide
DEQEIRTTNIVDTDWYGKSSTNLQIGST

SEQ ID NO: 38639 - protein, 28 aa, Artificial Sequence
  Description of Artificial Sequence: Synthetic peptide
YEEEIRSVNPCATEPYGTVSTAEQWGNE

SEQ ID NO: 38640 - protein, 28 aa, Artificial Sequence
  Description of Artificial Sequence: Synthetic peptide
DEEEIRTTNPVATEQWGDYSEIEMQGDA

SEQ ID NO: 38641 - protein, 28 aa, Artificial Sequence
  Description of Artificial Sequence: Synthetic peptide
DEEEIRTTNQIATGQWQQVSTNDLSSNR

SEQ ID NO: 38642 - protein, 32 aa, Artificial Sequence
  Description of Artificial Sequence: Synthetic polypeptide
DEEEIRTTNPVATEQYGDVSCECLQCHAGEDQ

SEQ ID NO: 38643 - protein, 28 aa, Artificial Sequence
  Description of Artificial Sequence: Synthetic peptide
DEYETNTVNIVHTENYGNVSFNLGRGNR

SEQ ID NO: 38644 - protein, 28 aa, Artificial Sequence
  Description of Artificial Sequence: Synthetic peptide
DDSETRTTLIVDTEQYGSTSNTLQRGTR

SEQ ID NO: 38645 - protein, 28 aa, Artificial Sequence
  Description of Artificial Sequence: Synthetic peptide
GEEEIASTNPVATEMYGEVACIIQRGGR

SEQ ID NO: 38646 - protein, 28 aa, Artificial Sequence
  Description of Artificial Sequence: Synthetic peptide
DENAGTTTNIVDTREYGSASDNLQRGNR

SEQ ID NO: 38647 - protein, 28 aa, Artificial Sequence
  Description of Artificial Sequence: Synthetic peptide
DEEEITTTNPVDTDRYGTTSTNLQSSTT

SEQ ID NO: 38648 - protein, 28 aa, Artificial Sequence
  Description of Artificial Sequence: Synthetic peptide
DEVEIRCTNPCATEQYGDVATDPNPGNY

SEQ ID NO: 38649 - protein, 28 aa, Artificial Sequence
  Description of Artificial Sequence: Synthetic peptide
DEQEVASTNIVSSENYGCVATNLQRGNR

SEQ ID NO: 38650 - protein, 28 aa, Artificial Sequence
  Description of Artificial Sequence: Synthetic peptide
DEEEIRATNIVATSEYGLVATNKQNKNT

SEQ ID NO: 38651 - protein, 28 aa, Artificial Sequence
  Description of Artificial Sequence: Synthetic peptide
DEEEIVTNNIVASDVYGSVANNLQYLNR

SEQ ID NO: 38652 - protein, 33 aa, Artificial Sequence
  Description of Artificial Sequence: Synthetic polypeptide
DESEIRTTNPVATEQWGSVSCINEPQDREGENG

SEQ ID NO: 38653 - protein, 28 aa, Artificial Sequence
  Description of Artificial Sequence: Synthetic peptide
DEQEVACTNIVASEIYGAVAMNLQRGNR

SEQ ID NO: 38654 - protein, 30 aa, Artificial Sequence
  Description of Artificial Sequence: Synthetic polypeptide
SEDEIRATNPVATETFGEVSENLQREGDDR

SEQ ID NO: 38655 - protein, 32 aa, Artificial Sequence
  Description of Artificial Sequence: Synthetic polypeptide
DENEIAQTNPVATEQYGSVSTGLVEDRGDNDI

SEQ ID NO: 38656 - protein, 28 aa, Artificial Sequence
  Description of Artificial Sequence: Synthetic peptide
SEEIIRTTNIVGGEQYGSVATNMQNTNM

SEQ ID NO: 38657 - protein, 35 aa, Artificial Sequence
  Description of Artificial Sequence: Synthetic polypeptide
DEEEIRTTNPVATEQYGSVDCTMNGLCCRNGDNDD

SEQ ID NO: 38658 - protein, 28 aa, Artificial Sequence
  Description of Artificial Sequence: Synthetic peptide
DEEEIRTTNPFATEQYWSWETPDDPGEP

SEQ ID NO: 38659 - protein, 31 aa, Artificial Sequence
  Description of Artificial Sequence: Synthetic polypeptide
DEEEIRTTNPVATEQYGDVSECPQEHAGEDL

SEQ ID NO: 38660 - protein, 35 aa, Artificial Sequence
  Description of Artificial Sequence: Synthetic polypeptide
DEEEIRTTNPVATEQYGSVSTTDNGDVEIREGEND

SEQ ID NO: 38661 - protein, 28 aa, Artificial Sequence
  Description of Artificial Sequence: Synthetic peptide
DEGEIATTNPVATENYGEVSVNWIQGPQ

SEQ ID NO: 38662 - protein, 32 aa, Artificial Sequence
  Description of Artificial Sequence: Synthetic polypeptide
DEQEIRTTNPEATEQYGSVSTLNPEQEKGEEN

SEQ ID NO: 38663 - protein, 28 aa, Artificial Sequence
  Description of Artificial Sequence: Synthetic peptide
DEVEIRCTNPTATECFGEVSTDLQNGTA

SEQ ID NO: 38664 - protein, 28 aa, Artificial Sequence
  Description of Artificial Sequence: Synthetic peptide
DEEEVRQTNIVATEQYGMVRAIEQFGNT

SEQ ID NO: 38665 - protein, 28 aa, Artificial Sequence
  Description of Artificial Sequence: Synthetic peptide
DEQEVATTNPIAYMMYGSVSTAYERGNR

SEQ ID NO: 38666 - protein, 31 aa, Artificial Sequence
  Description of Artificial Sequence: Synthetic polypeptide
QEEEIRATNPVATECYGSVSANDLEEHNGER

SEQ ID NO: 38667 - protein, 35 aa, Artificial Sequence
  Description of Artificial Sequence: Synthetic polypeptide
DEEEIRTTNPVATEQYGSVTDLTAPGLLPRGTNLR

SEQ ID NO: 38668 - protein, 35 aa, Artificial Sequence
  Description of Artificial Sequence: Synthetic polypeptide
DEEEIRTTNPVATEQYGSVADTTDPNLLDANGDNR

SEQ ID NO: 38669 - protein, 31 aa, Artificial Sequence
  Description of Artificial Sequence: Synthetic polypeptide
DEEEIRTTNPVATEQYGDVSECLQIHAEEDN

SEQ ID NO: 38670 - protein, 28 aa, Artificial Sequence
  Description of Artificial Sequence: Synthetic peptide
NEEEIRTTNIVATRYQGSTENNLQNGNT

SEQ ID NO: 38671 - protein, 28 aa, Artificial Sequence
  Description of Artificial Sequence: Synthetic peptide
DEEEIRTTNIYAEDSYGRVSTSLQNGAS

SEQ ID NO: 38672 - protein, 33 aa, Artificial Sequence
  Description of Artificial Sequence: Synthetic polypeptide
DEEEIRTTNPVATEQYGSVSETDLEDHEGEEDV

SEQ ID NO: 38673 - protein, 28 aa, Artificial Sequence
  Description of Artificial Sequence: Synthetic peptide
QEVEIYCTNPVATEIFGSVSTALQGGDN

SEQ ID NO: 38674 - protein, 31 aa, Artificial Sequence
  Description of Artificial Sequence: Synthetic polypeptide
DEEEIRTTNPTATEQYGEVSEANPQELGDTH

SEQ ID NO: 38675 - protein, 28 aa, Artificial Sequence
  Description of Artificial Sequence: Synthetic peptide
DEDTIQRTNIYDTEQIGSVSTNLERKNR

SEQ ID NO: 38676 - protein, 30 aa, Artificial Sequence
  Description of Artificial Sequence: Synthetic polypeptide
VEEEIRTTNPVATEAYGCVGMNLEDRLTER

SEQ ID NO: 38677 - protein, 28 aa, Artificial Sequence
  Description of Artificial Sequence: Synthetic peptide
DENEITTTNGDATENYQLVSDTLQRGND

SEQ ID NO: 38678 - protein, 28 aa, Artificial Sequence
  Description of Artificial Sequence: Synthetic peptide
DEEEIRFTNIVATEQYGSWETIDDIGSG

SEQ ID NO: 38679 - protein, 28 aa, Artificial Sequence
  Description of Artificial Sequence: Synthetic peptide
DEEERITTNDTAWEQVKSTSQNLQGGNR

SEQ ID NO: 38680 - protein, 28 aa, Artificial Sequence
  Description of Artificial Sequence: Synthetic peptide
DEEEIRTTNIFATEQYGVVETDQDNGEE

SEQ ID NO: 38681 - protein, 28 aa, Artificial Sequence
  Description of Artificial Sequence: Synthetic peptide
AEDEISTTNPVATEMWGFISENLQHFNR

SEQ ID NO: 38682 - protein, 34 aa, Artificial Sequence
  Description of Artificial Sequence: Synthetic polypeptide
DENEIRQTNPVATEQYGSVSVTGGLVEDRGDNDR

SEQ ID NO: 38683 - protein, 28 aa, Artificial Sequence
  Description of Artificial Sequence: Synthetic peptide
DEEETLTTNIVNTLQVTEVSTNLQGRGN

SEQ ID NO: 38684 - protein, 28 aa, Artificial Sequence
  Description of Artificial Sequence: Synthetic peptide
DEGEIECTNPCATESWGTVATNLQRGMM

SEQ ID NO: 38685 - protein, 28 aa, Artificial Sequence
  Description of Artificial Sequence: Synthetic peptide
DEEEIGTTNIVSTENYGSNWNQLLRGNS

SEQ ID NO: 38686 - protein, 30 aa, Artificial Sequence
  Description of Artificial Sequence: Synthetic polypeptide
DDQEVRTTNPVATEVYGCVAASNLEREGNR

SEQ ID NO: 38687 - protein, 28 aa, Artificial Sequence
  Description of Artificial Sequence: Synthetic peptide
DEEEIRTTNLVTISEAGSVSTNLAQGTN

SEQ ID NO: 38688 - protein, 28 aa, Artificial Sequence
  Description of Artificial Sequence: Synthetic peptide
DDEEINTTNIVTTEIYGEVSDILQRMNT

SEQ ID NO: 38689 - protein, 28 aa, Artificial Sequence
  Description of Artificial Sequence: Synthetic peptide
SEEEIYTTNPEATETYGCVSNNVQGGPI

SEQ ID NO: 38690 - protein, 28 aa, Artificial Sequence
  Description of Artificial Sequence: Synthetic peptide
DEEEIKTTNIVAWETYGKVVDNLQQGST

SEQ ID NO: 38691 - protein, 30 aa, Artificial Sequence
  Description of Artificial Sequence: Synthetic polypeptide
DEQEVRCTNPVASEQYGCVAANNLERNGNR

SEQ ID NO: 38692 - protein, 34 aa, Artificial Sequence
  Description of Artificial Sequence: Synthetic polypeptide
DEEEIRTTNPVATEQYGSASTCCPLQLFKGDNDN

SEQ ID NO: 38693 - protein, 28 aa, Artificial Sequence
  Description of Artificial Sequence: Synthetic peptide
DEEEIRTTNPCATEQYGDVWETDQSEEA

SEQ ID NO: 38694 - protein, 30 aa, Artificial Sequence
  Description of Artificial Sequence: Synthetic polypeptide
MEQEIRTTNPVATEMYGSVSEELQDIGEDM

SEQ ID NO: 38695 - protein, 28 aa, Artificial Sequence
  Description of Artificial Sequence: Synthetic peptide
DEEEIIDTNISATDQYSGVSNAIQRGNR

SEQ ID NO: 38696 - protein, 28 aa, Artificial Sequence
  Description of Artificial Sequence: Synthetic peptide
DEEEVATTNPIAYMMYGSVSTAYERGPR

SEQ ID NO: 38697 - protein, 36 aa, Artificial Sequence
  Description of Artificial Sequence: Synthetic polypeptide
DEEEIRTTNPVATEQYGSYVSSITGPLNQVRGDNPN

SEQ ID NO: 38698 - protein, 28 aa, Artificial Sequence
  Description of Artificial Sequence: Synthetic peptide
DEENIDTTNIGFITNYSSVSTELQRGNR

SEQ ID NO: 38699 - protein, 28 aa, Artificial Sequence
  Description of Artificial Sequence: Synthetic peptide
DEDEVRQTQLVATEQLGSDSDNDQRMNR

SEQ ID NO: 38700 - protein, 32 aa, Artificial Sequence
  Description of Artificial Sequence: Synthetic polypeptide
DEQEIRTTNPVATEQYGSVDTDGDPQEPGEDR

SEQ ID NO: 38701 - protein, 28 aa, Artificial Sequence
  Description of Artificial Sequence: Synthetic peptide
DEQEGRFTNIVDKEQLGTVSTNLQNGND

SEQ ID NO: 38702 - protein, 28 aa, Artificial Sequence
  Description of Artificial Sequence: Synthetic peptide
AEGEIWQTNPVATESYGNISTNPQGGNQ

SEQ ID NO: 38703 - protein, 32 aa, Artificial Sequence
  Description of Artificial Sequence: Synthetic polypeptide
DEEEIVTTNPVATEQYGSVSATDGPVEFEGND

SEQ ID NO: 38704 - protein, 28 aa, Artificial Sequence
  Description of Artificial Sequence: Synthetic peptide
AESEIGTTNPVATEIYGDCSNNLQMGQT

SEQ ID NO: 38705 - protein, 28 aa, Artificial Sequence
  Description of Artificial Sequence: Synthetic peptide
EEEETRNTNIVDTEQYGYVADNLQNANR

SEQ ID NO: 38706 - protein, 28 aa, Artificial Sequence
  Description of Artificial Sequence: Synthetic peptide
DEEEIRPTNPDATENYGSVAMCEDPGNG

SEQ ID NO: 38707 - protein, 28 aa, Artificial Sequence
  Description of Artificial Sequence: Synthetic peptide
QEEEITATNPVGTEQYGSVSENPAVGPH

SEQ ID NO: 38708 - protein, 34 aa, Artificial Sequence
  Description of Artificial Sequence: Synthetic polypeptide
DEEEIRTTNPVATEQYGSVSITPNPLVFIDGDEP

SEQ ID NO: 38709 - protein, 31 aa, Artificial Sequence
  Description of Artificial Sequence: Synthetic polypeptide
DEEEICTTNPVATEQYGDVSCEADQCLKGNE

SEQ ID NO: 38710 - protein, 28 aa, Artificial Sequence
  Description of Artificial Sequence: Synthetic peptide
QEEEIATTNPVATECYGDVSECLQHEEL

SEQ ID NO: 38711 - protein, 28 aa, Artificial Sequence
  Description of Artificial Sequence: Synthetic peptide
SEEQIDNTNVVRTEQYGSVMTNLIVGNT

SEQ ID NO: 38712 - protein, 28 aa, Artificial Sequence
  Description of Artificial Sequence: Synthetic peptide
QEQEIVTVNPVATEQYGEVAEVLQHGNM

SEQ ID NO: 38713 - protein, 34 aa, Artificial Sequence
  Description of Artificial Sequence: Synthetic polypeptide
DEEEIRTTNPVATEQYGSVSATTDQELDNGENDD

SEQ ID NO: 38714 - protein, 29 aa, Artificial Sequence
  Description of Artificial Sequence: Synthetic peptide
KEQEIRTTNPVATECYGIVSTVPQSREDL

SEQ ID NO: 38715 - protein, 28 aa, Artificial Sequence
  Description of Artificial Sequence: Synthetic peptide
HDEEIRTTNPIATEAYGHVSCTPQGGNH

SEQ ID NO: 38716 - protein, 28 aa, Artificial Sequence
  Description of Artificial Sequence: Synthetic peptide
EENEIQTTNIVAREQYGTVSEIHQRGND

SEQ ID NO: 38717 - protein, 32 aa, Artificial Sequence
  Description of Artificial Sequence: Synthetic polypeptide
DEEEIRTTNPVATEAYGNVPSTNNVDLDGVNW

SEQ ID NO: 38718 - protein, 32 aa, Artificial Sequence
  Description of Artificial Sequence: Synthetic polypeptide
SEEEIRTTNPVATEQYGSVSEMNPQENGDTDV

SEQ ID NO: 38719 - protein, 28 aa, Artificial Sequence
  Description of Artificial Sequence: Synthetic peptide
AEVEIAATNPVATENFGWVASNLQRGTR

SEQ ID NO: 38720 - protein, 31 aa, Artificial Sequence
  Description of Artificial Sequence: Synthetic polypeptide
GEEEIATTNPVATENYGSVSTDLQENEGDDF

SEQ ID NO: 38721 - protein, 28 aa, Artificial Sequence
  Description of Artificial Sequence: Synthetic peptide
DEVEIASTNPVGTEQYGSIPTNEQHFNG

SEQ ID NO: 38722 - protein, 35 aa, Artificial Sequence
  Description of Artificial Sequence: Synthetic polypeptide
DEEEIRTTNPFATEQYGSVTSITPGPLVDLRGDNR

SEQ ID NO: 38723 - protein, 31 aa, Artificial Sequence
  Description of Artificial Sequence: Synthetic polypeptide
DEGEIRTTNPVATECYGWVSTELQIVNGEDT

SEQ ID NO: 38724 - protein, 34 aa, Artificial Sequence
  Description of Artificial Sequence: Synthetic polypeptide
DEEEIRTTNPFATEQYGSVSITPGPLVDLPGDNR

SEQ ID NO: 38725 - protein, 34 aa, Artificial Sequence
  Description of Artificial Sequence: Synthetic polypeptide
DEEEIRTTNPVATEQYGSVISTLNWPQLFEGVTQ

SEQ ID NO: 38726 - protein, 30 aa, Artificial Sequence
  Description of Artificial Sequence: Synthetic polypeptide
VEEEIRATNPVASEQYGSCAENLQERGDDW

SEQ ID NO: 38727 - protein, 28 aa, Artificial Sequence
  Description of Artificial Sequence: Synthetic peptide
DEEEIATTNIFATEQYGVVETNEDEGEF

SEQ ID NO: 38728 - protein, 28 aa, Artificial Sequence
  Description of Artificial Sequence: Synthetic peptide
DEEEWVTTAISTTEQGGTVSTNLQSGSR

SEQ ID NO: 38729 - protein, 28 aa, Artificial Sequence
  Description of Artificial Sequence: Synthetic peptide
SEEEIRCTNPIATEIFGSVSTDVQSGLL

SEQ ID NO: 38730 - protein, 28 aa, Artificial Sequence
  Description of Artificial Sequence: Synthetic peptide
DSEQIDTTNIVAERQRGSVSTETQRGSR

SEQ ID NO: 38731 - protein, 33 aa, Artificial Sequence
  Description of Artificial Sequence: Synthetic polypeptide
DEEEIATTNPVATEQYGSVSATTGLELVEGNDD

SEQ ID NO: 38732 - protein, 31 aa, Artificial Sequence
  Description of Artificial Sequence: Synthetic polypeptide
DEEEIATTNPVATECYGSVSATDLEINGEDL

SEQ ID NO: 38733 - protein, 28 aa, Artificial Sequence
  Description of Artificial Sequence: Synthetic peptide
MENEIAQTNPVATEQYGQVSTPQELGND

SEQ ID NO: 38734 - protein, 28 aa, Artificial Sequence
  Description of Artificial Sequence: Synthetic peptide
DEDMINTTNIVSDEQYGTVSDNLQAGTR

SEQ ID NO: 38735 - protein, 31 aa, Artificial Sequence
  Description of Artificial Sequence: Synthetic polypeptide
YEHELRTTNPCATEQYGSVSTMNLQQTNGTQ

SEQ ID NO: 38736 - protein, 28 aa, Artificial Sequence
  Description of Artificial Sequence: Synthetic peptide
DEEEINTNNILATEVYGSYHTNTGSGNR

SEQ ID NO: 38737 - protein, 28 aa, Artificial Sequence
  Description of Artificial Sequence: Synthetic peptide
DESEIAATNIVSSEIYGCVANNLQRGNR

SEQ ID NO: 38738 - protein, 34 aa, Artificial Sequence
  Description of Artificial Sequence: Synthetic polypeptide
DEEEIRTTNPVATEQYGSVCSTTGGLVLCEGNLD

SEQ ID NO: 38739 - protein, 28 aa, Artificial Sequence
  Description of Artificial Sequence: Synthetic peptide
DCEEIATTNGSASEQYGVVSTNFQIDNN

SEQ ID NO: 38740 - protein, 28 aa, Artificial Sequence
  Description of Artificial Sequence: Synthetic peptide
DEEEIRATNGVAYEQYTSAHTNLNTKNT

SEQ ID NO: 38741 - protein, 28 aa, Artificial Sequence
  Description of Artificial Sequence: Synthetic peptide
SEEEIRTTNGVATEQYGTTEVNLQSSAT

SEQ ID NO: 38742 - protein, 28 aa, Artificial Sequence
  Description of Artificial Sequence: Synthetic peptide
DEGEISTNSIVATEIWGLVSTQLQRGDR

SEQ ID NO: 38743 - protein, 30 aa, Artificial Sequence
  Description of Artificial Sequence: Synthetic polypeptide
DENEINSTNPVATEQYGSVSTELEDMNGEA

SEQ ID NO: 38744 - protein, 28 aa, Artificial Sequence
  Description of Artificial Sequence: Synthetic peptide
SEVEIAATNPTATEQFGSVSENEQQGNF

SEQ ID NO: 38745 - protein, 28 aa, Artificial Sequence
  Description of Artificial Sequence: Synthetic peptide
DEEEIRTTNIYATEQYGKTADNLQNAST

SEQ ID NO: 38746 - protein, 28 aa, Artificial Sequence
  Description of Artificial Sequence: Synthetic peptide
IEEEASTTNIVHNQQVGSVSNNLQSGNR

SEQ ID NO: 38747 - protein, 28 aa, Artificial Sequence
  Description of Artificial Sequence: Synthetic peptide
QEVEIVTTNPVATECYGSASTDLETGEI

SEQ ID NO: 38748 - protein, 28 aa, Artificial Sequence
  Description of Artificial Sequence: Synthetic peptide
DEEMLATTQIVGAEQIGGVSTNLQRSNR

SEQ ID NO: 38749 - protein, 28 aa, Artificial Sequence
  Description of Artificial Sequence: Synthetic peptide
DESEISTVNPVATEMYGSVSEDLDAGDD

SEQ ID NO: 38750 - protein, 28 aa, Artificial Sequence
  Description of Artificial Sequence: Synthetic peptide
VEDEIRATNPVCSEQYGCTSMNLQRGTQ

SEQ ID NO: 38751 - protein, 28 aa, Artificial Sequence
  Description of Artificial Sequence: Synthetic peptide
DEEGIRTNNIVRTKQEGSVSDNLLRQNT

SEQ ID NO: 38752 - protein, 31 aa, Artificial Sequence
  Description of Artificial Sequence: Synthetic polypeptide
DEQEIVTTNPVATEMYGSVSGEELTHGDNDR

SEQ ID NO: 38753 - protein, 33 aa, Artificial Sequence
  Description of Artificial Sequence: Synthetic polypeptide
SEEEIRTTNPVATEQFGSVISTCNGPQNGINTV

SEQ ID NO: 38754 - protein, 32 aa, Artificial Sequence
  Description of Artificial Sequence: Synthetic polypeptide
DEEEIRPTNPDATEQYGEVSMTGDPQTAGNER

SEQ ID NO: 38755 - protein, 32 aa, Artificial Sequence
  Description of Artificial Sequence: Synthetic polypeptide
DEEEIRTTNPVATEQYGDVSCECLQCHAGEDL

SEQ ID NO: 38756 - protein, 29 aa, Artificial Sequence
  Description of Artificial Sequence: Synthetic peptide
DENEIRTTNPVATECWGIVSENDENGGDR

SEQ ID NO: 38757 - protein, 29 aa, Artificial Sequence
  Description of Artificial Sequence: Synthetic peptide
DEQEIRTTNPVATECWGSVDENLMIQGTL

SEQ ID NO: 38758 - protein, 35 aa, Artificial Sequence
  Description of Artificial Sequence: Synthetic polypeptide
DEEEIRTTNPVATEQYGSVDCTMNGLCCREGENDD

SEQ ID NO: 38759 - protein, 31 aa, Artificial Sequence
  Description of Artificial Sequence: Synthetic polypeptide
DENEIRTTNPVSTEQYGTVSMENIQQQNGNH

SEQ ID NO: 38760 - protein, 28 aa, Artificial Sequence
  Description of Artificial Sequence: Synthetic peptide
DEETIRINNNLANKQYGSVSTEEQRGNT

SEQ ID NO: 38761 - protein, 29 aa, Artificial Sequence
  Description of Artificial Sequence: Synthetic peptide
DEEEIATTNPVATEQYGEASEVLQHAEEK

SEQ ID NO: 38762 - protein, 28 aa, Artificial Sequence
  Description of Artificial Sequence: Synthetic peptide
DEDEICCTNPTATEIFGGVSENWQQGNR

SEQ ID NO: 38763 - protein, 28 aa, Artificial Sequence
  Description of Artificial Sequence: Synthetic peptide
DEEEITTTNPVDTRRYGTTSTNLQSSTT

SEQ ID NO: 38764 - protein, 32 aa, Artificial Sequence
  Description of Artificial Sequence: Synthetic polypeptide
DEEEIRTTNPCATESYGSVSTEEWEPQEGENG

SEQ ID NO: 38765 - protein, 32 aa, Artificial Sequence
  Description of Artificial Sequence: Synthetic polypeptide
DEEEIATTNPTATEQYGGVSTMNEQDQEGDNF

SEQ ID NO: 38766 - protein, 32 aa, Artificial Sequence
  Description of Artificial Sequence: Synthetic polypeptide
DEEEIRTTNPCATEQYGSVFITMALEPVGNDS

SEQ ID NO: 38767 - protein, 30 aa, Artificial Sequence
  Description of Artificial Sequence: Synthetic polypeptide
DEHEIRTTNPVASEQYGTVSTMDWQESGDT

SEQ ID NO: 38768 - protein, 29 aa, Artificial Sequence
  Description of Artificial Sequence: Synthetic peptide
DENEIRCTNPVATEQWGIVSENLMMQGTA

SEQ ID NO: 38769 - protein, 29 aa, Artificial Sequence
  Description of Artificial Sequence: Synthetic peptide
DENEIKTTNPVATECWGSVSENEQNLGTF

SEQ ID NO: 38770 - protein, 32 aa, Artificial Sequence
  Description of Artificial Sequence: Synthetic polypeptide
DEQEIATTNPVATEQYGSVSATDLQDHEGEDL

SEQ ID NO: 38771 - protein, 28 aa, Artificial Sequence
  Description of Artificial Sequence: Synthetic peptide
HELEIATTNPVATECYGDASTNIQTGMM

SEQ ID NO: 38772 - protein, 33 aa, Artificial Sequence
  Description of Artificial Sequence: Synthetic polypeptide
DEEEIRTTNPDATEQYGSVSTDNDVEGDGEEDR

SEQ ID NO: 38773 - protein, 28 aa, Artificial Sequence
  Description of Artificial Sequence: Synthetic peptide
DEEHIRTTMTVASEQYGSVEDNIRRSSR

SEQ ID NO: 38774 - protein, 33 aa, Artificial Sequence
  Description of Artificial Sequence: Synthetic polypeptide
DEQEIRTTNPVATEQYGSVDSTEPPDEETGNDR

SEQ ID NO: 38775 - protein, 33 aa, Artificial Sequence
  Description of Artificial Sequence: Synthetic polypeptide
DEEEIRTTNPVATEQYGDVSCEMNLCCHAGNDQ

SEQ ID NO: 38776 - protein, 28 aa, Artificial Sequence
  Description of Artificial Sequence: Synthetic peptide
DENEIAQTNPCATEQYGVVSEDLERGEA

SEQ ID NO: 38777 - protein, 34 aa, Artificial Sequence
  Description of Artificial Sequence: Synthetic polypeptide
KEEEIRTTNPVATEQYGSVSCTGNWQYVDGENDC

SEQ ID NO: 38778 - protein, 31 aa, Artificial Sequence
  Description of Artificial Sequence: Synthetic polypeptide
SEEEIRTTNPVATECWGSVSTNDMLGAGDDI

SEQ ID NO: 38779 - protein, 28 aa, Artificial Sequence
  Description of Artificial Sequence: Synthetic peptide
DEEETITTNIVAQDQSTSVNTNLQAGNT

SEQ ID NO: 38780 - protein, 28 aa, Artificial Sequence
  Description of Artificial Sequence: Synthetic peptide
DEEEVRTTNPCASEHYGCVANNLEPPNR

SEQ ID NO: 38781 - protein, 28 aa, Artificial Sequence
  Description of Artificial Sequence: Synthetic peptide
DEEGLRTTNITAREQQGSVSVNLRTGNT

SEQ ID NO: 38782 - protein, 31 aa, Artificial Sequence
  Description of Artificial Sequence: Synthetic polypeptide
DEEEIRTTNPVATEVWGSYDTNLMLTNGNDM

SEQ ID NO: 38783 - protein, 32 aa, Artificial Sequence
  Description of Artificial Sequence: Synthetic polypeptide
DEEEIRTTNPDATEQYGSVSCENPLDEIDGES

SEQ ID NO: 38784 - protein, 28 aa, Artificial Sequence
  Description of Artificial Sequence: Synthetic peptide
DAEEIQTTNIVATEDYGNVETNTSRGDC

SEQ ID NO: 38785 - protein, 28 aa, Artificial Sequence
  Description of Artificial Sequence: Synthetic peptide
QEEEICCTNPEATEQYGCVSVNDQLGPH

SEQ ID NO: 38786 - protein, 30 aa, Artificial Sequence
  Description of Artificial Sequence: Synthetic polypeptide
DEHEIRTTNPVATEQYGVADTMDLETAGNA

SEQ ID NO: 38787 - protein, 32 aa, Artificial Sequence
  Description of Artificial Sequence: Synthetic polypeptide
DEEEIATTNPVATECYGSVSATDLQDQNGEDL

SEQ ID NO: 38788 - protein, 28 aa, Artificial Sequence
  Description of Artificial Sequence: Synthetic peptide
DEEEIGTTLNIATDQIGSISDNLTRGTR

SEQ ID NO: 38789 - protein, 28 aa, Artificial Sequence
  Description of Artificial Sequence: Synthetic peptide
VEEEIRTTNPIATFQYGCVASDLERPNP

SEQ ID NO: 38790 - protein, 33 aa, Artificial Sequence
  Description of Artificial Sequence: Synthetic polypeptide
DEEEIRTTNPVATEQYGSVFCEMNLCCAGDNDC

SEQ ID NO: 38791 - protein, 33 aa, Artificial Sequence
  Description of Artificial Sequence: Synthetic polypeptide
DEEEIRATNPVATEQYGSVSEMNPQLIEGDNDF

SEQ ID NO: 38792 - protein, 30 aa, Artificial Sequence
  Description of Artificial Sequence: Synthetic polypeptide
DEEEIRTVNPVATECYGSVSEEPDEMREMR

SEQ ID NO: 38793 - protein, 32 aa, Artificial Sequence
  Description of Artificial Sequence: Synthetic polypeptide
DENEIATTNPVATECYGSVSATDLQEHEGNDL

SEQ ID NO: 38794 - protein, 28 aa, Artificial Sequence
  Description of Artificial Sequence: Synthetic peptide
DEIEIQCTNEVAAEQYGGVRTELQTGNN

SEQ ID NO: 38795 - protein, 28 aa, Artificial Sequence
  Description of Artificial Sequence: Synthetic peptide
SEEEIRITNIVATEQYGVTADNLQSSNT

SEQ ID NO: 38796 - protein, 28 aa, Artificial Sequence
  Description of Artificial Sequence: Synthetic peptide
SEQEISATNPVGTEQYGQVSTNLNLGDD

SEQ ID NO: 38797 - protein, 28 aa, Artificial Sequence
  Description of Artificial Sequence: Synthetic peptide
DEEEIRTTHITAWEQQGEVSTNKQTLNT

SEQ ID NO: 38798 - protein, 33 aa, Artificial Sequence
  Description of Artificial Sequence: Synthetic polypeptide
DEEEIAQTNPVATEQYGSVSTTPQELREGENDT

SEQ ID NO: 38799 - protein, 28 aa, Artificial Sequence
  Description of Artificial Sequence: Synthetic peptide
DIQEINTNNIVASESYGEVSTQLQRGNG

SEQ ID NO: 38800 - protein, 33 aa, Artificial Sequence
  Description of Artificial Sequence: Synthetic polypeptide
DEEEIRTTNPVATEQYGSVSTDPEQDTDGDDPE

SEQ ID NO: 38801 - protein, 28 aa, Artificial Sequence
  Description of Artificial Sequence: Synthetic peptide
FEEEICAVNPVATEPWGCVSENVQRGNT

SEQ ID NO: 38802 - protein, 28 aa, Artificial Sequence
  Description of Artificial Sequence: Synthetic peptide
YDHEIATTNPVSTESYGCVCTNWQRENR

SEQ ID NO: 38803 - protein, 34 aa, Artificial Sequence
  Description of Artificial Sequence: Synthetic polypeptide
DEEEIRTTNPVATEQYGSVETLNPDQDEKGDEPR

SEQ ID NO: 38804 - protein, 30 aa, Artificial Sequence
  Description of Artificial Sequence: Synthetic polypeptide
DEEEIAATNPVASECYGSVSTEPLETGDNI

SEQ ID NO: 38805 - protein, 28 aa, Artificial Sequence
  Description of Artificial Sequence: Synthetic peptide
DEEEIRQTGIVAAENYGNVSNGMQSGNR

SEQ ID NO: 38806 - protein, 32 aa, Artificial Sequence
  Description of Artificial Sequence: Synthetic polypeptide
DEEEIMTTNPVATEQYGGVNTGNWQMQGANTE

SEQ ID NO: 38807 - protein, 32 aa, Artificial Sequence
  Description of Artificial Sequence: Synthetic polypeptide
AEQEIVTTNPVATEQYGEVSTGNLESINGVNR

SEQ ID NO: 38808 - protein, 30 aa, Artificial Sequence
  Description of Artificial Sequence: Synthetic polypeptide
MENEIRTTNPVATEQYGVVSEDLEDRGTDM

SEQ ID NO: 38809 - protein, 35 aa, Artificial Sequence
  Description of Artificial Sequence: Synthetic polypeptide
DEEEIRTTNPVATEQYGSVDCTMNGLCCREGDNDG

SEQ ID NO: 38810 - protein, 31 aa, Artificial Sequence
  Description of Artificial Sequence: Synthetic polypeptide
QENEIATTNPVATECYGSVSDTDLEHNGENR

SEQ ID NO: 38811 - protein, 28 aa, Artificial Sequence
  Description of Artificial Sequence: Synthetic peptide
QEQEITATNPVATECYGWVSTDLEQGNA

SEQ ID NO: 38812 - protein, 34 aa, Artificial Sequence
  Description of Artificial Sequence: Synthetic polypeptide
DEEEIRTTNPVATECYGSVCSDTGNLQDQGDEEY

SEQ ID NO: 38813 - protein, 28 aa, Artificial Sequence
  Description of Artificial Sequence: Synthetic peptide
QEQEIASTNPVATECYGSVSTDLQEEEL

SEQ ID NO: 38814 - protein, 30 aa, Artificial Sequence
  Description of Artificial Sequence: Synthetic polypeptide
DEREIVATNPVSTDQYGVVSENLQRGGADR

SEQ ID NO: 38815 - protein, 30 aa, Artificial Sequence
  Description of Artificial Sequence: Synthetic polypeptide
CEEEIRTTNPVASEQYGSASTDLEDLEGDQ

SEQ ID NO: 38816 - protein, 29 aa, Artificial Sequence
  Description of Artificial Sequence: Synthetic peptide
AEVEITATNPVSTEQYGTVSENLQHAGMR

SEQ ID NO: 38817 - protein, 33 aa, Artificial Sequence
  Description of Artificial Sequence: Synthetic polypeptide
DEVEIATTNPTATEQYGSVSTGNPQLQEGDNTN

SEQ ID NO: 38818 - protein, 28 aa, Artificial Sequence
  Description of Artificial Sequence: Synthetic peptide
DEDAIRTTNTVATEQRGSRRNNEGRGNF

SEQ ID NO: 38819 - protein, 28 aa, Artificial Sequence
  Description of Artificial Sequence: Synthetic peptide
QEQEIATVNPVSTEVYGEASENLQHGNR

SEQ ID NO: 38820 - protein, 28 aa, Artificial Sequence
  Description of Artificial Sequence: Synthetic peptide
DWEEIRSVNNIATEQVGSISDGLQYGNR

SEQ ID NO: 38821 - protein, 28 aa, Artificial Sequence
  Description of Artificial Sequence: Synthetic peptide
DEQEIATVNICSSEMYGCVATNLQRGNR

SEQ ID NO: 38822 - protein, 28 aa, Artificial Sequence
  Description of Artificial Sequence: Synthetic peptide
HETEICSTNPVATEQYGNVAMLLQQGNI

SEQ ID NO: 38823 - protein, 34 aa, Artificial Sequence
  Description of Artificial Sequence: Synthetic polypeptide
DEEEIRTTNPVATEQYGSVSTPNPDQEDDGDEDE

SEQ ID NO: 38824 - protein, 35 aa, Artificial Sequence
  Description of Artificial Sequence: Synthetic polypeptide
DEEEIRTTNPVATEQYGSVSDTMNGLVEIPDGNPV

SEQ ID NO: 38825 - protein, 29 aa, Artificial Sequence
  Description of Artificial Sequence: Synthetic peptide
DEQEVRSVNPVAYEIYGCVSMNLERNGNR

SEQ ID NO: 38826 - protein, 30 aa, Artificial Sequence
  Description of Artificial Sequence: Synthetic polypeptide
DETEIRATNPVATEQYGDVSTQEQFLNPNE

SEQ ID NO: 38827 - protein, 31 aa, Artificial Sequence
  Description of Artificial Sequence: Synthetic polypeptide
QEEEIRSTNPCATEQYGSTSTDGLQLDNGND

SEQ ID NO: 38828 - protein, 31 aa, Artificial Sequence
  Description of Artificial Sequence: Synthetic polypeptide
DEEEIVTTNPDATEQYGEVSTGGDQITGDNY

SEQ ID NO: 38829 - protein, 32 aa, Artificial Sequence
  Description of Artificial Sequence: Synthetic polypeptide
DEEEIRTTNPAATEQYGSVSEGNPQEFGPDDI

SEQ ID NO: 38830 - protein, 31 aa, Artificial Sequence
  Description of Artificial Sequence: Synthetic polypeptide
DETEIRTTNPVATECYGATSTEDLQEPKGNI

SEQ ID NO: 38831 - protein, 28 aa, Artificial Sequence
  Description of Artificial Sequence: Synthetic peptide
DEEEIRDTNIVANEQYGTVSEQILRNSR

SEQ ID NO: 38832 - protein, 34 aa, Artificial Sequence
  Description of Artificial Sequence: Synthetic polypeptide
DEEEIRTTNPVATEQYGSVYSTEDGLQAQNEVTD

SEQ ID NO: 38833 - protein, 31 aa, Artificial Sequence
  Description of Artificial Sequence: Synthetic polypeptide
SEVEIACTNPVATEQYGSVSEMNEQREGTDR

SEQ ID NO: 38834 - protein, 28 aa, Artificial Sequence
  Description of Artificial Sequence: Synthetic peptide
QENEIATTNPVASECYGSVSTELEQGLI

SEQ ID NO: 38835 - protein, 30 aa, Artificial Sequence
  Description of Artificial Sequence: Synthetic polypeptide
DEIEICTTNPVATEQYGTCASVTALQGLNI

SEQ ID NO: 38836 - protein, 28 aa, Artificial Sequence
  Description of Artificial Sequence: Synthetic peptide
DEDEIRTTNILATEMWGVVATNLQQQNT

SEQ ID NO: 38837 - protein, 32 aa, Artificial Sequence
  Description of Artificial Sequence: Synthetic polypeptide
QEEEIATTNPVATECYGSVSATDLQDTKGEDR

SEQ ID NO: 38838 - protein, 33 aa, Artificial Sequence
  Description of Artificial Sequence: Synthetic polypeptide
DEEEIRTTNPVATEQYGSVFCEMNLCCAGFNDC

SEQ ID NO: 38839 - protein, 31 aa, Artificial Sequence
  Description of Artificial Sequence: Synthetic polypeptide
DEVEITTTNPVATEHYGSVSATGNPEIQGNF

SEQ ID NO: 38840 - protein, 29 aa, Artificial Sequence
  Description of Artificial Sequence: Synthetic peptide
QEGEITTTNPVATECFGSVSVGNLQQGDP

SEQ ID NO: 38841 - protein, 28 aa, Artificial Sequence
  Description of Artificial Sequence: Synthetic peptide
SEVEIAATNPTATEMYGEVSTNEQQGNF

SEQ ID NO: 38842 - protein, 28 aa, Artificial Sequence
  Description of Artificial Sequence: Synthetic peptide
AEAELSTTNPVASECYGNVGTNLQRGTQ

SEQ ID NO: 38843 - protein, 30 aa, Artificial Sequence
  Description of Artificial Sequence: Synthetic polypeptide
DEEEIRTTNPVAYEQYGSYSEHDMIGDNDS

SEQ ID NO: 38844 - protein, 31 aa, Artificial Sequence
  Description of Artificial Sequence: Synthetic polypeptide
DEDEVKTTNPVATEPYGQVSADNLQRAGPQR

SEQ ID NO: 38845 - protein, 35 aa, Artificial Sequence
  Description of Artificial Sequence: Synthetic polypeptide
DEEEIRTTNPVATEQYGSVDDVTQNGGERKGINLR

SEQ ID NO: 38846 - protein, 28 aa, Artificial Sequence
  Description of Artificial Sequence: Synthetic peptide
DEEGIRTDNIVATRQYGGVHTNIQTSNS

SEQ ID NO: 38847 - protein, 32 aa, Artificial Sequence
  Description of Artificial Sequence: Synthetic polypeptide
DEEEIRTTNPEATEQYGSVSTEAQVEADEGDF

SEQ ID NO: 38848 - protein, 28 aa, Artificial Sequence
  Description of Artificial Sequence: Synthetic peptide
DEEGIRTTNIVATDQYGYLSTNMRNGTG

SEQ ID NO: 38849 - protein, 31 aa, Artificial Sequence
  Description of Artificial Sequence: Synthetic polypeptide
AEEEITTTNPVATEQYGSVSTELEPKGDEAI

SEQ ID NO: 38850 - protein, 28 aa, Artificial Sequence
  Description of Artificial Sequence: Synthetic peptide
DEQEVAATNPVSSEIYGVVATNLQRGTR

SEQ ID NO: 38851 - protein, 34 aa, Artificial Sequence
  Description of Artificial Sequence: Synthetic polypeptide
DEEEIATTNPVATEQYGSVSITGDQVENNGDNDR

SEQ ID NO: 38852 - protein, 28 aa, Artificial Sequence
  Description of Artificial Sequence: Synthetic peptide
QEQEIAATNPVATEMYGEASTVLQHGMR

SEQ ID NO: 38853 - protein, 33 aa, Artificial Sequence
  Description of Artificial Sequence: Synthetic polypeptide
DEVEIATTNPVATEQYGSVSTMNEQEIEGDNDE

SEQ ID NO: 38854 - protein, 28 aa, Artificial Sequence
  Description of Artificial Sequence: Synthetic peptide
QENEIGTTNPVSTEIYGDVSDNLQNGDH

SEQ ID NO: 38855 - protein, 32 aa, Artificial Sequence
  Description of Artificial Sequence: Synthetic polypeptide
DEEEIATTNPVATEQYGSVSITDQEENNGNDS

SEQ ID NO: 38856 - protein, 28 aa, Artificial Sequence
  Description of Artificial Sequence: Synthetic peptide
DEWMIRTTNIVANDQYGGVSSNQQRGTT

SEQ ID NO: 38857 - protein, 33 aa, Artificial Sequence
  Description of Artificial Sequence: Synthetic polypeptide
DEEEIRTTNPVATEQYGDVSCEMNLCCHAGNDA

SEQ ID NO: 38858 - protein, 28 aa, Artificial Sequence
  Description of Artificial Sequence: Synthetic peptide
DEGEINTTNIIATDQYGTLSDNFWRGNR

SEQ ID NO: 38859 - protein, 28 aa, Artificial Sequence
  Description of Artificial Sequence: Synthetic peptide
DEEEIATTNGVATEVYGTISTNEQFSAT

SEQ ID NO: 38860 - protein, 32 aa, Artificial Sequence
  Description of Artificial Sequence: Synthetic polypeptide
DEEEIRCTNPVCTEQYGSVSTGNDEVYNGENS

SEQ ID NO: 38861 - protein, 28 aa, Artificial Sequence
  Description of Artificial Sequence: Synthetic peptide
DEDSIRTTNIFATIGYGTVSDNLDIGNR

SEQ ID NO: 38862 - protein, 32 aa, Artificial Sequence
  Description of Artificial Sequence: Synthetic polypeptide
DEEEIATTNPVATECYGSVSATDLQDHEGEDL

SEQ ID NO: 38863 - protein, 34 aa, Artificial Sequence
  Description of Artificial Sequence: Synthetic polypeptide
DEEEIRTTNPDATEQYGSVSITPGPLVQLPGDND

SEQ ID NO: 38864 - protein, 33 aa, Artificial Sequence
  Description of Artificial Sequence: Synthetic polypeptide
DEEEIRTTNPVATEAYGNVPSTNNVDLDDGVNW

SEQ ID NO: 38865 - protein, 28 aa, Artificial Sequence
  Description of Artificial Sequence: Synthetic peptide
DEAEIRTENNIMTLQLGSVSTIDQSGNR

SEQ ID NO: 38866 - protein, 28 aa, Artificial Sequence
  Description of Artificial Sequence: Synthetic peptide
DEENLRTTNIVALAQYGQVRTEVQAGNR

SEQ ID NO: 38867 - protein, 28 aa, Artificial Sequence
  Description of Artificial Sequence: Synthetic peptide
DGEEISTTNIAATEGYQSVSTYEDRGTR

SEQ ID NO: 38868 - protein, 28 aa, Artificial Sequence
  Description of Artificial Sequence: Synthetic peptide
AEEEIRTTNIVATDQYGRVATNEQNQTT

SEQ ID NO: 38869 - protein, 28 aa, Artificial Sequence
  Description of Artificial Sequence: Synthetic peptide
DIEEIRTTNIFATEQYGSVETDQDIGEM

SEQ ID NO: 38870 - protein, 28 aa, Artificial Sequence
  Description of Artificial Sequence: Synthetic peptide
AENVIRTTNIVATEQYGSVSNNAIGGTK

SEQ ID NO: 38871 - protein, 28 aa, Artificial Sequence
  Description of Artificial Sequence: Synthetic peptide
DMEEIQTSNLVDWEQYGSVSTTLLHSNR

SEQ ID NO: 38872 - protein, 28 aa, Artificial Sequence
  Description of Artificial Sequence: Synthetic peptide
DEEEIRTTNIFAWDQGGSVSTRSQRKGT

SEQ ID NO: 38873 - protein, 28 aa, Artificial Sequence
  Description of Artificial Sequence: Synthetic peptide
DESEINTNNIVCLEAYGSVTTNIQAGNR

SEQ ID NO: 38874 - protein, 28 aa, Artificial Sequence
  Description of Artificial Sequence: Synthetic peptide
DEEEIATTNPVATEVYGGTRDNLQNQTT

SEQ ID NO: 38875 - protein, 28 aa, Artificial Sequence
  Description of Artificial Sequence: Synthetic peptide
DIEAIRTTNNAAYETYGSVSENLQRNGG

SEQ ID NO: 38876 - protein, 34 aa, Artificial Sequence
  Description of Artificial Sequence: Synthetic polypeptide
DEEEIRTTNPVATEQYGSVSDTTGLELDNGENDF

SEQ ID NO: 38877 - protein, 32 aa, Artificial Sequence
  Description of Artificial Sequence: Synthetic polypeptide
DEEEIRTTNPVATECYGHVSTGQNQDRKENEL

SEQ ID NO: 38878 - protein, 28 aa, Artificial Sequence
  Description of Artificial Sequence: Synthetic peptide
DEDEIRATNPVATEQYGGCSDTVQHGTT

SEQ ID NO: 38879 - protein, 34 aa, Artificial Sequence
  Description of Artificial Sequence: Synthetic polypeptide
DEEEIRTTNPVATEQYGSVSATTDQELVNGENDD

SEQ ID NO: 38880 - protein, 28 aa, Artificial Sequence
  Description of Artificial Sequence: Synthetic peptide
DEEEIRTTNIVATEEYGVTATNEQSSTT

SEQ ID NO: 38881 - protein, 29 aa, Artificial Sequence
  Description of Artificial Sequence: Synthetic peptide
NEEEIRTTNPIATEWFGCVGMNLQFRGTD

SEQ ID NO: 38882 - protein, 28 aa, Artificial Sequence
  Description of Artificial Sequence: Synthetic peptide
TEEEINTTNVVAMEQLLEVSTRLQSGNV

SEQ ID NO: 38883 - protein, 28 aa, Artificial Sequence
  Description of Artificial Sequence: Synthetic peptide
NEEEIKTTNPVDTERYGTTATNLQSSNT

SEQ ID NO: 38884 - protein, 28 aa, Artificial Sequence
  Description of Artificial Sequence: Synthetic peptide
DTEEIAATNIFDTEQTGSVLTNLQRGTK

SEQ ID NO: 38885 - protein, 28 aa, Artificial Sequence
  Description of Artificial Sequence: Synthetic peptide
DEEEITTTNHVITEQYQMTSDNLYNGNS

SEQ ID NO: 38886 - protein, 33 aa, Artificial Sequence
  Description of Artificial Sequence: Synthetic polypeptide
DEEEIRTTNPVATEQYGSVSETVGNDTDEVGEF

SEQ ID NO: 38887 - protein, 32 aa, Artificial Sequence
  Description of Artificial Sequence: Synthetic polypeptide
DEEEIATTNPVATECYGSVSATDLQEHNGEDD

SEQ ID NO: 38888 - protein, 34 aa, Artificial Sequence
  Description of Artificial Sequence: Synthetic polypeptide
DEEEIRTTNPVATEQYGSVSATTDLELDNGENDD

SEQ ID NO: 38889 - protein, 28 aa, Artificial Sequence
  Description of Artificial Sequence: Synthetic peptide
DEEEIRTTNPVATEQWGDYSEIEMQGDM

SEQ ID NO: 38890 - protein, 28 aa, Artificial Sequence
  Description of Artificial Sequence: Synthetic peptide
DEDEIRTTNDVALEQLEMVSTQDQRGGT

SEQ ID NO: 38891 - protein, 28 aa, Artificial Sequence
  Description of Artificial Sequence: Synthetic peptide
DEEEIKTTNIVANEEYGKVATNLQSSTT

SEQ ID NO: 38892 - protein, 28 aa, Artificial Sequence
  Description of Artificial Sequence: Synthetic peptide
IEDMIANTNDVATEQTGSVSTNLLRGVT

SEQ ID NO: 38893 - protein, 28 aa, Artificial Sequence
  Description of Artificial Sequence: Synthetic peptide
DEDQTRTSNNVATEVYGSLSDNNQRGCR

SEQ ID NO: 38894 - protein, 33 aa, Artificial Sequence
  Description of Artificial Sequence: Synthetic polypeptide
DEEEIRTTNPFATEQYGSVSTPNPLPFIDKGEP

SEQ ID NO: 38895 - protein, 34 aa, Artificial Sequence
  Description of Artificial Sequence: Synthetic polypeptide
DEEEIRTTNPVATEQYGSVSTEDNGLEYYKEENE

SEQ ID NO: 38896 - protein, 28 aa, Artificial Sequence
  Description of Artificial Sequence: Synthetic peptide
DEDEICCTNPVATEIFGGVSENWQQGNT

SEQ ID NO: 38897 - protein, 28 aa, Artificial Sequence
  Description of Artificial Sequence: Synthetic peptide
DEQEIDTTNGVATEIYGVVVDNFQRTNT

SEQ ID NO: 38898 - protein, 28 aa, Artificial Sequence
  Description of Artificial Sequence: Synthetic peptide
DEEEIRTTNPVDTDRYGTTATNLQSSTT

SEQ ID NO: 38899 - protein, 28 aa, Artificial Sequence
  Description of Artificial Sequence: Synthetic peptide
DEEEIRTTNPVDTRPYGTTATNLQSSTT

SEQ ID NO: 38900 - protein, 28 aa, Artificial Sequence
  Description of Artificial Sequence: Synthetic peptide
DETEIRTTNIVAIDQQGRVSTNAQVGTT

SEQ ID NO: 38901 - protein, 31 aa, Artificial Sequence
  Description of Artificial Sequence: Synthetic polypeptide
DEEEIVTTNPVATELYGVVSCENEQQEGNDL

SEQ ID NO: 38902 - protein, 28 aa, Artificial Sequence
  Description of Artificial Sequence: Synthetic peptide
DGEEIRAQNIVANEGYGSVSTFLQRATG

SEQ ID NO: 38903 - protein, 28 aa, Artificial Sequence
  Description of Artificial Sequence: Synthetic peptide
DDENINTTNIVAYLNYGTVSTNLIRGAR

SEQ ID NO: 38904 - protein, 34 aa, Artificial Sequence
  Description of Artificial Sequence: Synthetic polypeptide
DEEEIRTTNPCATEQYGSVSETEGLQVREGEEDS

SEQ ID NO: 38905 - protein, 28 aa, Artificial Sequence
  Description of Artificial Sequence: Synthetic peptide
DENEIVTTNPCATEIYGDVPTGLQRPTD

SEQ ID NO: 38906 - protein, 32 aa, Artificial Sequence
  Description of Artificial Sequence: Synthetic polypeptide
DEVEIATTNPTATEQYGSVSTMNEQDQEGDNF

SEQ ID NO: 38907 - protein, 28 aa, Artificial Sequence
  Description of Artificial Sequence: Synthetic peptide
EEEEISTTNIVAIEKYGSLQTNCGRGNT

SEQ ID NO: 38908 - protein, 28 aa, Artificial Sequence
  Description of Artificial Sequence: Synthetic peptide
NDAEIAATNPVATENYGSVANNLQRGTQ

SEQ ID NO: 38909 - protein, 28 aa, Artificial Sequence
  Description of Artificial Sequence: Synthetic peptide
DEEEIKTTNIIATEEYGIVATNLQNTST

SEQ ID NO: 38910 - protein, 28 aa, Artificial Sequence
  Description of Artificial Sequence: Synthetic peptide
DEREINTTNIQAQESYGSVGTNLQGINH

SEQ ID NO: 38911 - protein, 28 aa, Artificial Sequence
  Description of Artificial Sequence: Synthetic peptide
DEHEINTTNIVTTEQYGLISTNIGKKNR

SEQ ID NO: 38912 - protein, 29 aa, Artificial Sequence
  Description of Artificial Sequence: Synthetic peptide
MENEIATTNPVATECYGSVSEDLQDSGDM

SEQ ID NO: 38913 - protein, 35 aa, Artificial Sequence
  Description of Artificial Sequence: Synthetic polypeptide
DEEEIRTTNPVATEQYGSVSITCNDVQDIKGDNDF

SEQ ID NO: 38914 - protein, 34 aa, Artificial Sequence
  Description of Artificial Sequence: Synthetic polypeptide
DEEEIRTTNPVATEQYGSVISTANPPCENGDNCF

SEQ ID NO: 38915 - protein, 33 aa, Artificial Sequence
  Description of Artificial Sequence: Synthetic polypeptide
SEEEIRTTNPVATEQYGEVISTMNLPQIGIDTA

SEQ ID NO: 38916 - protein, 30 aa, Artificial Sequence
  Description of Artificial Sequence: Synthetic polypeptide
DEEEIWTTNPVATEGYGVVCSNCILQLGEQ

SEQ ID NO: 38917 - protein, 28 aa, Artificial Sequence
  Description of Artificial Sequence: Synthetic peptide
QEEEIVTTNPVATEQYGEASEVLQHEEK

SEQ ID NO: 38918 - protein, 28 aa, Artificial Sequence
  Description of Artificial Sequence: Synthetic peptide
DEEEIVTTLIVSTNQIGSQNTNLQRGTT

SEQ ID NO: 38919 - protein, 28 aa, Artificial Sequence
  Description of Artificial Sequence: Synthetic peptide
DEEEIRTTNPDATQQYGSVFEPPDNGEN

SEQ ID NO: 38920 - protein, 28 aa, Artificial Sequence
  Description of Artificial Sequence: Synthetic peptide
GEQEIRTTNIVATEQYGVVSSNNQNTTT

SEQ ID NO: 38921 - protein, 28 aa, Artificial Sequence
  Description of Artificial Sequence: Synthetic peptide
QEHEISQTNPVATEQYGWTSTNDQNGEG

SEQ ID NO: 38922 - protein, 28 aa, Artificial Sequence
  Description of Artificial Sequence: Synthetic peptide
SEEEISTTNPDATEQYGFASTGQQHGME

SEQ ID NO: 38923 - protein, 34 aa, Artificial Sequence
  Description of Artificial Sequence: Synthetic polypeptide
DEEEIRTTNPVATEQYGSVSATTDLELVNGENDD

SEQ ID NO: 38924 - protein, 32 aa, Artificial Sequence
  Description of Artificial Sequence: Synthetic polypeptide
DEEEIRTTNPVATEQYGSVSDDLQEHDEDEDM

SEQ ID NO: 38925 - protein, 28 aa, Artificial Sequence
  Description of Artificial Sequence: Synthetic peptide
DEDNIRTTNIVATAQYGDVSTMLRDSNS

SEQ ID NO: 38926 - protein, 32 aa, Artificial Sequence
  Description of Artificial Sequence: Synthetic polypeptide
DEEEIRTTNPCATEQYGSVDCTMALEHAGNDD

SEQ ID NO: 38927 - protein, 32 aa, Artificial Sequence
  Description of Artificial Sequence: Synthetic polypeptide
DENEIRTTNPVATEQWGSYSTTNEMDRDGNDA

SEQ ID NO: 38928 - protein, 34 aa, Artificial Sequence
  Description of Artificial Sequence: Synthetic polypeptide
DEEEIRTTNPVATEQYGHSHVHQTPPLLIRGENP

SEQ ID NO: 38929 - protein, 32 aa, Artificial Sequence
  Description of Artificial Sequence: Synthetic polypeptide
NEEEIRTTNPVCTEQYGSVSSEELQQAGENDT

SEQ ID NO: 38930 - protein, 28 aa, Artificial Sequence
  Description of Artificial Sequence: Synthetic peptide
SEEEIRATNPVATEMFGEVSENWQIGTQ

SEQ ID NO: 38931 - protein, 28 aa, Artificial Sequence
  Description of Artificial Sequence: Synthetic peptide
DEETIRFNNGVATEIYGSVATNSGRKNE

SEQ ID NO: 38932 - protein, 28 aa, Artificial Sequence
  Description of Artificial Sequence: Synthetic peptide
DEESIETINNTATEQYNSVSTQLQRNHG

SEQ ID NO: 38933 - protein, 28 aa, Artificial Sequence
  Description of Artificial Sequence: Synthetic peptide
EEEEGATTNIVATEQHGSVSMNTQRTDT

SEQ ID NO: 38934 - protein, 28 aa, Artificial Sequence
  Description of Artificial Sequence: Synthetic peptide
DEEGAKTTNIVATENVSSTSTNLLGGNR

SEQ ID NO: 38935 - protein, 28 aa, Artificial Sequence
  Description of Artificial Sequence: Synthetic peptide
DEHEITCTNPVATEHYGAVSDDEQVGNA

SEQ ID NO: 38936 - protein, 31 aa, Artificial Sequence
  Description of Artificial Sequence: Synthetic polypeptide
QENEIRATNPVATECYGVVSTNLEMREGEND

SEQ ID NO: 38937 - protein, 29 aa, Artificial Sequence
  Description of Artificial Sequence: Synthetic peptide
SEQEVSTTNPVATEQYGWVTAANIQRGGR

SEQ ID NO: 38938 - protein, 32 aa, Artificial Sequence
  Description of Artificial Sequence: Synthetic polypeptide
SEEEIRTTNPTATEMYGSVISEMNEQQGDNTR

SEQ ID NO: 38939 - protein, 28 aa, Artificial Sequence
  Description of Artificial Sequence: Synthetic peptide
DEEEIIAINIVETDQVGSVSDGLQLGNR

SEQ ID NO: 38940 - protein, 35 aa, Artificial Sequence
  Description of Artificial Sequence: Synthetic polypeptide
DEEEIRTTNPVATEQYGSVSSTTPNGPNRNGMNPV

SEQ ID NO: 38941 - protein, 29 aa, Artificial Sequence
  Description of Artificial Sequence: Synthetic peptide
QEEEINATNPVSTEQYGVVGTILQSRGGH

SEQ ID NO: 38942 - protein, 28 aa, Artificial Sequence
  Description of Artificial Sequence: Synthetic peptide
EEEEANTTNGVAREQQSSNSTIDQRGNR

SEQ ID NO: 38943 - protein, 28 aa, Artificial Sequence
  Description of Artificial Sequence: Synthetic peptide
DEEEIRATNQVTTKIYGSVSENHGGGQR

SEQ ID NO: 38944 - protein, 33 aa, Artificial Sequence
  Description of Artificial Sequence: Synthetic polypeptide
DEEEIATTNPVATEQYGDVSATTDGQQLRGEND

SEQ ID NO: 38945 - protein, 28 aa, Artificial Sequence
  Description of Artificial Sequence: Synthetic peptide
DEQEVAATNPVSTEIYGVVATNLQRTTR

SEQ ID NO: 38946 - protein, 32 aa, Artificial Sequence
  Description of Artificial Sequence: Synthetic polypeptide
DEHEIRTTNPVATEQYGSVDCEMDLQCHGNDA

SEQ ID NO: 38947 - protein, 28 aa, Artificial Sequence
  Description of Artificial Sequence: Synthetic peptide
DEEEIRINNIFATEIYGSRSDNLLRGTD

SEQ ID NO: 38948 - protein, 34 aa, Artificial Sequence
  Description of Artificial Sequence: Synthetic polypeptide
DEEEIRTTNPVATEQYGSVSVENEGGGFRDGINH

SEQ ID NO: 38949 - protein, 28 aa, Artificial Sequence
  Description of Artificial Sequence: Synthetic peptide
DWEEIRTTNIVAEEIVGSTETTLQGGAR

SEQ ID NO: 38950 - protein, 28 aa, Artificial Sequence
  Description of Artificial Sequence: Synthetic peptide
DEQGVRFTNILATDQYGSTSDNLQGGNR

SEQ ID NO: 38951 - protein, 28 aa, Artificial Sequence
  Description of Artificial Sequence: Synthetic peptide
DEEAIRTTNIVATERYGQRTDILQTVNR

SEQ ID NO: 38952 - protein, 28 aa, Artificial Sequence
  Description of Artificial Sequence: Synthetic peptide
DEEEIRTTNPCAHMFFGCVSTGLDIGNE

SEQ ID NO: 38953 - protein, 28 aa, Artificial Sequence
  Description of Artificial Sequence: Synthetic peptide
QEEEITATNPVATECFGSVSTDWQQGTS

SEQ ID NO: 38954 - protein, 28 aa, Artificial Sequence
  Description of Artificial Sequence: Synthetic peptide
DEFEIAATNPVATEMFGTVSDNEQIGTR

SEQ ID NO: 38955 - protein, 28 aa, Artificial Sequence
  Description of Artificial Sequence: Synthetic peptide
DEDEIATTNPVCTEVYGCVSDEDQTGNC

SEQ ID NO: 38956 - protein, 29 aa, Artificial Sequence
  Description of Artificial Sequence: Synthetic peptide
QEQEIAATNPVATEVYGEASAENLQRGGR

SEQ ID NO: 38957 - protein, 28 aa, Artificial Sequence
  Description of Artificial Sequence: Synthetic peptide
DENEIAQTNPVATEQYGVVSTDDEVGEL

SEQ ID NO: 38958 - protein, 28 aa, Artificial Sequence
  Description of Artificial Sequence: Synthetic peptide
EEENIITTNIVTTEQYRILSSNLQGGNR

SEQ ID NO: 38959 - protein, 31 aa, Artificial Sequence
  Description of Artificial Sequence: Synthetic polypeptide
DEEEIATTNPVATELYGIVSDDLQQYANGNI

SEQ ID NO: 38960 - protein, 34 aa, Artificial Sequence
  Description of Artificial Sequence: Synthetic polypeptide
DEEEIRTTNPVATEQYGSVDCTMALQDDEGENDI

SEQ ID NO: 38961 - protein, 29 aa, Artificial Sequence
  Description of Artificial Sequence: Synthetic peptide
DEAEIAQTNPVATEMYGVTSCTLQSRGNY

SEQ ID NO: 38962 - protein, 33 aa, Artificial Sequence
  Description of Artificial Sequence: Synthetic polypeptide
DEEEIRTTNPVATEQYGSVSETDLEDNDGDEEL

SEQ ID NO: 38963 - protein, 32 aa, Artificial Sequence
  Description of Artificial Sequence: Synthetic polypeptide
DEQEIRTTNPVATEQYGDVSCEMDLQCTGNDM

SEQ ID NO: 38964 - protein, 32 aa, Artificial Sequence
  Description of Artificial Sequence: Synthetic polypeptide
DEEEIATTNPFATEQYGQVSIELNPQDRKGNS

SEQ ID NO: 38965 - protein, 28 aa, Artificial Sequence
  Description of Artificial Sequence: Synthetic peptide
DEEEIRDTNISKTEQYGSVTNNFQRTCA

SEQ ID NO: 38966 - protein, 28 aa, Artificial Sequence
  Description of Artificial Sequence: Synthetic peptide
DEEELSQTNIVATFNYGSVGTQMGRGNR

SEQ ID NO: 38967 - protein, 28 aa, Artificial Sequence
  Description of Artificial Sequence: Synthetic peptide
DEDELRTTNIVATEQYTVISTHLGAGNG

SEQ ID NO: 38968 - protein, 35 aa, Artificial Sequence
  Description of Artificial Sequence: Synthetic polypeptide
DEEEIRTTNPVATEQYGSVCSETCPLVLDRKGTNV

SEQ ID NO: 38969 - protein, 33 aa, Artificial Sequence
  Description of Artificial Sequence: Synthetic polypeptide
DEEEIATTNPTATEQYGGVSTMNEQLQEGDNTF

SEQ ID NO: 38970 - protein, 28 aa, Artificial Sequence
  Description of Artificial Sequence: Synthetic peptide
QEQEIACTNPVSTEQYGEASEVLQRGMR

SEQ ID NO: 38971 - protein, 31 aa, Artificial Sequence
  Description of Artificial Sequence: Synthetic polypeptide
DEEEIVTTNPVATECYGWVSETPLERKGDEV

SEQ ID NO: 38972 - protein, 28 aa, Artificial Sequence
  Description of Artificial Sequence: Synthetic peptide
DEVEIACTNPVCTECYGTVSTDWQHGNG

SEQ ID NO: 38973 - protein, 28 aa, Artificial Sequence
  Description of Artificial Sequence: Synthetic peptide
DEEEIATTNPVATRPYGTTATNLQSSTT

SEQ ID NO: 38974 - protein, 28 aa, Artificial Sequence
  Description of Artificial Sequence: Synthetic peptide
DEFETEQTNIVKTDQYGSVSTELQRGIT

SEQ ID NO: 38975 - protein, 28 aa, Artificial Sequence
  Description of Artificial Sequence: Synthetic peptide
DEENLNTQNGVRTEQYGSVHTNLQYNNT

SEQ ID NO: 38976 - protein, 28 aa, Artificial Sequence
  Description of Artificial Sequence: Synthetic peptide
DENEIAQTNPVATEQYGVVDTDDEVGNL

SEQ ID NO: 38977 - protein, 33 aa, Artificial Sequence
  Description of Artificial Sequence: Synthetic polypeptide
DEDEIRATNPVATEQYGEVISATMNGLQQEGNI

SEQ ID NO: 38978 - protein, 30 aa, Artificial Sequence
  Description of Artificial Sequence: Synthetic polypeptide
DEQEIATVNPVSTEQYGEASTVLQSRAGGR

SEQ ID NO: 38979 - protein, 31 aa, Artificial Sequence
  Description of Artificial Sequence: Synthetic polypeptide
DENEIRTTNPVATEQWGSYSTNEMDYDGNDA

SEQ ID NO: 38980 - protein, 28 aa, Artificial Sequence
  Description of Artificial Sequence: Synthetic peptide
NEHEIRTTNPVCTEQYGAVSEDDCHGNS

SEQ ID NO: 38981 - protein, 36 aa, Artificial Sequence
  Description of Artificial Sequence: Synthetic polypeptide
DEEEIRTTNPDATEQYGSVASCTIGNLVIEREGVNR

SEQ ID NO: 38982 - protein, 28 aa, Artificial Sequence
  Description of Artificial Sequence: Synthetic peptide
DEEEGRTTNQVATEYYGIVHDHLEGGNF

SEQ ID NO: 38983 - protein, 33 aa, Artificial Sequence
  Description of Artificial Sequence: Synthetic polypeptide
DEEEIRTTNPVATEQYGSVISATENPDINGTHG

SEQ ID NO: 38984 - protein, 28 aa, Artificial Sequence
  Description of Artificial Sequence: Synthetic peptide
DEEEVRTTNTVMNEQRTSTSTNLQGKNT

SEQ ID NO: 38985 - protein, 28 aa, Artificial Sequence
  Description of Artificial Sequence: Synthetic peptide
DEEEIDTTNIVAITHYGSVSDNIGRAAR

SEQ ID NO: 38986 - protein, 28 aa, Artificial Sequence
  Description of Artificial Sequence: Synthetic peptide
DTEEIQFGNIVATEQYQAVHQNLQVGNR

SEQ ID NO: 38987 - protein, 36 aa, Artificial Sequence
  Description of Artificial Sequence: Synthetic polypeptide
DEEEIRTTNPFATEQYGSVSVTENGLVDLRNGENPR

SEQ ID NO: 38988 - protein, 28 aa, Artificial Sequence
  Description of Artificial Sequence: Synthetic peptide
DESEINTTNGVANERYGSVRTNISRANE

SEQ ID NO: 38989 - protein, 34 aa, Artificial Sequence
  Description of Artificial Sequence: Synthetic polypeptide
DEEEIRTTNPDATEQYGSVSDTPNGLDIDNGDNP

SEQ ID NO: 38990 - protein, 33 aa, Artificial Sequence
  Description of Artificial Sequence: Synthetic polypeptide
QEEEIATTNPVATECYGVVSETNLQETNGENDR

SEQ ID NO: 38991 - protein, 28 aa, Artificial Sequence
  Description of Artificial Sequence: Synthetic peptide
DEREIRATNIVATEMYGTVATNLQSSSE

SEQ ID NO: 38992 - protein, 28 aa, Artificial Sequence
  Description of Artificial Sequence: Synthetic peptide
DDSEIRGSNIVITEQYGSVHTNIIDGNR

SEQ ID NO: 38993 - protein, 28 aa, Artificial Sequence
  Description of Artificial Sequence: Synthetic peptide
DEEEIKTTNNVATEEYGGLSTCIQRKAG

SEQ ID NO: 38994 - protein, 28 aa, Artificial Sequence
  Description of Artificial Sequence: Synthetic peptide
EDENWRNTNIVATEQSGSVSTNIIGGNR

SEQ ID NO: 38995 - protein, 28 aa, Artificial Sequence
  Description of Artificial Sequence: Synthetic peptide
DEQEIMATNPVATEQYGEVSEDDQQLNA

SEQ ID NO: 38996 - protein, 28 aa, Artificial Sequence
  Description of Artificial Sequence: Synthetic peptide
DETEIRTVNPVATEQYGTTGTEDETGNI

SEQ ID NO: 38997 - protein, 28 aa, Artificial Sequence
  Description of Artificial Sequence: Synthetic peptide
DEEEIATTNPVATRPYGTTATNLQNSTT

SEQ ID NO: 38998 - protein, 28 aa, Artificial Sequence
  Description of Artificial Sequence: Synthetic peptide
DESDIRTTNIFATEQYGIIRTNLQTSNG

SEQ ID NO: 38999 - protein, 28 aa, Artificial Sequence
  Description of Artificial Sequence: Synthetic peptide
QEEEIAATNPVATETYGVVSTALQQETY

SEQ ID NO: 39000 - protein, 28 aa, Artificial Sequence
  Description of Artificial Sequence: Synthetic peptide
NEEGLADTNIVRTEQYGEVRTNLQQGNR

SEQ ID NO: 39001 - protein, 32 aa, Artificial Sequence
  Description of Artificial Sequence: Synthetic polypeptide
DEEEIRTTNPVATEQYGSVSEELQEHDEDEDN

SEQ ID NO: 39002 - protein, 30 aa, Artificial Sequence
  Description of Artificial Sequence: Synthetic polypeptide
AETEIVTTNPVATEQYGCVGSEMNLQPLIR

SEQ ID NO: 39003 - protein, 31 aa, Artificial Sequence
  Description of Artificial Sequence: Synthetic polypeptide
DEEEIATTNPVATEQYGDVSCEEPDQLGDNV

SEQ ID NO: 39004 - protein, 32 aa, Artificial Sequence
  Description of Artificial Sequence: Synthetic polypeptide
DEQEITTTNPVATEQYGVVSCEMNLQCQGNDY

SEQ ID NO: 39005 - protein, 28 aa, Artificial Sequence
  Description of Artificial Sequence: Synthetic peptide
ETDEIDDTNIVAREQYGTVSDNLQRSNR

SEQ ID NO: 39006 - protein, 28 aa, Artificial Sequence
  Description of Artificial Sequence: Synthetic peptide
MEEEISSTNPEATEQYGAVSENGIQGNF

SEQ ID NO: 39007 - protein, 28 aa, Artificial Sequence
  Description of Artificial Sequence: Synthetic peptide
QEEEIATTNPVATEQYGEASEVLQHEEK

SEQ ID NO: 39008 - protein, 35 aa, Artificial Sequence
  Description of Artificial Sequence: Synthetic polypeptide
DEEEIRTTNPVATEQYGSVSTTDNLVEEVEGDNDC

SEQ ID NO: 39009 - protein, 30 aa, Artificial Sequence
  Description of Artificial Sequence: Synthetic polypeptide
QEHEICTTNPCATECYGSVSTDLQETNGNM

SEQ ID NO: 39010 - protein, 32 aa, Artificial Sequence
  Description of Artificial Sequence: Synthetic polypeptide
DEHEIRTTNPVATEQYGDVSCEMDLCCHGNDR

SEQ ID NO: 39011 - protein, 28 aa, Artificial Sequence
  Description of Artificial Sequence: Synthetic peptide
EDIEGRTSNIVFTEQYGSVSDRLQRGNT

SEQ ID NO: 39012 - protein, 33 aa, Artificial Sequence
  Description of Artificial Sequence: Synthetic polypeptide
DEEEIRTTNPVATEQYGSVSETDLEDHEGEEDF

SEQ ID NO: 39013 - protein, 32 aa, Artificial Sequence
  Description of Artificial Sequence: Synthetic polypeptide
DEQEIRTTNPVATEQYGSVSTLDPDQDHGEDV

SEQ ID NO: 39014 - protein, 30 aa, Artificial Sequence
  Description of Artificial Sequence: Synthetic polypeptide
VEDEIRTTNPVASEQYGCVGAMNLERNGND

SEQ ID NO: 39015 - protein, 28 aa, Artificial Sequence
  Description of Artificial Sequence: Synthetic peptide
SEEEIRTTNIVATEQINNNSTNHQRSQI

SEQ ID NO: 39016 - protein, 30 aa, Artificial Sequence
  Description of Artificial Sequence: Synthetic polypeptide
DEVEIAATNPTATEQFGGVSTNPQREGTTR

SEQ ID NO: 39017 - protein, 34 aa, Artificial Sequence
  Description of Artificial Sequence: Synthetic polypeptide
DEEEIRTTNPVATEQYGSVSITTDLEEVEGDNDV

SEQ ID NO: 39018 - protein, 28 aa, Artificial Sequence
  Description of Artificial Sequence: Synthetic peptide
SEQEIRTTNIVATEEYGVVATNLQNQST

SEQ ID NO: 39019 - protein, 28 aa, Artificial Sequence
  Description of Artificial Sequence: Synthetic peptide
DEIEQRDTNRGDTEQLTLVSTNLQAGNR

SEQ ID NO: 39020 - protein, 28 aa, Artificial Sequence
  Description of Artificial Sequence: Synthetic peptide
SENEIRTVNPVATEQYGSMATDPELGNM

SEQ ID NO: 39021 - protein, 34 aa, Artificial Sequence
  Description of Artificial Sequence: Synthetic polypeptide
DEEEIRTTNPVATEQYWSVESTPNPLQDDGDEPP

SEQ ID NO: 39022 - protein, 30 aa, Artificial Sequence
  Description of Artificial Sequence: Synthetic polypeptide
DEEEIRTTNPVATEQWGDVSENEMNAAGDA

SEQ ID NO: 39023 - protein, 28 aa, Artificial Sequence
  Description of Artificial Sequence: Synthetic peptide
NEEEISGTNIVATEQYGVVSTEEINGNS

SEQ ID NO: 39024 - protein, 28 aa, Artificial Sequence
  Description of Artificial Sequence: Synthetic peptide
NEEETRTTNIVATEKYGRVSTNKQDSTT

SEQ ID NO: 39025 - protein, 28 aa, Artificial Sequence
  Description of Artificial Sequence: Synthetic peptide
AEAELNTTNPVATECYGEVSTNVQRPPH

SEQ ID NO: 39026 - protein, 31 aa, Artificial Sequence
  Description of Artificial Sequence: Synthetic polypeptide
DEVEIATTNPCATEQYGDVSCTDLQCQAGNA

SEQ ID NO: 39027 - protein, 28 aa, Artificial Sequence
  Description of Artificial Sequence: Synthetic peptide
DENEIAQTNPVATEQYGDVSTGDEHGEQ

SEQ ID NO: 39028 - protein, 28 aa, Artificial Sequence
  Description of Artificial Sequence: Synthetic peptide
DEEEIRCTNPVATENYGNVATPDEEGTL

SEQ ID NO: 39029 - protein, 33 aa, Artificial Sequence
  Description of Artificial Sequence: Synthetic polypeptide
DEEEIATTNPVATEQYGSVSETEDQELNNGNDT

SEQ ID NO: 39030 - protein, 28 aa, Artificial Sequence
  Description of Artificial Sequence: Synthetic peptide
YEHEVATTNPVSTEQYGAVSTDLEAGNV

SEQ ID NO: 39031 - protein, 28 aa, Artificial Sequence
  Description of Artificial Sequence: Synthetic peptide
AENEIAQTNPVATEQYGSVDTDQEVGER

SEQ ID NO: 39032 - protein, 28 aa, Artificial Sequence
  Description of Artificial Sequence: Synthetic peptide
SDEEIATTNPTATEMYGAVNTNLMVGNS

SEQ ID NO: 39033 - protein, 28 aa, Artificial Sequence
  Description of Artificial Sequence: Synthetic peptide
NEEEIQTGNIVAQEQYGGLSNNLGIGNR

SEQ ID NO: 39034 - protein, 31 aa, Artificial Sequence
  Description of Artificial Sequence: Synthetic polypeptide
DDQEITTTNPVATECYGSVSTNGLQEDKGET

SEQ ID NO: 39035 - protein, 32 aa, Artificial Sequence
  Description of Artificial Sequence: Synthetic polypeptide
SEEEIRTTNPVATEQYGSHYSEALQDQYGANP

SEQ ID NO: 39036 - protein, 30 aa, Artificial Sequence
  Description of Artificial Sequence: Synthetic polypeptide
VENEIRTTNPVATECYGSVSDTELEIHGEH

SEQ ID NO: 39037 - protein, 35 aa, Artificial Sequence
  Description of Artificial Sequence: Synthetic polypeptide
DEEEIRTTNPVATEQYGSVQSLTDTLQIQDEGNNI

SEQ ID NO: 39038 - protein, 28 aa, Artificial Sequence
  Description of Artificial Sequence: Synthetic peptide
DEEEIGTTNIGATEQWGTISTNEQSQVR

SEQ ID NO: 39039 - protein, 28 aa, Artificial Sequence
  Description of Artificial Sequence: Synthetic peptide
DENEITCTNPVCTEPYGSVATDDQYGND

SEQ ID NO: 39040 - protein, 28 aa, Artificial Sequence
  Description of Artificial Sequence: Synthetic peptide
DEEEVRTTNITAYEQYGSVADNSQGGSG

SEQ ID NO: 39041 - protein, 30 aa, Artificial Sequence
  Description of Artificial Sequence: Synthetic polypeptide
DEGEITATNPVATECFGSVSTGNWQQGDDR

SEQ ID NO: 39042 - protein, 29 aa, Artificial Sequence
  Description of Artificial Sequence: Synthetic peptide
CEEEIAATNPCATEQYGCVSATTVQRGQF

SEQ ID NO: 39043 - protein, 33 aa, Artificial Sequence
  Description of Artificial Sequence: Synthetic polypeptide
DEEEIRTTNPVATEVYGVVCSTEDLQRKGEEDI

SEQ ID NO: 39044 - protein, 28 aa, Artificial Sequence
  Description of Artificial Sequence: Synthetic peptide
SEVEIATTNPEATECFGSVSENWQNGNA

SEQ ID NO: 39045 - protein, 28 aa, Artificial Sequence
  Description of Artificial Sequence: Synthetic peptide
SEEEIYATNPEATEQYGSVSTGPQHETV

SEQ ID NO: 39046 - protein, 28 aa, Artificial Sequence
  Description of Artificial Sequence: Synthetic peptide
DEEEVRTNLIGGTEQYGSVSTNLGRNAT

SEQ ID NO: 39047 - protein, 29 aa, Artificial Sequence
  Description of Artificial Sequence: Synthetic peptide
DEQEIRTTNPVATECWGSVSENEMMQGTA

SEQ ID NO: 39048 - protein, 31 aa, Artificial Sequence
  Description of Artificial Sequence: Synthetic polypeptide
DEHEIRTTNPVATEQYGDVSCEMELCHGNDS

SEQ ID NO: 39049 - protein, 28 aa, Artificial Sequence
  Description of Artificial Sequence: Synthetic peptide
DEGAGRTTDTVAGLRYGSVSTNLQSGNT

SEQ ID NO: 39050 - protein, 32 aa, Artificial Sequence
  Description of Artificial Sequence: Synthetic polypeptide
DEVEIATTNPVATEQYGSVISENEQDREGDTF

SEQ ID NO: 39051 - protein, 31 aa, Artificial Sequence
  Description of Artificial Sequence: Synthetic polypeptide
QEEEIATTNPVATEQYGWVSTNLEDFKGDDP

SEQ ID NO: 39052 - protein, 28 aa, Artificial Sequence
  Description of Artificial Sequence: Synthetic peptide
SEFEIYTTNPVATESFGSVSVNWQHGDS

SEQ ID NO: 39053 - protein, 28 aa, Artificial Sequence
  Description of Artificial Sequence: Synthetic peptide
DEEEIRRTNLCAAEVYGSVANNLQFGGT

SEQ ID NO: 39054 - protein, 32 aa, Artificial Sequence
  Description of Artificial Sequence: Synthetic polypeptide
DEVEIATTNPTATEQYGSVSTMNEQEIEGDNE

SEQ ID NO: 39055 - protein, 28 aa, Artificial Sequence
  Description of Artificial Sequence: Synthetic peptide
DESEIITNNNVATEGEGSVSTNILRKTR

SEQ ID NO: 39056 - protein, 35 aa, Artificial Sequence
  Description of Artificial Sequence: Synthetic polypeptide
DEEEIRTTNPEATEQYGESVDSETEDGLVQREGER

SEQ ID NO: 39057 - protein, 28 aa, Artificial Sequence
  Description of Artificial Sequence: Synthetic peptide
DEEEIRTTAIVAEDNYGSVSTLVGGGNQ

SEQ ID NO: 39058 - protein, 31 aa, Artificial Sequence
  Description of Artificial Sequence: Synthetic polypeptide
MENEIATTNPVATEMYGSVSENLQDTEGNDM

SEQ ID NO: 39059 - protein, 34 aa, Artificial Sequence
  Description of Artificial Sequence: Synthetic polypeptide
DEEEIRTTNPVATEQYGSVSTTTGLEDDEGENDL

SEQ ID NO: 39060 - protein, 28 aa, Artificial Sequence
  Description of Artificial Sequence: Synthetic peptide
DDENIMLALTVANEQYGTVSTNLQRGTR

SEQ ID NO: 39061 - protein, 28 aa, Artificial Sequence
  Description of Artificial Sequence: Synthetic peptide
DNEEIRTTNIVANEGLGSHSTLLRRQNN

SEQ ID NO: 39062 - protein, 32 aa, Artificial Sequence
  Description of Artificial Sequence: Synthetic polypeptide
DEEEIRATNPTSTELYGSVSAENLQREGANTH

SEQ ID NO: 39063 - protein, 28 aa, Artificial Sequence
  Description of Artificial Sequence: Synthetic peptide
DENEIAQTNPVATEQYGDVSTDQEVGED

SEQ ID NO: 39064 - protein, 28 aa, Artificial Sequence
  Description of Artificial Sequence: Synthetic peptide
DEEQIAFTNIVALDQYGDLSTNLQRNNG

SEQ ID NO: 39065 - protein, 34 aa, Artificial Sequence
  Description of Artificial Sequence: Synthetic polypeptide
DEEEIATTNPVATEQYGSVSITGDLVENNGDNDR

SEQ ID NO: 39066 - protein, 34 aa, Artificial Sequence
  Description of Artificial Sequence: Synthetic polypeptide
DEEEIRTTNPVATEQYGSVSATTGQELDNGENDD

SEQ ID NO: 39067 - protein, 30 aa, Artificial Sequence
  Description of Artificial Sequence: Synthetic polypeptide
DEVEISTTNPVSTEQYGSVSATADQIGETF

SEQ ID NO: 39068 - protein, 28 aa, Artificial Sequence
  Description of Artificial Sequence: Synthetic peptide
DEEEINGTNNVNNEQYGSVNTNTQGNDG

SEQ ID NO: 39069 - protein, 28 aa, Artificial Sequence
  Description of Artificial Sequence: Synthetic peptide
DEEEIQTTLIVGKEQVGSVHTMLQNGNT

SEQ ID NO: 39070 - protein, 33 aa, Artificial Sequence
  Description of Artificial Sequence: Synthetic polypeptide
DEEEIRCTNPDATEQYGWVASTTNLQQDDGIND

SEQ ID NO: 39071 - protein, 28 aa, Artificial Sequence
  Description of Artificial Sequence: Synthetic peptide
SEEEIRSTNPVSTEQWGSVSTAEEVGDY

SEQ ID NO: 39072 - protein, 28 aa, Artificial Sequence
  Description of Artificial Sequence: Synthetic peptide
DEEEIKTTNIVATESYGVVVDNEQNGTT

SEQ ID NO: 39073 - protein, 33 aa, Artificial Sequence
  Description of Artificial Sequence: Synthetic polypeptide
SEEEIRTTNPTATEQFGSVSTANLQLIEGENDI

SEQ ID NO: 39074 - protein, 29 aa, Artificial Sequence
  Description of Artificial Sequence: Synthetic peptide
DEEEISTTNPVATEQWGSVDDADMQGNDS

SEQ ID NO: 39075 - protein, 28 aa, Artificial Sequence
  Description of Artificial Sequence: Synthetic peptide
DERNLRTTNIITLDQYGEVSTNLQRGNT

SEQ ID NO: 39076 - protein, 28 aa, Artificial Sequence
  Description of Artificial Sequence: Synthetic peptide
DESEIRTTNIVTTDQYSAVTDNLERGNV

SEQ ID NO: 39077 - protein, 29 aa, Artificial Sequence
  Description of Artificial Sequence: Synthetic peptide
DENEIRTTNPVATECWGSVSEEDENRGDT

SEQ ID NO: 39078 - protein, 30 aa, Artificial Sequence
  Description of Artificial Sequence: Synthetic polypeptide
MENEIRTTNPVATECYGSVSENEQDHEGEQ

SEQ ID NO: 39079 - protein, 28 aa, Artificial Sequence
  Description of Artificial Sequence: Synthetic peptide
DTEEIRTTNIMATENYGSMIDNLQGGSG

SEQ ID NO: 39080 - protein, 34 aa, Artificial Sequence
  Description of Artificial Sequence: Synthetic polypeptide
DEEEIRTTNPVATEQYGSVFCEMNLCCRDGFNPC

SEQ ID NO: 39081 - protein, 28 aa, Artificial Sequence
  Description of Artificial Sequence: Synthetic peptide
GDSEIRTTNPCAYEFYGVVASNLERGNR

SEQ ID NO: 39082 - protein, 28 aa, Artificial Sequence
  Description of Artificial Sequence: Synthetic peptide
DEEEIRTTHIVGTEIYGAVATNLQHSTT

SEQ ID NO: 39083 - protein, 28 aa, Artificial Sequence
  Description of Artificial Sequence: Synthetic peptide
SEVEIAATNPVATEIFGSVSENEQRGDF

SEQ ID NO: 39084 - protein, 32 aa, Artificial Sequence
  Description of Artificial Sequence: Synthetic polypeptide
DEQEIRTTNPVATEQYGSVESETPLEDSGDEI

SEQ ID NO: 39085 - protein, 33 aa, Artificial Sequence
  Description of Artificial Sequence: Synthetic polypeptide
DEEEIRTTNPVATEQYGSVSTEPDQEHDGDEDW

SEQ ID NO: 39086 - protein, 33 aa, Artificial Sequence
  Description of Artificial Sequence: Synthetic polypeptide
DEEEIRTTNPVATEQYGNVSSEGNPGQDMGDNF

SEQ ID NO: 39087 - protein, 28 aa, Artificial Sequence
  Description of Artificial Sequence: Synthetic peptide
DENEIRTTNPVATECWGSVDENEMTGTF

SEQ ID NO: 39088 - protein, 32 aa, Artificial Sequence
  Description of Artificial Sequence: Synthetic polypeptide
SEEEIRTTNPTATEQYGSVSTANEQEFGDTTG

SEQ ID NO: 39089 - protein, 28 aa, Artificial Sequence
  Description of Artificial Sequence: Synthetic peptide
DEMEIKTTNDVETEQEGGVSTNTYRKNG

SEQ ID NO: 39090 - protein, 28 aa, Artificial Sequence
  Description of Artificial Sequence: Synthetic peptide
DEEIIATTNTVATEHILSVSNNHQSGNN

SEQ ID NO: 39091 - protein, 28 aa, Artificial Sequence
  Description of Artificial Sequence: Synthetic peptide
DENQIATEMIVATEQYGSISTNLAGGGR

SEQ ID NO: 39092 - protein, 30 aa, Artificial Sequence
  Description of Artificial Sequence: Synthetic polypeptide
DEVEIATTNPTATEIFGSVSTNEQLEGDNQ

SEQ ID NO: 39093 - protein, 30 aa, Artificial Sequence
  Description of Artificial Sequence: Synthetic polypeptide
MENEIRTTNPVATECYGSVATELQEVGEDL

SEQ ID NO: 39094 - protein, 28 aa, Artificial Sequence
  Description of Artificial Sequence: Synthetic peptide
QENEIASTNPVATECYGSVSTDLEVGEL

SEQ ID NO: 39095 - protein, 29 aa, Artificial Sequence
  Description of Artificial Sequence: Synthetic peptide
DDQEIRTTNPCATEQYGCVASNLEREPND

SEQ ID NO: 39096 - protein, 34 aa, Artificial Sequence
  Description of Artificial Sequence: Synthetic polypeptide
DEEEIRTTNPFATEQYGSVPSETNNLFREAMNDD

SEQ ID NO: 39097 - protein, 33 aa, Artificial Sequence
  Description of Artificial Sequence: Synthetic polypeptide
DEEEIRTTNPTATEQYGSVISTMNEQESGDTDG

SEQ ID NO: 39098 - protein, 31 aa, Artificial Sequence
  Description of Artificial Sequence: Synthetic polypeptide
DEQEIATTNPVATEQYGSVSATDLEDHEGEL

SEQ ID NO: 39099 - protein, 30 aa, Artificial Sequence
  Description of Artificial Sequence: Synthetic polypeptide
DEEEISTTNPCATEQYGDASTMDIQQDGNV

SEQ ID NO: 39100 - protein, 30 aa, Artificial Sequence
  Description of Artificial Sequence: Synthetic polypeptide
QENEIVTTNPVATECYGSVSTELQVTGEEQ

SEQ ID NO: 39101 - protein, 28 aa, Artificial Sequence
  Description of Artificial Sequence: Synthetic peptide
DEIEGNTLNIVATEQYGGVSTNLYDKNG

SEQ ID NO: 39102 - protein, 31 aa, Artificial Sequence
  Description of Artificial Sequence: Synthetic polypeptide
DEQEIATTNPVATECYGSVSATDLQINGEDL

SEQ ID NO: 39103 - protein, 28 aa, Artificial Sequence
  Description of Artificial Sequence: Synthetic peptide
SEVEIRTTNPTATETFGEVSENEQNGNF

SEQ ID NO: 39104 - protein, 36 aa, Artificial Sequence
  Description of Artificial Sequence: Synthetic polypeptide
DEEEIRTTNPVATEQYGSVISTMNGPPQLREGDNCG

SEQ ID NO: 39105 - protein, 28 aa, Artificial Sequence
  Description of Artificial Sequence: Synthetic peptide
DEEEIATTNIDATEQYGSVETIDEDGED

SEQ ID NO: 39106 - protein, 29 aa, Artificial Sequence
  Description of Artificial Sequence: Synthetic peptide
DEQEIRTTNPVATECWGSYDTNEMMQGNM

SEQ ID NO: 39107 - protein, 30 aa, Artificial Sequence
  Description of Artificial Sequence: Synthetic polypeptide
DEEEIAAVNPVATECYGSVSEDLQDQGDDR

SEQ ID NO: 39108 - protein, 33 aa, Artificial Sequence
  Description of Artificial Sequence: Synthetic polypeptide
DEEEIRTTNPVATEQYGSVSTDPVQEIKGVEDL

SEQ ID NO: 39109 - protein, 28 aa, Artificial Sequence
  Description of Artificial Sequence: Synthetic peptide
DEVENSTNNIVANEQYGRVSTNLNGGGR

SEQ ID NO: 39110 - protein, 33 aa, Artificial Sequence
  Description of Artificial Sequence: Synthetic polypeptide
DEMEIRTTNPVATEQYGVVDSVTIDPGQRKGNS

SEQ ID NO: 39111 - protein, 28 aa, Artificial Sequence
  Description of Artificial Sequence: Synthetic peptide
DEMEIRATNIVAWELYGSVATNLQNSST

SEQ ID NO: 39112 - protein, 28 aa, Artificial Sequence
  Description of Artificial Sequence: Synthetic peptide
DEEEIRTTNPVAYQQYGSNNTWKHDGIP

SEQ ID NO: 39113 - protein, 34 aa, Artificial Sequence
  Description of Artificial Sequence: Synthetic polypeptide
DEQEIRTTNPVATEQYGSTVDSITYNADDLRGNL

SEQ ID NO: 39114 - protein, 29 aa, Artificial Sequence
  Description of Artificial Sequence: Synthetic peptide
DENEIASTNPVASEQYGVVSTDLQDQGEL

SEQ ID NO: 39115 - protein, 28 aa, Artificial Sequence
  Description of Artificial Sequence: Synthetic peptide
DENEIAQTNPVATEQYGVVSTDQEDGEA

SEQ ID NO: 39116 - protein, 31 aa, Artificial Sequence
  Description of Artificial Sequence: Synthetic polypeptide
DEQEIATTNPVATECYGSVSATDLEDREGEL

SEQ ID NO: 39117 - protein, 28 aa, Artificial Sequence
  Description of Artificial Sequence: Synthetic peptide
YEEEITTTNPVATEQYGEAPTVLQHPQH

SEQ ID NO: 39118 - protein, 33 aa, Artificial Sequence
  Description of Artificial Sequence: Synthetic polypeptide
DEEEIRTTNPVATEQYGSVSITEELEDNDGDEL

SEQ ID NO: 39119 - protein, 34 aa, Artificial Sequence
  Description of Artificial Sequence: Synthetic polypeptide
DEEEIRTTNPFATEQYGSVTSDTPNPLDPEGENP

SEQ ID NO: 39120 - protein, 31 aa, Artificial Sequence
  Description of Artificial Sequence: Synthetic polypeptide
DEEEIRTTNPVATEQYGEVSEDLQEAQEEDM

SEQ ID NO: 39121 - protein, 28 aa, Artificial Sequence
  Description of Artificial Sequence: Synthetic peptide
QESEIYTTNPVATEIYGEVSYNWEDGNM

SEQ ID NO: 39122 - protein, 29 aa, Artificial Sequence
  Description of Artificial Sequence: Synthetic peptide
SDQEIATTNPVATEIYGVVASNLEREGNR

SEQ ID NO: 39123 - protein, 28 aa, Artificial Sequence
  Description of Artificial Sequence: Synthetic peptide
DEEHIRTTNIIATEEYGVVATSLQNQNT

SEQ ID NO: 39124 - protein, 34 aa, Artificial Sequence
  Description of Artificial Sequence: Synthetic polypeptide
AEEEIRTTNPVATEQYGVVDDTTNGLVQLVGNDR

SEQ ID NO: 39125 - protein, 28 aa, Artificial Sequence
  Description of Artificial Sequence: Synthetic peptide
DEEEVRTTNIVAGRIYTSHSNNLQGGNE

SEQ ID NO: 39126 - protein, 33 aa, Artificial Sequence
  Description of Artificial Sequence: Synthetic polypeptide
AEEEIATTNPVATEQYGVVDSTNGLVERGEEDR

SEQ ID NO: 39127 - protein, 30 aa, Artificial Sequence
  Description of Artificial Sequence: Synthetic polypeptide
MEEEIRATNPVATESYGVCVVTLPLERGND

SEQ ID NO: 39128 - protein, 31 aa, Artificial Sequence
  Description of Artificial Sequence: Synthetic polypeptide
DEQEITTTNPCATEQYGVVSCTALCEQGNDR

SEQ ID NO: 39129 - protein, 35 aa, Artificial Sequence
  Description of Artificial Sequence: Synthetic polypeptide
DEEEIRTTNPVATEQYGSVSITPNPLVQIDKGDEP

SEQ ID NO: 39130 - protein, 28 aa, Artificial Sequence
  Description of Artificial Sequence: Synthetic peptide
DENEIAQTNPVATEQYGVVSTDQEVGED

SEQ ID NO: 39131 - protein, 28 aa, Artificial Sequence
  Description of Artificial Sequence: Synthetic peptide
DEEEIRNTNIIGTESYGSVNDNLQIGAT

SEQ ID NO: 39132 - protein, 31 aa, Artificial Sequence
  Description of Artificial Sequence: Synthetic polypeptide
GEEEIATTNPVATEQYGEVAEDLQESEGNDR

SEQ ID NO: 39133 - protein, 28 aa, Artificial Sequence
  Description of Artificial Sequence: Synthetic peptide
DESEVRTVNIVAQEQQGNVRTNLQSTNR

SEQ ID NO: 39134 - protein, 36 aa, Artificial Sequence
  Description of Artificial Sequence: Synthetic polypeptide
DEEEIRTTNPVATEQYGSVSSLTMNGLVEREGENLQ

SEQ ID NO: 39135 - protein, 32 aa, Artificial Sequence
  Description of Artificial Sequence: Synthetic polypeptide
DNEEIRSTNPVATEQYGSVNATNGEQREGDPQ

SEQ ID NO: 39136 - protein, 28 aa, Artificial Sequence
  Description of Artificial Sequence: Synthetic peptide
DEEDIRTTLTYATRQVGIVTTGLQMGNR

SEQ ID NO: 39137 - protein, 32 aa, Artificial Sequence
  Description of Artificial Sequence: Synthetic polypeptide
DEEEIRTTNPVATEQYGSVSEDLQEHDEDEDN

SEQ ID NO: 39138 - protein, 28 aa, Artificial Sequence
  Description of Artificial Sequence: Synthetic peptide
QESEIATTNPVATEGYGVMASTLQHGNI

SEQ ID NO: 39139 - protein, 31 aa, Artificial Sequence
  Description of Artificial Sequence: Synthetic polypeptide
DEAEIRTTNPVCTEQYGSACTNLEDNNGNDA

SEQ ID NO: 39140 - protein, 28 aa, Artificial Sequence
  Description of Artificial Sequence: Synthetic peptide
DESELDTNNIVTTEQYGNVDTNIQEGNR

SEQ ID NO: 39141 - protein, 30 aa, Artificial Sequence
  Description of Artificial Sequence: Synthetic polypeptide
SEEEIAATNPVSTEQFGSVDSTNLQQEGTF

SEQ ID NO: 39142 - protein, 28 aa, Artificial Sequence
  Description of Artificial Sequence: Synthetic peptide
VEDELAATNIVASEVYGCVGTNLQRGNR

SEQ ID NO: 39143 - protein, 30 aa, Artificial Sequence
  Description of Artificial Sequence: Synthetic polypeptide
DDEEIRTTNPIAYEIYGAVGASNLERNGNR

SEQ ID NO: 39144 - protein, 28 aa, Artificial Sequence
  Description of Artificial Sequence: Synthetic peptide
DEQEVASTNIVSTEIYGAVGNNLQRGNR

SEQ ID NO: 39145 - protein, 28 aa, Artificial Sequence
  Description of Artificial Sequence: Synthetic peptide
AENEIAQTNPVATEQYGVVSTDQENGND

SEQ ID NO: 39146 - protein, 33 aa, Artificial Sequence
  Description of Artificial Sequence: Synthetic polypeptide
DEEEIATTNPVATECYGSVSATNLQEHEGEEDL

SEQ ID NO: 39147 - protein, 31 aa, Artificial Sequence
  Description of Artificial Sequence: Synthetic polypeptide
DEQEIATTNPVATECYGSVSATDLQDHEGEL

SEQ ID NO: 39148 - protein, 28 aa, Artificial Sequence
  Description of Artificial Sequence: Synthetic peptide
NEENIRTTNIYANEQYGSISTNSQERTR

SEQ ID NO: 39149 - protein, 30 aa, Artificial Sequence
  Description of Artificial Sequence: Synthetic polypeptide
KEEEIRATNPVATECYGVVSTELQETEGEM

SEQ ID NO: 39150 - protein, 28 aa, Artificial Sequence
  Description of Artificial Sequence: Synthetic peptide
DEEEIRTTNPVSTECWGIVDTNDETGTM

SEQ ID NO: 39151 - protein, 28 aa, Artificial Sequence
  Description of Artificial Sequence: Synthetic peptide
AENEIACTNPVATEMYGEASEVLQRGGR

SEQ ID NO: 39152 - protein, 28 aa, Artificial Sequence
  Description of Artificial Sequence: Synthetic peptide
DEEEIRTTNNVDTEIYQSITDNLLRGTT

SEQ ID NO: 39153 - protein, 28 aa, Artificial Sequence
  Description of Artificial Sequence: Synthetic peptide
DENEIACTNPVATEIYGVVSTELEIGEY

SEQ ID NO: 39154 - protein, 28 aa, Artificial Sequence
  Description of Artificial Sequence: Synthetic peptide
DEEEIKGQNGVATETYGGVVTNAQTVNG

SEQ ID NO: 39155 - protein, 28 aa, Artificial Sequence
  Description of Artificial Sequence: Synthetic peptide
DEEGISTTHIVAMRQYGSMSDNLGGGNQ

SEQ ID NO: 39156 - protein, 28 aa, Artificial Sequence
  Description of Artificial Sequence: Synthetic peptide
DEEEGKTVNIYGTEQFGAVITGLQVGNR

SEQ ID NO: 39157 - protein, 34 aa, Artificial Sequence
  Description of Artificial Sequence: Synthetic polypeptide
DEEEIRTTNPYATEQYGSVCSSTENGLVDGGMGI

SEQ ID NO: 39158 - protein, 28 aa, Artificial Sequence
  Description of Artificial Sequence: Synthetic peptide
DETEVACTNIVASENYGTTATNLQRLNR

SEQ ID NO: 39159 - protein, 33 aa, Artificial Sequence
  Description of Artificial Sequence: Synthetic polypeptide
SEEEIRTTNPVATETFGSVISTCNGPQNGINTV

SEQ ID NO: 39160 - protein, 28 aa, Artificial Sequence
  Description of Artificial Sequence: Synthetic peptide
MENEIAQTNPVATEQYGQASTPQELGND

SEQ ID NO: 39161 - protein, 28 aa, Artificial Sequence
  Description of Artificial Sequence: Synthetic peptide
SEGEIAATNPTATEQFGSVSENPQVGTA

SEQ ID NO: 39162 - protein, 28 aa, Artificial Sequence
  Description of Artificial Sequence: Synthetic peptide
DEQELAATNIVASENYGAVAMNLQRGNT

SEQ ID NO: 39163 - protein, 28 aa, Artificial Sequence
  Description of Artificial Sequence: Synthetic peptide
DAEELRDTNVVATENYGKVSTNLGWKDT

SEQ ID NO: 39164 - protein, 28 aa, Artificial Sequence
  Description of Artificial Sequence: Synthetic peptide
DEEAIGTENNIATEQWTSVDTNWDRGGR

SEQ ID NO: 39165 - protein, 32 aa, Artificial Sequence
  Description of Artificial Sequence: Synthetic polypeptide
QEEEIATTNPVATECYGSVSATDLQDTKGEDP

SEQ ID NO: 39166 - protein, 29 aa, Artificial Sequence
  Description of Artificial Sequence: Synthetic peptide
DEEEISTTNPVATEWWGSVDDADMQGNDS

SEQ ID NO: 39167 - protein, 32 aa, Artificial Sequence
  Description of Artificial Sequence: Synthetic polypeptide
DEQEITTTNPCATEQYGVVSCTADQCEQGNDR

SEQ ID NO: 39168 - protein, 28 aa, Artificial Sequence
  Description of Artificial Sequence: Synthetic peptide
DEEEIETTNIVFNEQGGLVSTNIDSGTG

SEQ ID NO: 39169 - protein, 33 aa, Artificial Sequence
  Description of Artificial Sequence: Synthetic polypeptide
DEEEIRTTNPDATEQYGSVSCENPLDCNEGEDN

SEQ ID NO: 39170 - protein, 32 aa, Artificial Sequence
  Description of Artificial Sequence: Synthetic polypeptide
AEQEIVTTNPVATEQYGEVSTGNLESINGVNQ

SEQ ID NO: 39171 - protein, 28 aa, Artificial Sequence
  Description of Artificial Sequence: Synthetic peptide
DGQEIATNNIIDTEQYSGVSTNLGKGNR

SEQ ID NO: 39172 - protein, 28 aa, Artificial Sequence
  Description of Artificial Sequence: Synthetic peptide
AEEEIETTNAVNISQYGSVSDNILGGSR

SEQ ID NO: 39173 - protein, 28 aa, Artificial Sequence
  Description of Artificial Sequence: Synthetic peptide
DEENINFTNIVANDNVGSQSTNLQRGTT

SEQ ID NO: 39174 - protein, 28 aa, Artificial Sequence
  Description of Artificial Sequence: Synthetic peptide
DEEEIRTTNIDATEQWWSVETIIDDGEM

SEQ ID NO: 39175 - protein, 31 aa, Artificial Sequence
  Description of Artificial Sequence: Synthetic polypeptide
SEEEIRTTNPVSTECWGSVSTNDMLGAGDDI

SEQ ID NO: 39176 - protein, 28 aa, Artificial Sequence
  Description of Artificial Sequence: Synthetic peptide
DEEDIRTTRGVALDIIGSNSDALQRTNR

SEQ ID NO: 39177 - protein, 28 aa, Artificial Sequence
  Description of Artificial Sequence: Synthetic peptide
DEQEIACVNIVSSEHYGVVGTNLQRGGR

SEQ ID NO: 39178 - protein, 28 aa, Artificial Sequence
  Description of Artificial Sequence: Synthetic peptide
DEENIITTNIVATESYGSTHTNLLGITG

SEQ ID NO: 39179 - protein, 32 aa, Artificial Sequence
  Description of Artificial Sequence: Synthetic polypeptide
DEEEIRTTNPVATEQYGDVSECPVQEHAGEDL

SEQ ID NO: 39180 - protein, 28 aa, Artificial Sequence
  Description of Artificial Sequence: Synthetic peptide
DEVEIGTTNPTGTETFGEVSTALQNEGR

SEQ ID NO: 39181 - protein, 28 aa, Artificial Sequence
  Description of Artificial Sequence: Synthetic peptide
TEEELINTNIIATNQWGSVSDNLQSGNE

SEQ ID NO: 39182 - protein, 28 aa, Artificial Sequence
  Description of Artificial Sequence: Synthetic peptide
DEEEILTNNIQATAVLSSWSTNIQRKNR

SEQ ID NO: 39183 - protein, 28 aa, Artificial Sequence
  Description of Artificial Sequence: Synthetic peptide
DEEEVRNTNIVKTEQYGHNSTGLLGGTT

SEQ ID NO: 39184 - protein, 32 aa, Artificial Sequence
  Description of Artificial Sequence: Synthetic polypeptide
DEEEIATTNPVATEQYGDVSCEEEPDQLGDNV

SEQ ID NO: 39185 - protein, 28 aa, Artificial Sequence
  Description of Artificial Sequence: Synthetic peptide
DEEEIRTTNIDATEQYWSWDTGDDDGEI

SEQ ID NO: 39186 - protein, 30 aa, Artificial Sequence
  Description of Artificial Sequence: Synthetic polypeptide
QEQEIATVNPVSTEQYGEASTVLQSRAGGR

SEQ ID NO: 39187 - protein, 33 aa, Artificial Sequence
  Description of Artificial Sequence: Synthetic polypeptide
DEEEIRTTNPVATEQYGSVGITEELEDNDGDEL

SEQ ID NO: 39188 - protein, 28 aa, Artificial Sequence
  Description of Artificial Sequence: Synthetic peptide
DEEEIRGTNIVATDQVGSVIDYLGQNNG

SEQ ID NO: 39189 - protein, 30 aa, Artificial Sequence
  Description of Artificial Sequence: Synthetic polypeptide
DEDEIATTNPVSSEIYGCVSASNLEFPGNR

SEQ ID NO: 39190 - protein, 28 aa, Artificial Sequence
  Description of Artificial Sequence: Synthetic peptide
DEEETAYTNIVTTEGYGSVSTQIGFGNE

SEQ ID NO: 39191 - protein, 33 aa, Artificial Sequence
  Description of Artificial Sequence: Synthetic polypeptide
DEEEIRTTNPVATEQYGDVSCECCLQCHAGEDL

SEQ ID NO: 39192 - protein, 28 aa, Artificial Sequence
  Description of Artificial Sequence: Synthetic peptide
DGEEIRTTLITNTEQYNSVHNNLSRGAN

SEQ ID NO: 39193 - protein, 28 aa, Artificial Sequence
  Description of Artificial Sequence: Synthetic peptide
DDEEARTTNRIKTEGYGSLSDNLQNGGD

SEQ ID NO: 39194 - protein, 33 aa, Artificial Sequence
  Description of Artificial Sequence: Synthetic polypeptide
DENEIRTTNPVASEIYGSVSTENQVQLNNGDNT

SEQ ID NO: 39195 - protein, 28 aa, Artificial Sequence
  Description of Artificial Sequence: Synthetic peptide
NEQDTATTNIGDTEHYGSVSDNLQSGNR

SEQ ID NO: 39196 - protein, 33 aa, Artificial Sequence
  Description of Artificial Sequence: Synthetic polypeptide
DEDEIRATNPVCTEQYGEVISATMNGLQQEGNI

SEQ ID NO: 39197 - protein, 34 aa, Artificial Sequence
  Description of Artificial Sequence: Synthetic polypeptide
DEEEIATTNPVATEQYGSVSATTGLELVEGDNDD

SEQ ID NO: 39198 - protein, 28 aa, Artificial Sequence
  Description of Artificial Sequence: Synthetic peptide
DWGEIDTNNIVATKQGDSVRTNLGRGND

SEQ ID NO: 39199 - protein, 28 aa, Artificial Sequence
  Description of Artificial Sequence: Synthetic peptide
DEEEIRTGNIVDTKQYSSLSRQLQSANG

SEQ ID NO: 39200 - protein, 32 aa, Artificial Sequence
  Description of Artificial Sequence: Synthetic polypeptide
DEQEIRTTNPEATEQYGSVDTLNPEQEKGEEN

SEQ ID NO: 39201 - protein, 28 aa, Artificial Sequence
  Description of Artificial Sequence: Synthetic peptide
DESEVRSTNIVSSENYGVVGSNLQRGTR

SEQ ID NO: 39202 - protein, 28 aa, Artificial Sequence
  Description of Artificial Sequence: Synthetic peptide
DEVEIACTNPVCTECYGTASTDWQHGNG

SEQ ID NO: 39203 - protein, 35 aa, Artificial Sequence
  Description of Artificial Sequence: Synthetic polypeptide
DEEEIRTTNPVATEQYGSVDCTMNGLCCPEGDNDG

SEQ ID NO: 39204 - protein, 33 aa, Artificial Sequence
  Description of Artificial Sequence: Synthetic polypeptide
DEQEIRTTNPVATEQYGSVSTLDPDPQDHGEDV

SEQ ID NO: 39205 - protein, 28 aa, Artificial Sequence
  Description of Artificial Sequence: Synthetic peptide
DEANINTTNNMAQESQGSTSTNLQRNYR

SEQ ID NO: 39206 - protein, 32 aa, Artificial Sequence
  Description of Artificial Sequence: Synthetic polypeptide
DEQEIATTNPVATEQYGSVSATDLEDHEGEDL

SEQ ID NO: 39207 - protein, 28 aa, Artificial Sequence
  Description of Artificial Sequence: Synthetic peptide
DEEEVRTTNIVATNEWGQVNINLQNTNT

SEQ ID NO: 39208 - protein, 31 aa, Artificial Sequence
  Description of Artificial Sequence: Synthetic polypeptide
DEVEIRTTNPVATEQYGIVNDCCLQAEGYQW

SEQ ID NO: 39209 - protein, 32 aa, Artificial Sequence
  Description of Artificial Sequence: Synthetic polypeptide
DEEEIRTTNPVATEQYGSVSCDIPEQNNEEPS

SEQ ID NO: 39210 - protein, 28 aa, Artificial Sequence
  Description of Artificial Sequence: Synthetic peptide
NEEEIRTTNIVSTEGLGCLATQIQRGND

SEQ ID NO: 39211 - protein, 32 aa, Artificial Sequence
  Description of Artificial Sequence: Synthetic polypeptide
DENEIATTNPVATECYGSVSATDLQDQNGEDL

SEQ ID NO: 39212 - protein, 28 aa, Artificial Sequence
  Description of Artificial Sequence: Synthetic peptide
AEEEIATTNIMFNSQYGLVSTNIQAGNH

SEQ ID NO: 39213 - protein, 34 aa, Artificial Sequence
  Description of Artificial Sequence: Synthetic polypeptide
DEEEIRTTNPVATEQYGSVSTIDPEQDTDGDDPE

SEQ ID NO: 39214 - protein, 28 aa, Artificial Sequence
  Description of Artificial Sequence: Synthetic peptide
DEEQINTTNSVATENLGSVSSQVQNGST

SEQ ID NO: 39215 - protein, 28 aa, Artificial Sequence
  Description of Artificial Sequence: Synthetic peptide
DTEEIRTTNIVANETWGSTNTNLQSKQT

SEQ ID NO: 39216 - protein, 28 aa, Artificial Sequence
  Description of Artificial Sequence: Synthetic peptide
DEEEIRSTNQVATEDWGSLRTLNQYANT

SEQ ID NO: 39217 - protein, 28 aa, Artificial Sequence
  Description of Artificial Sequence: Synthetic peptide
DEEEIRPTNPDATENYGSVAMCEDPGDG

SEQ ID NO: 39218 - protein, 34 aa, Artificial Sequence
  Description of Artificial Sequence: Synthetic polypeptide
DEEEIATTNPVATEQYGDVSATTDGQQLRNGEND

SEQ ID NO: 39219 - protein, 31 aa, Artificial Sequence
  Description of Artificial Sequence: Synthetic polypeptide
DEVEIAATNPTATEQFGGVSTNPQLREGTTR

SEQ ID NO: 39220 - protein, 30 aa, Artificial Sequence
  Description of Artificial Sequence: Synthetic polypeptide
QENEIVTTNPVASECYGSVSTELQVTGEEQ

SEQ ID NO: 39221 - protein, 28 aa, Artificial Sequence
  Description of Artificial Sequence: Synthetic peptide
DEEGVRFNNDVAQEQYGSTSTCYQQGNE

SEQ ID NO: 39222 - protein, 28 aa, Artificial Sequence
  Description of Artificial Sequence: Synthetic peptide
DEETIITNVIVATEQLGTTSTNDQRINT

SEQ ID NO: 39223 - protein, 28 aa, Artificial Sequence
  Description of Artificial Sequence: Synthetic peptide
DEEEIQTTNIVANEDLDELSTNLQRAAT

SEQ ID NO: 39224 - protein, 28 aa, Artificial Sequence
  Description of Artificial Sequence: Synthetic peptide
QENEIATTNPVATECYGDVSECLQHEEN

SEQ ID NO: 39225 - protein, 28 aa, Artificial Sequence
  Description of Artificial Sequence: Synthetic peptide
DEEEVAAVNIVSTEGYGWVGNNLQRGNT

SEQ ID NO: 39226 - protein, 34 aa, Artificial Sequence
  Description of Artificial Sequence: Synthetic polypeptide
DEEEIRTTNPCATEQYGSVSTGEGDQEQQDGNDC

SEQ ID NO: 39227 - protein, 28 aa, Artificial Sequence
  Description of Artificial Sequence: Synthetic peptide
SEEEITTTNIGATDIYGRLSTNLQSGAG

SEQ ID NO: 39228 - protein, 32 aa, Artificial Sequence
  Description of Artificial Sequence: Synthetic polypeptide
DEQEIATTNPVATECYGSVSATDLQEHEGEDL

SEQ ID NO: 39229 - protein, 28 aa, Artificial Sequence
  Description of Artificial Sequence: Synthetic peptide
SEEEISSTNPDATEQYGFASTGQQHGME

SEQ ID NO: 39230 - protein, 28 aa, Artificial Sequence
  Description of Artificial Sequence: Synthetic peptide
DEEEVITTNIFAADNQLSVSTNLQRLNN

SEQ ID NO: 39231 - protein, 28 aa, Artificial Sequence
  Description of Artificial Sequence: Synthetic peptide
DEETINTTNIFSTEVYGSTSTSEQRLNS

SEQ ID NO: 39232 - protein, 28 aa, Artificial Sequence
  Description of Artificial Sequence: Synthetic peptide
SEENIRNTNIVTTDQTGSRSTDLQGSNR

SEQ ID NO: 39233 - protein, 28 aa, Artificial Sequence
  Description of Artificial Sequence: Synthetic peptide
DEEEIKSTNIVAREQEGSVSTLNQNKGT

SEQ ID NO: 39234 - protein, 28 aa, Artificial Sequence
  Description of Artificial Sequence: Synthetic peptide
DEEEIRTTNIDATEQYWSWETIDEIGEI

SEQ ID NO: 39235 - protein, 28 aa, Artificial Sequence
  Description of Artificial Sequence: Synthetic peptide
DEEEISTNNIVTCEQYLNTTTNLLLGNR

SEQ ID NO: 39236 - protein, 28 aa, Artificial Sequence
  Description of Artificial Sequence: Synthetic peptide
SEEEQETTLISATSQYGTVSTNVQRKNN

SEQ ID NO: 39237 - protein, 28 aa, Artificial Sequence
  Description of Artificial Sequence: Synthetic peptide
DNEELITTLIVAEEQITSVNDNLQNGNR

SEQ ID NO: 39238 - protein, 28 aa, Artificial Sequence
  Description of Artificial Sequence: Synthetic peptide
GDSEIRTTNPCAYEFYGVVASNLERLNR

SEQ ID NO: 39239 - protein, 33 aa, Artificial Sequence
  Description of Artificial Sequence: Synthetic polypeptide
QEEEIATTNPVATECYGVVSETNLQETNGENDP

SEQ ID NO: 39240 - protein, 31 aa, Artificial Sequence
  Description of Artificial Sequence: Synthetic polypeptide
DEEEIVTTNPVSTELYGVVSCENEQQEGNDL

SEQ ID NO: 39241 - protein, 28 aa, Artificial Sequence
  Description of Artificial Sequence: Synthetic peptide
DEEEIITTNIVACERLGRSRANLQTGNT

SEQ ID NO: 39242 - protein, 28 aa, Artificial Sequence
  Description of Artificial Sequence: Synthetic peptide
DLEDIITGNIVGTKQYGSTATNLQRGST

SEQ ID NO: 39243 - protein, 35 aa, Artificial Sequence
  Description of Artificial Sequence: Synthetic polypeptide
DEEEIRTTNPVATEQYGSVSITCDDVQDIKGDNDF

SEQ ID NO: 39244 - protein, 31 aa, Artificial Sequence
  Description of Artificial Sequence: Synthetic polypeptide
MENEIATTNPVATEMYGVVSENLQDTEGNDM

SEQ ID NO: 39245 - protein, 28 aa, Artificial Sequence
  Description of Artificial Sequence: Synthetic peptide
DEQEVATVNGVASKIYGSVATNLERGTR

SEQ ID NO: 39246 - protein, 28 aa, Artificial Sequence
  Description of Artificial Sequence: Synthetic peptide
DEEEIAITNIVAREQYGKTVTNLQNTTT

SEQ ID NO: 39247 - protein, 28 aa, Artificial Sequence
  Description of Artificial Sequence: Synthetic peptide
DEEEGITTNIGAWRQYGHVATNIQRSDR

SEQ ID NO: 39248 - protein, 28 aa, Artificial Sequence
  Description of Artificial Sequence: Synthetic peptide
DEQEIRTTNGVATEQAGTTATNSQSATT

SEQ ID NO: 39249 - protein, 28 aa, Artificial Sequence
  Description of Artificial Sequence: Synthetic peptide
DEEEVRTTNGVGTKQYGLVAQNLQNSSA

SEQ ID NO: 39250 - protein, 28 aa, Artificial Sequence
  Description of Artificial Sequence: Synthetic peptide
DEEEIRTTNIVATEQLGLTVDNEQSSSN

SEQ ID NO: 39251 - protein, 29 aa, Artificial Sequence
  Description of Artificial Sequence: Synthetic peptide
DDQEIRTTNPCATEVYGCVASNLEREPND

SEQ ID NO: 39252 - protein, 32 aa, Artificial Sequence
  Description of Artificial Sequence: Synthetic polypeptide
AEEEITTTNPVATEQYGSVSTELEEPKGDEAI

SEQ ID NO: 39253 - protein, 28 aa, Artificial Sequence
  Description of Artificial Sequence: Synthetic peptide
DEENIITTNIVAAGQEGLVKNNLQYGNS

SEQ ID NO: 39254 - protein, 33 aa, Artificial Sequence
  Description of Artificial Sequence: Synthetic polypeptide
DEEEIRTTNPVATEQYGDVSCEMNLCCHAENDA

SEQ ID NO: 39255 - protein, 33 aa, Artificial Sequence
  Description of Artificial Sequence: Synthetic polypeptide
DEEEIRTTNPDATEQYGSVSCENPLTDEIDGES

SEQ ID NO: 39256 - protein, 29 aa, Artificial Sequence
  Description of Artificial Sequence: Synthetic peptide
DEQEIRTTNPVATECWGSVDENDMIQGTL

SEQ ID NO: 39257 - protein, 33 aa, Artificial Sequence
  Description of Artificial Sequence: Synthetic polypeptide
DEEEISCTNPDATEQYGWVASTTNLQQDDGIND

SEQ ID NO: 39258 - protein, 28 aa, Artificial Sequence
  Description of Artificial Sequence: Synthetic peptide
DEESYRTTNIVTTEQVTSVADNCQTGAR

SEQ ID NO: 39259 - protein, 34 aa, Artificial Sequence
  Description of Artificial Sequence: Synthetic polypeptide
DEEEIRTTNPVATEQYGSVETLNPDQDEKGDEPW

SEQ ID NO: 39260 - protein, 32 aa, Artificial Sequence
  Description of Artificial Sequence: Synthetic polypeptide
KEEEIRTTNPVATECYGHVSTGQNQDRKENEL

SEQ ID NO: 39261 - protein, 28 aa, Artificial Sequence
  Description of Artificial Sequence: Synthetic peptide
DGEAFRTNNTVETENYGSVSTQVQSGTR

SEQ ID NO: 39262 - protein, 28 aa, Artificial Sequence
  Description of Artificial Sequence: Synthetic peptide
DEEQIVTTNNAATVVYGSVTDNLYRGVG

SEQ ID NO: 39263 - protein, 34 aa, Artificial Sequence
  Description of Artificial Sequence: Synthetic polypeptide
DENEIAQTNPVATEQYGSVSVTGGLVEDRGDNDR

SEQ ID NO: 39264 - protein, 28 aa, Artificial Sequence
  Description of Artificial Sequence: Synthetic peptide
DTEEIRDTNIVTFETYGSTSTNLYSANG

SEQ ID NO: 39265 - protein, 28 aa, Artificial Sequence
  Description of Artificial Sequence: Synthetic peptide
DEEEINTTNIVGWEEYGLVATNLQQTTT

SEQ ID NO: 39266 - protein, 36 aa, Artificial Sequence
  Description of Artificial Sequence: Synthetic polypeptide
DEEEIRTTNPVATEQYGSVTDLTAPGLLPRLGTNLR

SEQ ID NO: 39267 - protein, 28 aa, Artificial Sequence
  Description of Artificial Sequence: Synthetic peptide
QEEEICCTNPESTEQYGCVSVNDQLGPH

SEQ ID NO: 39268 - protein, 31 aa, Artificial Sequence
  Description of Artificial Sequence: Synthetic polypeptide
SEEEIRTTNPVATECYGSMATELQDYEGEDD

SEQ ID NO: 39269 - protein, 28 aa, Artificial Sequence
  Description of Artificial Sequence: Synthetic peptide
EEDDIRTVNIVATEEYGSTATNLQNSNT

SEQ ID NO: 39270 - protein, 28 aa, Artificial Sequence
  Description of Artificial Sequence: Synthetic peptide
DENGIINTNWVAQEYQGSVSTNLQAGGN

SEQ ID NO: 39271 - protein, 28 aa, Artificial Sequence
  Description of Artificial Sequence: Synthetic peptide
DEETIRTTDIVTTENYGSTHTNMQNGAT

SEQ ID NO: 39272 - protein, 28 aa, Artificial Sequence
  Description of Artificial Sequence: Synthetic peptide
DTEEVNTNNGIGLEQYGSVSDNLQRGGL

SEQ ID NO: 39273 - protein, 28 aa, Artificial Sequence
  Description of Artificial Sequence: Synthetic peptide
TDEEIRNVNNVATEIYGSVSDNIQQTGR

SEQ ID NO: 39274 - protein, 28 aa, Artificial Sequence
  Description of Artificial Sequence: Synthetic peptide
AEEEIAQTNPDATEQYGDVSTGDEHGEQ

SEQ ID NO: 39275 - protein, 28 aa, Artificial Sequence
  Description of Artificial Sequence: Synthetic peptide
DEEEIDINNIITTEQYGNTSTNMLRSNR

SEQ ID NO: 39276 - protein, 28 aa, Artificial Sequence
  Description of Artificial Sequence: Synthetic peptide
DEANIITTNGVIEEQLGMLDTNLQRGNT

SEQ ID NO: 39277 - protein, 28 aa, Artificial Sequence
  Description of Artificial Sequence: Synthetic peptide
DEESIASVNPVCTETYGSVVTNFQSGSQ

SEQ ID NO: 39278 - protein, 28 aa, Artificial Sequence
  Description of Artificial Sequence: Synthetic peptide
DEEEGRNTNGVITEQYGGVSTRILWGTT

SEQ ID NO: 39279 - protein, 28 aa, Artificial Sequence
  Description of Artificial Sequence: Synthetic peptide
DEEETATTEIITTEQYGTWATNLQRANN

SEQ ID NO: 39280 - protein, 28 aa, Artificial Sequence
  Description of Artificial Sequence: Synthetic peptide
HEEEIRTTNITGTEQWGSTSTNDQQKTG

SEQ ID NO: 39281 - protein, 28 aa, Artificial Sequence
  Description of Artificial Sequence: Synthetic peptide
DEAEAIETNIVATEQVGSVASQWQRGNT

SEQ ID NO: 39282 - protein, 28 aa, Artificial Sequence
  Description of Artificial Sequence: Synthetic peptide
DEEETAATNIVSTEVYGVTATNLQRLGR

SEQ ID NO: 39283 - protein, 28 aa, Artificial Sequence
  Description of Artificial Sequence: Synthetic peptide
AEGEIWQTNPVATESYGNISTNPQGGDQ

SEQ ID NO: 39284 - protein, 28 aa, Artificial Sequence
  Description of Artificial Sequence: Synthetic peptide
SEFEIYTTNPVATESFGSVSVDWQHGDS

SEQ ID NO: 39285 - protein, 28 aa, Artificial Sequence
  Description of Artificial Sequence: Synthetic peptide
DEEETNTTNPIDTLQWGTVSDNVQGGNT

SEQ ID NO: 39286 - protein, 31 aa, Artificial Sequence
  Description of Artificial Sequence: Synthetic polypeptide
KEEEICTTNPVATEQYGDVSCEADQCLKGNE

SEQ ID NO: 39287 - protein, 28 aa, Artificial Sequence
  Description of Artificial Sequence: Synthetic peptide
DEQEVASTNIVASENYGVVGTNLERGTR

SEQ ID NO: 39288 - protein, 28 aa, Artificial Sequence
  Description of Artificial Sequence: Synthetic peptide
DEETIRTNNNVATLHYLMVSTNLLDGGG

SEQ ID NO: 39289 - protein, 28 aa, Artificial Sequence
  Description of Artificial Sequence: Synthetic peptide
DEEEVTQTNAVTTEQYQSVSQNLIRTAT

SEQ ID NO: 39290 - protein, 29 aa, Artificial Sequence
  Description of Artificial Sequence: Synthetic peptide
NEEEIRCTNPIATEWFGCVGMNLQFRGTD

SEQ ID NO: 39291 - protein, 28 aa, Artificial Sequence
  Description of Artificial Sequence: Synthetic peptide
DEEEIRINNINATDQIGGVSTNLQQTAI

SEQ ID NO: 39292 - protein, 28 aa, Artificial Sequence
  Description of Artificial Sequence: Synthetic peptide
DEEEIETTNIVATEQGGEITSIIQGGNT

SEQ ID NO: 39293 - protein, 32 aa, Artificial Sequence
  Description of Artificial Sequence: Synthetic polypeptide
DEHEIRTTNPVATEQYGSVDCEMDLCCHGNDA

SEQ ID NO: 39294 - protein, 28 aa, Artificial Sequence
  Description of Artificial Sequence: Synthetic peptide
DAEEIATVNKVGTDQYGSVATNIQRLTN

SEQ ID NO: 39295 - protein, 34 aa, Artificial Sequence
  Description of Artificial Sequence: Synthetic polypeptide
DEEEIRTTNPDATEQYGSVSTDNGDVEGDGEEDR

SEQ ID NO: 39296 - protein, 35 aa, Artificial Sequence
  Description of Artificial Sequence: Synthetic polypeptide
DEEEIRTTNPVATEQYGESYVTDETNDTEIRGENP

SEQ ID NO: 39297 - protein, 28 aa, Artificial Sequence
  Description of Artificial Sequence: Synthetic peptide
DEEEIKTTNGGHTDDYGNVNDNLQGGNE

SEQ ID NO: 39298 - protein, 32 aa, Artificial Sequence
  Description of Artificial Sequence: Synthetic polypeptide
DEEEICTTNPVATEQFGDVSEANLQLHGAPDI

SEQ ID NO: 39299 - protein, 34 aa, Artificial Sequence
  Description of Artificial Sequence: Synthetic polypeptide
DEEEIRTTNPVATEQYGSVSTEDNGPEYYKEENE

SEQ ID NO: 39300 - protein, 28 aa, Artificial Sequence
  Description of Artificial Sequence: Synthetic peptide
DEENINITNIVAREQYGSGMNNLQAQNT

SEQ ID NO: 39301 - protein, 36 aa, Artificial Sequence
  Description of Artificial Sequence: Synthetic polypeptide
DEEEIRTTNPVATEQYGSVSTTDNGDVEIREGENDD

SEQ ID NO: 39302 - protein, 33 aa, Artificial Sequence
  Description of Artificial Sequence: Synthetic polypeptide
DEEEIRTTNPCATEQYGSVFITMALEPVAGNDS

SEQ ID NO: 39303 - protein, 28 aa, Artificial Sequence
  Description of Artificial Sequence: Synthetic peptide
DDEEIRNTNIVDTEHVSLVSTQLLRGNE

SEQ ID NO: 39304 - protein, 28 aa, Artificial Sequence
  Description of Artificial Sequence: Synthetic peptide
DEVEISTTNPEASENYGHVSTGQLVGNE

SEQ ID NO: 39305 - protein, 28 aa, Artificial Sequence
  Description of Artificial Sequence: Synthetic peptide
DEEEVRITNIVAWDQYGTTADNLQNTNR

SEQ ID NO: 39306 - protein, 28 aa, Artificial Sequence
  Description of Artificial Sequence: Synthetic peptide
DEEEIKGTNIEATEHYGLVSTNTQVASF

SEQ ID NO: 39307 - protein, 28 aa, Artificial Sequence
  Description of Artificial Sequence: Synthetic peptide
DEQEVATTNPIAYMMYGSVSTAYERGPR

SEQ ID NO: 39308 - protein, 28 aa, Artificial Sequence
  Description of Artificial Sequence: Synthetic peptide
DDEEIANTNIVATENYGGTSSNLENGNQ

SEQ ID NO: 39309 - protein, 28 aa, Artificial Sequence
  Description of Artificial Sequence: Synthetic peptide
DEETIRSTNQTQTEEAGSTRTNLQGGNT

SEQ ID NO: 39310 - protein, 37 aa, Artificial Sequence
  Description of Artificial Sequence: Synthetic polypeptide
DEEEIRTTNPDATEQYGSVASCTIGNLVIEREGVNDR

SEQ ID NO: 39311 - protein, 28 aa, Artificial Sequence
  Description of Artificial Sequence: Synthetic peptide
DEEEIAATNIYGTEIYGNVATNIQRTTR

SEQ ID NO: 39312 - protein, 28 aa, Artificial Sequence
  Description of Artificial Sequence: Synthetic peptide
SDEEIATTNPTATEMYGAVNTGLMVGNS

SEQ ID NO: 39313 - protein, 28 aa, Artificial Sequence
  Description of Artificial Sequence: Synthetic peptide
SEEEIRCTNPIATEIFGVVSTDVQSGLL

SEQ ID NO: 39314 - protein, 28 aa, Artificial Sequence
  Description of Artificial Sequence: Synthetic peptide
DEEEVNCTNIVSTEIFGVVATNLQRLNN

SEQ ID NO: 39315 - protein, 34 aa, Artificial Sequence
  Description of Artificial Sequence: Synthetic polypeptide
DEEEIATTNPVATEQYGSVSATTDQELDNGENDD

SEQ ID NO: 39316 - protein, 33 aa, Artificial Sequence
  Description of Artificial Sequence: Synthetic polypeptide
DEEEIRTTNPVATEQYGDASTTCLQQSVAGTEY

SEQ ID NO: 39317 - protein, 31 aa, Artificial Sequence
  Description of Artificial Sequence: Synthetic polypeptide
DEQEIVTTNPVATEMYGSVSGEELTHGDNDN

SEQ ID NO: 39318 - protein, 28 aa, Artificial Sequence
  Description of Artificial Sequence: Synthetic peptide
QEEEICTTNPESTEQYGCVSVADQLGPH

SEQ ID NO: 39319 - protein, 28 aa, Artificial Sequence
  Description of Artificial Sequence: Synthetic peptide
DEEEISLTNNTAVENLGSVKTNLQGGST

SEQ ID NO: 39320 - protein, 28 aa, Artificial Sequence
  Description of Artificial Sequence: Synthetic peptide
DEWEISTTNGVKTEQQGLVTTETQRSGR

SEQ ID NO: 39321 - protein, 28 aa, Artificial Sequence
  Description of Artificial Sequence: Synthetic peptide
DEEETRTTNVVATEETGVTATNLQNSST

SEQ ID NO: 39322 - protein, 33 aa, Artificial Sequence
  Description of Artificial Sequence: Synthetic polypeptide
SEEEIRATNPVATEQYGSVSEMNPQLIEGDNDF

SEQ ID NO: 39323 - protein, 32 aa, Artificial Sequence
  Description of Artificial Sequence: Synthetic polypeptide
DEEEIATTNPVATECYGSVSATDLEEHNGEDD

SEQ ID NO: 39324 - protein, 28 aa, Artificial Sequence
  Description of Artificial Sequence: Synthetic peptide
DEEEIRCTNPVCTENYGNVATPDEEGTL

SEQ ID NO: 39325 - protein, 31 aa, Artificial Sequence
  Description of Artificial Sequence: Synthetic polypeptide
GENEIATTNPVATENYGSVSTDLQENEGDDF

SEQ ID NO: 39326 - protein, 30 aa, Artificial Sequence
  Description of Artificial Sequence: Synthetic polypeptide
DEEEIRTTNPVAYEQYGSYSEHDMIGDLDS

SEQ ID NO: 39327 - protein, 28 aa, Artificial Sequence
  Description of Artificial Sequence: Synthetic peptide
DEEGTNTTNIVAWEQYGNTSTSLDSSNR

SEQ ID NO: 39328 - protein, 36 aa, Artificial Sequence
  Description of Artificial Sequence: Synthetic polypeptide
DEEEIRTTNPVATEQYGSVSSLTMEGLVEREGENLQ

SEQ ID NO: 39329 - protein, 32 aa, Artificial Sequence
  Description of Artificial Sequence: Synthetic polypeptide
DENEIATTNPVATECYGSVSDTDLEIHNGENQ

SEQ ID NO: 39330 - protein, 28 aa, Artificial Sequence
  Description of Artificial Sequence: Synthetic peptide
DGIEGFTTNIVATDQYGFVSDNLQGGAG

SEQ ID NO: 39331 - protein, 28 aa, Artificial Sequence
  Description of Artificial Sequence: Synthetic peptide
DEEEIRGTSIVAIEQYGTYSANVAQGNT

SEQ ID NO: 39332 - protein, 28 aa, Artificial Sequence
  Description of Artificial Sequence: Synthetic peptide
VEEEIATTNIGATEVLGQVSSQLQRNNS

SEQ ID NO: 39333 - protein, 28 aa, Artificial Sequence
  Description of Artificial Sequence: Synthetic peptide
SEVEIAATNPTATEMFGGVSTNLQQGTF

SEQ ID NO: 39334 - protein, 28 aa, Artificial Sequence
  Description of Artificial Sequence: Synthetic peptide
DEEEINTNNIVDQEQYGTVSTRMQRQCS

SEQ ID NO: 39335 - protein, 28 aa, Artificial Sequence
  Description of Artificial Sequence: Synthetic peptide
DEEEIRTQNIVGIDQYGLVSDNILSGTR

SEQ ID NO: 39336 - protein, 28 aa, Artificial Sequence
  Description of Artificial Sequence: Synthetic peptide
DENEIRGTNIVTTEKYDSVKDNIQNGGR

SEQ ID NO: 39337 - protein, 34 aa, Artificial Sequence
  Description of Artificial Sequence: Synthetic polypeptide
DEEEIRTTNPVATEQYGSVDCTMAWQDDEGENDI

SEQ ID NO: 39338 - protein, 36 aa, Artificial Sequence
  Description of Artificial Sequence: Synthetic polypeptide
DEEEIRTTNPVATEQYGSVCSETCPLVLDRKGTNDV

SEQ ID NO: 39339 - protein, 28 aa, Artificial Sequence
  Description of Artificial Sequence: Synthetic peptide
SEEEIYTTNIYTVDQYGATSTQLQNGNR

SEQ ID NO: 39340 - protein, 28 aa, Artificial Sequence
  Description of Artificial Sequence: Synthetic peptide
DEEGINTTNIIAQEIAGSVSDYLQQTNR

SEQ ID NO: 39341 - protein, 28 aa, Artificial Sequence
  Description of Artificial Sequence: Synthetic peptide
DEDEIRTTNGGNTVQGGTVSTDLQSGAG

SEQ ID NO: 39342 - protein, 31 aa, Artificial Sequence
  Description of Artificial Sequence: Synthetic polypeptide
DEVEIATTNPTATEIFGSVSTNEPQLEGDNQ

SEQ ID NO: 39343 - protein, 28 aa, Artificial Sequence
  Description of Artificial Sequence: Synthetic peptide
DWQEGTATNIVGTENYGAVSNNLQRGNA

SEQ ID NO: 39344 - protein, 33 aa, Artificial Sequence
  Description of Artificial Sequence: Synthetic polypeptide
SEEEIRTTNPTATEQFGSVSTANLQLIEGETDI

SEQ ID NO: 39345 - protein, 32 aa, Artificial Sequence
  Description of Artificial Sequence: Synthetic polypeptide
DEHEIRTTNPVATEQYGDVSCEMELCDHGNDS

SEQ ID NO: 39346 - protein, 28 aa, Artificial Sequence
  Description of Artificial Sequence: Synthetic peptide
YDHELATTNPVSTESYGCVCTNWQRENR

SEQ ID NO: 39347 - protein, 28 aa, Artificial Sequence
  Description of Artificial Sequence: Synthetic peptide
DEWEIEYTNSVARRQYGSVEANLQGANT

SEQ ID NO: 39348 - protein, 28 aa, Artificial Sequence
  Description of Artificial Sequence: Synthetic peptide
NEEETRTTLGVATSVYGSVSDHAQFGNN

SEQ ID NO: 39349 - protein, 28 aa, Artificial Sequence
  Description of Artificial Sequence: Synthetic peptide
DEEEIASTNIVATAYYGSREDFLQNKNR

SEQ ID NO: 39350 - protein, 28 aa, Artificial Sequence
  Description of Artificial Sequence: Synthetic peptide
YEHEVATTNPVSTEGYGAVSTDLEAGNV

SEQ ID NO: 39351 - protein, 31 aa, Artificial Sequence
  Description of Artificial Sequence: Synthetic polypeptide
DDEEIRTTNPIAYEIYGAVGASNLERNGNDR

SEQ ID NO: 39352 - protein, 31 aa, Artificial Sequence
  Description of Artificial Sequence: Synthetic polypeptide
DENEINSTNPVATEQYGSVSTELEDMNGEEA

SEQ ID NO: 39353 - protein, 32 aa, Artificial Sequence
  Description of Artificial Sequence: Synthetic polypeptide
DEQEIATTNPVATECYGSVSATDLQDHEGEDL

SEQ ID NO: 39354 - protein, 28 aa, Artificial Sequence
  Description of Artificial Sequence: Synthetic peptide
DIEETNNTNGVATEQWGSVTTMLDNGNS

SEQ ID NO: 39355 - protein, 34 aa, Artificial Sequence
  Description of Artificial Sequence: Synthetic polypeptide
KEEEIRTTNPVATEIYGSVSCTGNWQYVDGENDC

SEQ ID NO: 39356 - protein, 28 aa, Artificial Sequence
  Description of Artificial Sequence: Synthetic peptide
DESEIRNTLIVATDQYGSWSDNAYGGAR

SEQ ID NO: 39357 - protein, 32 aa, Artificial Sequence
  Description of Artificial Sequence: Synthetic polypeptide
DEEEIRTTNPTATEQYGEVSEGNPQDSGDTDI

SEQ ID NO: 39358 - protein, 28 aa, Artificial Sequence
  Description of Artificial Sequence: Synthetic peptide
DEENINTTNIAATDNVGSVMTRLGRGNT

SEQ ID NO: 39359 - protein, 28 aa, Artificial Sequence
  Description of Artificial Sequence: Synthetic peptide
DEQELAATNIVSSEVYGWVATNLERGNR

SEQ ID NO: 39360 - protein, 31 aa, Artificial Sequence
  Description of Artificial Sequence: Synthetic polypeptide
QENEIVATNPVATECYGVVSTNLEMREGEND

SEQ ID NO: 39361 - protein, 34 aa, Artificial Sequence
  Description of Artificial Sequence: Synthetic polypeptide
DEEEIATTNPVATEQYGSVSETEDQELNNGDNDT

SEQ ID NO: 39362 - protein, 34 aa, Artificial Sequence
  Description of Artificial Sequence: Synthetic polypeptide
DEEEIAQTNPVATEQYGSVSTTPQVELREGENDT

SEQ ID NO: 39363 - protein, 28 aa, Artificial Sequence
  Description of Artificial Sequence: Synthetic peptide
DGSEIRTTNIVANEVYGGTSDNLQIGGG

SEQ ID NO: 39364 - protein, 28 aa, Artificial Sequence
  Description of Artificial Sequence: Synthetic peptide
SDEGTATTNIVNTEQQGSVSTNVQGKNR

SEQ ID NO: 39365 - protein, 28 aa, Artificial Sequence
  Description of Artificial Sequence: Synthetic peptide
SEEEINTENRVDTRQYGSTSNQLQGGNG

SEQ ID NO: 39366 - protein, 32 aa, Artificial Sequence
  Description of Artificial Sequence: Synthetic polypeptide
DEEEIAATNPFATEQYGQVSIELNPQDRKGNS

SEQ ID NO: 39367 - protein, 34 aa, Artificial Sequence
  Description of Artificial Sequence: Synthetic polypeptide
DEEEIRTTNPFATEQYGSVSITPGPLVDLPGDND

SEQ ID NO: 39368 - protein, 34 aa, Artificial Sequence
  Description of Artificial Sequence: Synthetic polypeptide
DEEEIRTTNPVATEQYGSVSTLEPDQEHDGDEDW

SEQ ID NO: 39369 - protein, 28 aa, Artificial Sequence
  Description of Artificial Sequence: Synthetic peptide
DEEEIRSTNIVGTLQYGSVSNFMTGGSQ

SEQ ID NO: 39370 - protein, 28 aa, Artificial Sequence
  Description of Artificial Sequence: Synthetic peptide
DEEEISTTNIVDTEQYGITEVNEQNTNS

SEQ ID NO: 39371 - protein, 28 aa, Artificial Sequence
  Description of Artificial Sequence: Synthetic peptide
DEEEINTTNGYATAGQGSTSTRIQAGNQ

SEQ ID NO: 39372 - protein, 34 aa, Artificial Sequence
  Description of Artificial Sequence: Synthetic polypeptide
DEEEIRTTNPDATEQYGSVSDTPPGLDIDNGDNP

SEQ ID NO: 39373 - protein, 28 aa, Artificial Sequence
  Description of Artificial Sequence: Synthetic peptide
DEENIKTNNITATDMVNSISTNSQRGNR

SEQ ID NO: 39374 - protein, 28 aa, Artificial Sequence
  Description of Artificial Sequence: Synthetic peptide
DEGEGRTNNIVSTEQYGSMSTNKRGGTT

SEQ ID NO: 39375 - protein, 28 aa, Artificial Sequence
  Description of Artificial Sequence: Synthetic peptide
DENEIRTTNPVATEQWGDYSEIEMQGDM

SEQ ID NO: 39376 - protein, 29 aa, Artificial Sequence
  Description of Artificial Sequence: Synthetic peptide
DEQEVRSVNPVAYEIYGCVGMNLERNGNR

SEQ ID NO: 39377 - protein, 32 aa, Artificial Sequence
  Description of Artificial Sequence: Synthetic polypeptide
DDQEITTTNPVATECYGSVSATNGLQEDKGET

SEQ ID NO: 39378 - protein, 28 aa, Artificial Sequence
  Description of Artificial Sequence: Synthetic peptide
CEDELRQTNPCATEHYGVVSENPQHGNH

SEQ ID NO: 39379 - protein, 34 aa, Artificial Sequence
  Description of Artificial Sequence: Synthetic polypeptide
DEEEIRQTNPVATEQYGSVSTNNPVQENKGDEDF

SEQ ID NO: 39380 - protein, 28 aa, Artificial Sequence
  Description of Artificial Sequence: Synthetic peptide
QENEIGCTNPVSTEIYGDVSDNLQNGDH

SEQ ID NO: 39381 - protein, 30 aa, Artificial Sequence
  Description of Artificial Sequence: Synthetic polypeptide
DENEIGCTNPVSTEMYGTASATVLQRAGGR

SEQ ID NO: 39382 - protein, 28 aa, Artificial Sequence
  Description of Artificial Sequence: Synthetic peptide
AENEIAQTNPVATEQYGVVSTDQEDGEA

SEQ ID NO: 39383 - protein, 28 aa, Artificial Sequence
  Description of Artificial Sequence: Synthetic peptide
SEEEILTTNIVATGMYGKVSINELRSNT

SEQ ID NO: 39384 - protein, 31 aa, Artificial Sequence
  Description of Artificial Sequence: Synthetic polypeptide
KEEEIRTTNPVATEQYGEVSEDLQEAQEEDM

SEQ ID NO: 39385 - protein, 30 aa, Artificial Sequence
  Description of Artificial Sequence: Synthetic polypeptide
DEIEICTTNPVATEQYGTCASVTALQGLMI

SEQ ID NO: 39386 - protein, 29 aa, Artificial Sequence
  Description of Artificial Sequence: Synthetic peptide
DEAEIAQTNPVATEMYGVTSCTLQSRGDY

SEQ ID NO: 39387 - protein, 33 aa, Artificial Sequence
  Description of Artificial Sequence: Synthetic polypeptide
DEVEIATTNPTATEQYGSVSTMNEQEIEGDNDE

SEQ ID NO: 39388 - protein, 33 aa, Artificial Sequence
  Description of Artificial Sequence: Synthetic polypeptide
DESEIRTTNPVATECWGSVSCINEPQDREGENG

SEQ ID NO: 39389 - protein, 28 aa, Artificial Sequence
  Description of Artificial Sequence: Synthetic peptide
VEEEERLTNIVATTQYGIVSDNSQRKGG

SEQ ID NO: 39390 - protein, 35 aa, Artificial Sequence
  Description of Artificial Sequence: Synthetic polypeptide
DEEEIRTTNPFATEQYGSVSITPGPLVCCDGDNPR

SEQ ID NO: 39391 - protein, 28 aa, Artificial Sequence
  Description of Artificial Sequence: Synthetic peptide
FEEELCAVNPVATEPWGCVSENVQRGNT

SEQ ID NO: 39392 - protein, 33 aa, Artificial Sequence
  Description of Artificial Sequence: Synthetic polypeptide
QEEEITTTNPVATEQYGVVSETGELQVVEGENG

SEQ ID NO: 39393 - protein, 28 aa, Artificial Sequence
  Description of Artificial Sequence: Synthetic peptide
DEQEIRTTNIVATEQYGVTADNEQSQTT

SEQ ID NO: 39394 - protein, 28 aa, Artificial Sequence
  Description of Artificial Sequence: Synthetic peptide
DEEEIATTNPVATEPYGGTRDNEQNQAT

SEQ ID NO: 39395 - protein, 30 aa, Artificial Sequence
  Description of Artificial Sequence: Synthetic polypeptide
MENEIRTTNPVATECYGSVSEDEQDHEGEQ

SEQ ID NO: 39396 - protein, 29 aa, Artificial Sequence
  Description of Artificial Sequence: Synthetic peptide
DENEIRCTNPVATEQWGIVSENEMMQGTA

SEQ ID NO: 39397 - protein, 28 aa, Artificial Sequence
  Description of Artificial Sequence: Synthetic peptide
DEEEIQTTNIVHTEQQLSVSDNFLIKNT

SEQ ID NO: 39398 - protein, 34 aa, Artificial Sequence
  Description of Artificial Sequence: Synthetic polypeptide
DEEEIRTTNPVATEQYGSASTCCPGLLFKGDNDN

SEQ ID NO: 39399 - protein, 28 aa, Artificial Sequence
  Description of Artificial Sequence: Synthetic peptide
AENEIAQTNPVATEQYGVVSTDDEVGEL

SEQ ID NO: 39400 - protein, 31 aa, Artificial Sequence
  Description of Artificial Sequence: Synthetic polypeptide
QEEEIRATNPVASEQYGVVGTDLQESDGNDN

SEQ ID NO: 39401 - protein, 32 aa, Artificial Sequence
  Description of Artificial Sequence: Synthetic polypeptide
DENEIRTTNPVSTEQYGTVSMENIQQQQNGNH

SEQ ID NO: 39402 - protein, 31 aa, Artificial Sequence
  Description of Artificial Sequence: Synthetic polypeptide
DEQEITTTNPCATEQYGVVSCTADCEQGNDR

SEQ ID NO: 39403 - protein, 31 aa, Artificial Sequence
  Description of Artificial Sequence: Synthetic polypeptide
DETEIRTTNPVATECYGATATEDLQEPKGNI

SEQ ID NO: 39404 - protein, 34 aa, Artificial Sequence
  Description of Artificial Sequence: Synthetic polypeptide
DEEEIRTTNPIATEQYGSVYSTEDGLQAQNEVTD

SEQ ID NO: 39405 - protein, 28 aa, Artificial Sequence
  Description of Artificial Sequence: Synthetic peptide
DENEIAQTNPCSTEQYGVVSEDLERGEA

SEQ ID NO: 39406 - protein, 32 aa, Artificial Sequence
  Description of Artificial Sequence: Synthetic polypeptide
DEEEIRCTNPVCTEQYGSVSNGNDEVYNGENS

SEQ ID NO: 39407 - protein, 28 aa, Artificial Sequence
  Description of Artificial Sequence: Synthetic peptide
DEENIRTTNNVAYCQQGLVHTNLGGGGG

SEQ ID NO: 39408 - protein, 30 aa, Artificial Sequence
  Description of Artificial Sequence: Synthetic polypeptide
DEEEIRTTNPVATEQWGDVSEIEMNAAGDA

SEQ ID NO: 39409 - protein, 29 aa, Artificial Sequence
  Description of Artificial Sequence: Synthetic peptide
AEVEITATNPVSTENYGTVSENLQHAGMR

SEQ ID NO: 39410 - protein, 30 aa, Artificial Sequence
  Description of Artificial Sequence: Synthetic polypeptide
QEAEIASTNPVATECYGSVSEMALQERGDP

SEQ ID NO: 39411 - protein, 31 aa, Artificial Sequence
  Description of Artificial Sequence: Synthetic polypeptide
DEEEIVTTNPVATECYGWVSETPLEPKGDEV

SEQ ID NO: 39412 - protein, 29 aa, Artificial Sequence
  Description of Artificial Sequence: Synthetic peptide
DEAEICATNPVATEVYGSCSDVLQHAGPM

SEQ ID NO: 39413 - protein, 28 aa, Artificial Sequence
  Description of Artificial Sequence: Synthetic peptide
DENEIAQTNPFATEQYGVVSTDQEVGED

SEQ ID NO: 39414 - protein, 28 aa, Artificial Sequence
  Description of Artificial Sequence: Synthetic peptide
QEQEIAATNPVSTEMYGEASEVLQRGMR

SEQ ID NO: 39415 - protein, 28 aa, Artificial Sequence
  Description of Artificial Sequence: Synthetic peptide
DEGEARTTNIVATEEGGLVATNEQSSNT

SEQ ID NO: 39416 - protein, 30 aa, Artificial Sequence
  Description of Artificial Sequence: Synthetic polypeptide
DEQEIAAVNPVATECYGSVSEDLQDQGDDR

SEQ ID NO: 39417 - protein, 28 aa, Artificial Sequence
  Description of Artificial Sequence: Synthetic peptide
QESEIYTTNPVSTEIYGEVSYNWEDGNM

SEQ ID NO: 39418 - protein, 35 aa, Artificial Sequence
  Description of Artificial Sequence: Synthetic polypeptide
DEEEIRTTNPVATEQYGSVSVTIPPVQDIKGDEPR

SEQ ID NO: 39419 - protein, 35 aa, Artificial Sequence
  Description of Artificial Sequence: Synthetic polypeptide
DEEEIRTTNPFATEQYGSVSITPGPLVCCDGFNPR

SEQ ID NO: 39420 - protein, 28 aa, Artificial Sequence
  Description of Artificial Sequence: Synthetic peptide
DIQGIRTLNDGSTEQYDNISTNLQRGNT

SEQ ID NO: 39421 - protein, 33 aa, Artificial Sequence
  Description of Artificial Sequence: Synthetic polypeptide
DEEEIATTNPVATEQYGSVSITDQEENNGDNDS

SEQ ID NO: 39422 - protein, 32 aa, Artificial Sequence
  Description of Artificial Sequence: Synthetic polypeptide
DEQEIATTNPVATECYGSVSATDLQIINGEDL

SEQ ID NO: 39423 - protein, 34 aa, Artificial Sequence
  Description of Artificial Sequence: Synthetic polypeptide
DEEEIATTNPVATEQYGSVSATTGQELDNGENDD

SEQ ID NO: 39424 - protein, 32 aa, Artificial Sequence
  Description of Artificial Sequence: Synthetic polypeptide
HEEEIMTTNPVATEQYGGVNTGNWQMQGANTE

SEQ ID NO: 39425 - protein, 28 aa, Artificial Sequence
  Description of Artificial Sequence: Synthetic peptide
QEQEIASTNPVATECYGSVSTDLEEEEL

SEQ ID NO: 39426 - protein, 28 aa, Artificial Sequence
  Description of Artificial Sequence: Synthetic peptide
DEEEIRTVNIVAQDQLGSISNNWQYTTR

SEQ ID NO: 39427 - protein, 28 aa, Artificial Sequence
  Description of Artificial Sequence: Synthetic peptide
VEEEIRTTNPVSTEMYGEAGDNLMQQTR

SEQ ID NO: 39428 - protein, 28 aa, Artificial Sequence
  Description of Artificial Sequence: Synthetic peptide
DEDEIRSTNPVSYEWWGSVSTALMPGTM

SEQ ID NO: 39429 - protein, 28 aa, Artificial Sequence
  Description of Artificial Sequence: Synthetic peptide
DEEVIRTNNAYITEQQGTVSDNLYKGNT

SEQ ID NO: 39430 - protein, 33 aa, Artificial Sequence
  Description of Artificial Sequence: Synthetic polypeptide
DEVEIATTNPVATEQYGSVISENEQDREGDTTF

SEQ ID NO: 39431 - protein, 33 aa, Artificial Sequence
  Description of Artificial Sequence: Synthetic polypeptide
DEEEIRTTNPDATEQYGSVSCENPLDCNEGHEN

SEQ ID NO: 39432 - protein, 33 aa, Artificial Sequence
  Description of Artificial Sequence: Synthetic polypeptide
DEVEIATTNPTATEQYGSVSTMNEQDQEGDNTF

SEQ ID NO: 39433 - protein, 28 aa, Artificial Sequence
  Description of Artificial Sequence: Synthetic peptide
SEVEIAATNPVATEIFGEVSENEQRGDF

SEQ ID NO: 39434 - protein, 34 aa, Artificial Sequence
  Description of Artificial Sequence: Synthetic polypeptide
DEEEIRTTNPVATEAYGNVPSLTNNVDLDDGVNW

SEQ ID NO: 39435 - protein, 32 aa, Artificial Sequence
  Description of Artificial Sequence: Synthetic polypeptide
DEEEIRTTNPEATEMYGCVISANLQEFGDTCT

SEQ ID NO: 39436 - protein, 32 aa, Artificial Sequence
  Description of Artificial Sequence: Synthetic polypeptide
DEEEIRTTNPCATESYGSVSTEEWEPQELENG

SEQ ID NO: 39437 - protein, 28 aa, Artificial Sequence
  Description of Artificial Sequence: Synthetic peptide
DEEETTTTNIVATEEYGQVVDNLQSSTT

SEQ ID NO: 39438 - protein, 31 aa, Artificial Sequence
  Description of Artificial Sequence: Synthetic polypeptide
QEHEIATTNPVATEQYGWVSTNLEDFKGDDP

SEQ ID NO: 39439 - protein, 28 aa, Artificial Sequence
  Description of Artificial Sequence: Synthetic peptide
DESEVRTISQIATNQYTGTVTNLQRGNT

SEQ ID NO: 39440 - protein, 28 aa, Artificial Sequence
  Description of Artificial Sequence: Synthetic peptide
DGEEGRFTNNVAWEHIGSVNTQLQREND

SEQ ID NO: 39441 - protein, 31 aa, Artificial Sequence
  Description of Artificial Sequence: Synthetic polypeptide
SEVEIACTNPTATEQYGSVSEMNEQREGTDR

SEQ ID NO: 39442 - protein, 28 aa, Artificial Sequence
  Description of Artificial Sequence: Synthetic peptide
DEEEGSTNNIVVQDQYGMTSTNLQYANR

SEQ ID NO: 39443 - protein, 34 aa, Artificial Sequence
  Description of Artificial Sequence: Synthetic polypeptide
DEEEIRTTNPVATEQYGSVFCEMNLCCDDGFNPC

SEQ ID NO: 39444 - protein, 28 aa, Artificial Sequence
  Description of Artificial Sequence: Synthetic peptide
SEVEIACTNPEATECFGSVSENWQNGNA

SEQ ID NO: 39445 - protein, 33 aa, Artificial Sequence
  Description of Artificial Sequence: Synthetic polypeptide
DEEEIRTTNPVATEQYGDVSCEMNLCCHAENDQ

SEQ ID NO: 39446 - protein, 34 aa, Artificial Sequence
  Description of Artificial Sequence: Synthetic polypeptide
DEEEIRTTNPFATEQYGSVSLTPNPLPFIDKGEP

SEQ ID NO: 39447 - protein, 28 aa, Artificial Sequence
  Description of Artificial Sequence: Synthetic peptide
DEEEIRTTNPFATEQYWSWEDPDDPGEP

SEQ ID NO: 39448 - protein, 30 aa, Artificial Sequence
  Description of Artificial Sequence: Synthetic polypeptide
VEDEIRTTNPVATEAYGCVGMNLEDRLTER

SEQ ID NO: 39449 - protein, 28 aa, Artificial Sequence
  Description of Artificial Sequence: Synthetic peptide
EEEEILTTNDGMTDRYGVVSTNLQSANT

SEQ ID NO: 39450 - protein, 28 aa, Artificial Sequence
  Description of Artificial Sequence: Synthetic peptide
DADGINTTNIITTNQYGSVSTNVQRKNG

SEQ ID NO: 39451 - protein, 35 aa, Artificial Sequence
  Description of Artificial Sequence: Synthetic polypeptide
DEEEIRTTNPFATEQYGSVSITPNPLVQIDKGDEP

SEQ ID NO: 39452 - protein, 35 aa, Artificial Sequence
  Description of Artificial Sequence: Synthetic polypeptide
DEEEIRTTNPVATEQYGSVDDVTQEGGERKGINLR

SEQ ID NO: 39453 - protein, 29 aa, Artificial Sequence
  Description of Artificial Sequence: Synthetic peptide
QEEEINATNPVSTEQYGVVGTIIQSRGGH

SEQ ID NO: 39454 - protein, 31 aa, Artificial Sequence
  Description of Artificial Sequence: Synthetic polypeptide
DEAEIQTTNPVCTEQYGSACTNLEDNNGNDA

SEQ ID NO: 39455 - protein, 33 aa, Artificial Sequence
  Description of Artificial Sequence: Synthetic polypeptide
DEEEIVTTNPVATEQYGSVCSATDGPVEFEGND

SEQ ID NO: 39456 - protein, 31 aa, Artificial Sequence
  Description of Artificial Sequence: Synthetic polypeptide
DEVEISTTNPVSTEQYGSVSATADVQIGETF

SEQ ID NO: 39457 - protein, 36 aa, Artificial Sequence
  Description of Artificial Sequence: Synthetic polypeptide
DEEEIRTTNPVATEQYGSVTSDTMNGLVEIPDGNPV

SEQ ID NO: 39458 - protein, 28 aa, Artificial Sequence
  Description of Artificial Sequence: Synthetic peptide
DKECILSTNIVATSQYGSTSTNDGNGNT

SEQ ID NO: 39459 - protein, 35 aa, Artificial Sequence
  Description of Artificial Sequence: Synthetic polypeptide
DEEEIRTTNPVATEQYGSVADTTDPNLLDANGDER

SEQ ID NO: 39460 - protein, 28 aa, Artificial Sequence
  Description of Artificial Sequence: Synthetic peptide
ANEEIRTTNIGATDQYNSVSDNMQNKDR

SEQ ID NO: 39461 - protein, 29 aa, Artificial Sequence
  Description of Artificial Sequence: Synthetic peptide
CEEEIRQTNPVATEQYGEAADDLQDQGEV

SEQ ID NO: 39462 - protein, 32 aa, Artificial Sequence
  Description of Artificial Sequence: Synthetic polypeptide
DEQEIATTNPVATECYGSVSATDLEDREGEDL

SEQ ID NO: 39463 - protein, 28 aa, Artificial Sequence
  Description of Artificial Sequence: Synthetic peptide
SEEEIATVNIVATDQYGYVSNNNQQSNQ

SEQ ID NO: 39464 - protein, 28 aa, Artificial Sequence
  Description of Artificial Sequence: Synthetic peptide
DEEEIRTTNIVMTEMYGRTVNNLQTSTV

SEQ ID NO: 39465 - protein, 28 aa, Artificial Sequence
  Description of Artificial Sequence: Synthetic peptide
DEEETVSNNIVTIEQYGSISTNLKTANR

SEQ ID NO: 39466 - protein, 28 aa, Artificial Sequence
  Description of Artificial Sequence: Synthetic peptide
DEFEIAATNPVATEMFGTVSDAEQIGTR

SEQ ID NO: 39467 - protein, 28 aa, Artificial Sequence
  Description of Artificial Sequence: Synthetic peptide
SEGEIRATNPTATEMFGCVSVNPQNGNF

SEQ ID NO: 39468 - protein, 28 aa, Artificial Sequence
  Description of Artificial Sequence: Synthetic peptide
SEQEISATNPEGTEQYGQVSTNLNLGDD

SEQ ID NO: 39469 - protein, 30 aa, Artificial Sequence
  Description of Artificial Sequence: Synthetic polypeptide
VEDEIRTTNPVASEQYGCVGAMNLERNGTD

SEQ ID NO: 39470 - protein, 34 aa, Artificial Sequence
  Description of Artificial Sequence: Synthetic polypeptide
DEEEIRTTNPFATEQYGSVESDTPGPLDPEGENP

SEQ ID NO: 39471 - protein, 31 aa, Artificial Sequence
  Description of Artificial Sequence: Synthetic polypeptide
DEGEITATNPVATECFGSVISTGNWQQGDDR

SEQ ID NO: 39472 - protein, 28 aa, Artificial Sequence
  Description of Artificial Sequence: Synthetic peptide
DEEEIDFTNIVLMDQRGSVHTNFQRGTT

SEQ ID NO: 39473 - protein, 35 aa, Artificial Sequence
  Description of Artificial Sequence: Synthetic polypeptide
DEQEIRTTNPVATEQYGSVQSLTDTLQIQDEGNNI

SEQ ID NO: 39474 - protein, 28 aa, Artificial Sequence
  Description of Artificial Sequence: Synthetic peptide
YENEITCTNPVCTEPYGSVATDDQYGND

SEQ ID NO: 39475 - protein, 33 aa, Artificial Sequence
  Description of Artificial Sequence: Synthetic polypeptide
DEVEIATTNPTATEQYGSVSTMNEQDQEGDNDF

SEQ ID NO: 39476 - protein, 33 aa, Artificial Sequence
  Description of Artificial Sequence: Synthetic polypeptide
DEEEIRQTNPVATEQYGSVSTDPVQEIKGVEDL

SEQ ID NO: 39477 - protein, 28 aa, Artificial Sequence
  Description of Artificial Sequence: Synthetic peptide
DEEEIKTTNIVATERYGLTAINLQNSTT

SEQ ID NO: 39478 - protein, 28 aa, Artificial Sequence
  Description of Artificial Sequence: Synthetic peptide
QEEEITATNPVATECFGSVSADWQQGTS

SEQ ID NO: 39479 - protein, 34 aa, Artificial Sequence
  Description of Artificial Sequence: Synthetic polypeptide
DEEEIRQTNPVATEQYGSVSTPNPVQENKGDEDF

SEQ ID NO: 39480 - protein, 31 aa, Artificial Sequence
  Description of Artificial Sequence: Synthetic polypeptide
QEEEIRATNPVATECYGSVSANDLEEHNGED

SEQ ID NO: 39481 - protein, 34 aa, Artificial Sequence
  Description of Artificial Sequence: Synthetic polypeptide
AEEEIATTNPVATEQYGVVDSTTNGLVERGEEDR

SEQ ID NO: 39482 - protein, 28 aa, Artificial Sequence
  Description of Artificial Sequence: Synthetic peptide
DEVEIASTNPVGTEQYGSIPTNEEHFNG

SEQ ID NO: 39483 - protein, 28 aa, Artificial Sequence
  Description of Artificial Sequence: Synthetic peptide
QEEEIATTNPVATEQYGEAPEVLQHEEK

SEQ ID NO: 39484 - protein, 28 aa, Artificial Sequence
  Description of Artificial Sequence: Synthetic peptide
DEEEIRTTNPLATQQYWSWETDDDNDNG

SEQ ID NO: 39485 - protein, 35 aa, Artificial Sequence
  Description of Artificial Sequence: Synthetic polypeptide
DEEEIRTTNPVATEQYGSVSITPNPLVFIDKGDEP

SEQ ID NO: 39486 - protein, 28 aa, Artificial Sequence
  Description of Artificial Sequence: Synthetic peptide
DEEAIRATNAVNRENYYSTDTNAQRGNT

SEQ ID NO: 39487 - protein, 28 aa, Artificial Sequence
  Description of Artificial Sequence: Synthetic peptide
DGEEGNTQNIVDTEHYGAVSSYLQRGNT

SEQ ID NO: 39488 - protein, 29 aa, Artificial Sequence
  Description of Artificial Sequence: Synthetic peptide
QEQEIATVNPVSTEVYGSVSEVLQHAGGR

SEQ ID NO: 39489 - protein, 28 aa, Artificial Sequence
  Description of Artificial Sequence: Synthetic peptide
DEEEITTTNPVDTDRYGTTATNLQSSTT

SEQ ID NO: 39490 - protein, 28 aa, Artificial Sequence
  Description of Artificial Sequence: Synthetic peptide
QEQEITATNPVATECYGWVSTDLEQGEA

SEQ ID NO: 39491 - protein, 28 aa, Artificial Sequence
  Description of Artificial Sequence: Synthetic peptide
DEEEIRTTNPCAHMFFGCVSTGLDIGTE

SEQ ID NO: 39492 - protein, 28 aa, Artificial Sequence
  Description of Artificial Sequence: Synthetic peptide
QENEIATTNPVATECYGDVSECLQHEEL

SEQ ID NO: 39493 - protein, 28 aa, Artificial Sequence
  Description of Artificial Sequence: Synthetic peptide
DEEEIATTNPVAIEVYGGTRDNLQYRAT

SEQ ID NO: 39494 - protein, 28 aa, Artificial Sequence
  Description of Artificial Sequence: Synthetic peptide
AEAELNTTNPVATECYGEVSNNVQRPPH

SEQ ID NO: 39495 - protein, 33 aa, Artificial Sequence
  Description of Artificial Sequence: Synthetic polypeptide
DEVEIATTNPTATEQYGGVSTGNPQLQEGDNTN

SEQ ID NO: 39496 - protein, 31 aa, Artificial Sequence
  Description of Artificial Sequence: Synthetic polypeptide
DEVEIATTNPCATEPYGDVSCTDLQCQAGNA

SEQ ID NO: 39497 - protein, 30 aa, Artificial Sequence
  Description of Artificial Sequence: Synthetic polypeptide
SEDEIRATNPVATETFGEVSENLQIEGDDR

SEQ ID NO: 39498 - protein, 28 aa, Artificial Sequence
  Description of Artificial Sequence: Synthetic peptide
QEGEIAPTNPCSSEQYGIVSCNLQSGTR

SEQ ID NO: 39499 - protein, 28 aa, Artificial Sequence
  Description of Artificial Sequence: Synthetic peptide
DEEEIRNTNIIAELQYGLTHDILQHGNR

SEQ ID NO: 39500 - protein, 30 aa, Artificial Sequence
  Description of Artificial Sequence: Synthetic polypeptide
DEHEIRTTNPVASETYGTVSTMDWQESGDT

SEQ ID NO: 39501 - protein, 37 aa, Artificial Sequence
  Description of Artificial Sequence: Synthetic polypeptide
DEEEIRTTNPVATEQYGSYVSSITGPLNQVRDGDNPN

SEQ ID NO: 39502 - protein, 28 aa, Artificial Sequence
  Description of Artificial Sequence: Synthetic peptide
HETEICSTNPVATEQYGNVAMLLQQGQI

SEQ ID NO: 39503 - protein, 31 aa, Artificial Sequence
  Description of Artificial Sequence: Synthetic polypeptide
SEGEIRTTNPVCTEQYGSVISTDGWQTGTFA

SEQ ID NO: 39504 - protein, 35 aa, Artificial Sequence
  Description of Artificial Sequence: Synthetic polypeptide
DEEEIRTTNPVATEQYGSVSTTDDLVEEVEGDNDC

SEQ ID NO: 39505 - protein, 28 aa, Artificial Sequence
  Description of Artificial Sequence: Synthetic peptide
DEEEITTTNPVDTDRYGTTSTNVQSSTT

SEQ ID NO: 39506 - protein, 33 aa, Artificial Sequence
  Description of Artificial Sequence: Synthetic polypeptide
DEEEIRTTNPVATEQYGSVGTCDNQDCNEFEPF

SEQ ID NO: 39507 - protein, 31 aa, Artificial Sequence
  Description of Artificial Sequence: Synthetic polypeptide
DEEEIRTTNPVATEQWGDHVSEIEMNQAGDA

SEQ ID NO: 39508 - protein, 28 aa, Artificial Sequence
  Description of Artificial Sequence: Synthetic peptide
DDSEVASTNPVSTEGYGNVANNLQRGQR

SEQ ID NO: 39509 - protein, 33 aa, Artificial Sequence
  Description of Artificial Sequence: Synthetic polypeptide
DEQEIATTNPVATECYGSVSATNLQEHEGEEDL

SEQ ID NO: 39510 - protein, 28 aa, Artificial Sequence
  Description of Artificial Sequence: Synthetic peptide
NGEEIETTDIVATDRQGSLSTNLIWGNR

SEQ ID NO: 39511 - protein, 31 aa, Artificial Sequence
  Description of Artificial Sequence: Synthetic polypeptide
DEEEIRTTNPCATEPYGDVSCSMELCYVGNV

SEQ ID NO: 39512 - protein, 35 aa, Artificial Sequence
  Description of Artificial Sequence: Synthetic polypeptide
DEEEIRTTNPVATEQYGSVDCTMNGLCCPEGENDD

SEQ ID NO: 39513 - protein, 32 aa, Artificial Sequence
  Description of Artificial Sequence: Synthetic polypeptide
DENEIAQTNPVATEQYGSVSTGPVEDRGDNDI

SEQ ID NO: 39514 - protein, 33 aa, Artificial Sequence
  Description of Artificial Sequence: Synthetic polypeptide
DNEEIRSTNPVATEQYGSVNATNGEPQREGDPQ

SEQ ID NO: 39515 - protein, 28 aa, Artificial Sequence
  Description of Artificial Sequence: Synthetic peptide
DSEEIRATNNVANTQQGSVETQLQQINQ

SEQ ID NO: 39516 - protein, 28 aa, Artificial Sequence
  Description of Artificial Sequence: Synthetic peptide
AENEIAQTNPVATEQYGVVDTDQEVGER

SEQ ID NO: 39517 - protein, 28 aa, Artificial Sequence
  Description of Artificial Sequence: Synthetic peptide
REHEITCTNPVATEHYGAVSDDEQVGNA

SEQ ID NO: 39518 - protein, 31 aa, Artificial Sequence
  Description of Artificial Sequence: Synthetic polypeptide
DEGEITTTNPVATECYGWVSTELQIVNGEDT

SEQ ID NO: 39519 - protein, 28 aa, Artificial Sequence
  Description of Artificial Sequence: Synthetic peptide
DEIETRTTNGFITERYGGVSDNEYQGNR

SEQ ID NO: 39520 - protein, 34 aa, Artificial Sequence
  Description of Artificial Sequence: Synthetic polypeptide
DEEEIRTTNPVATECYGSVCSDTGNLQDQEDEEY

SEQ ID NO: 39521 - protein, 35 aa, Artificial Sequence
  Description of Artificial Sequence: Synthetic polypeptide
DEEEIRTTNPVATEQYGSVISTANPPCENEGDNCF

SEQ ID NO: 39522 - protein, 30 aa, Artificial Sequence
  Description of Artificial Sequence: Synthetic polypeptide
DENEIRTTNPVATECWGIVSENDENGGDDR

SEQ ID NO: 39523 - protein, 28 aa, Artificial Sequence
  Description of Artificial Sequence: Synthetic peptide
DEEEIRTVNNVAGINYGYTSDNLQYDAR

SEQ ID NO: 39524 - protein, 32 aa, Artificial Sequence
  Description of Artificial Sequence: Synthetic polypeptide
DEQEIATTNPFATEQYGSVSITLNPDSKGNPS

SEQ ID NO: 39525 - protein, 30 aa, Artificial Sequence
  Description of Artificial Sequence: Synthetic polypeptide
DDEEIRTTNPVASEMYGTVATELEEYEGNS

SEQ ID NO: 39526 - protein, 28 aa, Artificial Sequence
  Description of Artificial Sequence: Synthetic peptide
SEEEIYTTNPESTETYGCVSNNVQGGPI

SEQ ID NO: 39527 - protein, 34 aa, Artificial Sequence
  Description of Artificial Sequence: Synthetic polypeptide
DEEEIRTTNPVATEQYGSVISATENPDAINGTHG

SEQ ID NO: 39528 - protein, 28 aa, Artificial Sequence
  Description of Artificial Sequence: Synthetic peptide
SEGEIATTNPVATENYGEVSVNWIQGPQ

SEQ ID NO: 39529 - protein, 30 aa, Artificial Sequence
  Description of Artificial Sequence: Synthetic polypeptide
DEEEIWTTNPVATEGYGVVCSNCILDLGEQ

SEQ ID NO: 39530 - protein, 32 aa, Artificial Sequence
  Description of Artificial Sequence: Synthetic polypeptide
DEEEIRTTNPIATEQYGATWSNAENWQPGNYI

SEQ ID NO: 39531 - protein, 28 aa, Artificial Sequence
  Description of Artificial Sequence: Synthetic peptide
DEEEINTTNTVDMDQRGSVTTSLQQNNE

SEQ ID NO: 39532 - protein, 33 aa, Artificial Sequence
  Description of Artificial Sequence: Synthetic polypeptide
SEEEIRTTNPTATEMYGSVISEMNEPQQGDNTR

SEQ ID NO: 39533 - protein, 36 aa, Artificial Sequence
  Description of Artificial Sequence: Synthetic polypeptide
DEEEIRTTNPVATEQYGSVISTMGGPPQLREGDNCG

SEQ ID NO: 39534 - protein, 28 aa, Artificial Sequence
  Description of Artificial Sequence: Synthetic peptide
DEEEIRTNDIVQTEHVGLISTNIQRGAG

SEQ ID NO: 39535 - protein, 35 aa, Artificial Sequence
  Description of Artificial Sequence: Synthetic polypeptide
DEEEIRTTNPVATEQYGSVDCTMNGLCCPNGDNDD

SEQ ID NO: 39536 - protein, 32 aa, Artificial Sequence
  Description of Artificial Sequence: Synthetic polypeptide
DENEIRTTNPVATEQWGSYSTTNEMDYDGNDA

SEQ ID NO: 39537 - protein, 28 aa, Artificial Sequence
  Description of Artificial Sequence: Synthetic peptide
DEGETKTNNIVAWEQYGSVSDGEQSGNY

SEQ ID NO: 39538 - protein, 28 aa, Artificial Sequence
  Description of Artificial Sequence: Synthetic peptide
DEEEIKTTNIVGWKQYGIVATNLQQSTT

SEQ ID NO: 39539 - protein, 31 aa, Artificial Sequence
  Description of Artificial Sequence: Synthetic polypeptide
VENEIRTTNPVATECYGSVSDTELEIHGEEH

SEQ ID NO: 39540 - protein, 33 aa, Artificial Sequence
  Description of Artificial Sequence: Synthetic polypeptide
SEEEIRATNPTATEQYGSVISEMNGEQDQEGNR

SEQ ID NO: 39541 - protein, 28 aa, Artificial Sequence
  Description of Artificial Sequence: Synthetic peptide
DEESINVVNNVADEQLGGVSANLGRGNQ

SEQ ID NO: 39542 - protein, 35 aa, Artificial Sequence
  Description of Artificial Sequence: Synthetic polypeptide
DEEEIRTTNPVATEQYGSVSSTTPAGPNRNGMNPV

SEQ ID NO: 39543 - protein, 30 aa, Artificial Sequence
  Description of Artificial Sequence: Synthetic polypeptide
DEHEIRTTNPVATEQYGVADMMDLETAGNA

SEQ ID NO: 39544 - protein, 28 aa, Artificial Sequence
  Description of Artificial Sequence: Synthetic peptide
YEIEIASVNPVCTETYGVVSDNLQSGNQ

SEQ ID NO: 39545 - protein, 32 aa, Artificial Sequence
  Description of Artificial Sequence: Synthetic polypeptide
DEHEIRTTNPVATEVYGDVSCEMDLCCHGNDR

SEQ ID NO: 39546 - protein, 28 aa, Artificial Sequence
  Description of Artificial Sequence: Synthetic peptide
DGEEINQTNITTTEIYGAVLDNLQRGNV

SEQ ID NO: 39547 - protein, 28 aa, Artificial Sequence
  Description of Artificial Sequence: Synthetic peptide
DESEIRQTNIAATDIYTSASTELQRRND

SEQ ID NO: 39548 - protein, 28 aa, Artificial Sequence
  Description of Artificial Sequence: Synthetic peptide
DEQEVAATNPVSTEIYGGVATNLQRTTT

SEQ ID NO: 39549 - protein, 36 aa, Artificial Sequence
  Description of Artificial Sequence: Synthetic polypeptide
DEEEIRTTNPFATEQYGSVSVTENGPVDLRNGENPR

SEQ ID NO: 39550 - protein, 34 aa, Artificial Sequence
  Description of Artificial Sequence: Synthetic polypeptide
DEQEIRTTNPVATEQYGSTVDDITYNADDLRGNL

SEQ ID NO: 39551 - protein, 33 aa, Artificial Sequence
  Description of Artificial Sequence: Synthetic polypeptide
DEEEIATTNPVATEQYGSVISEMNEPQDQEGDF

SEQ ID NO: 39552 - protein, 28 aa, Artificial Sequence
  Description of Artificial Sequence: Synthetic peptide
DEEEVRTTNIVATEMWGTTTDNLQDSNA

SEQ ID NO: 39553 - protein, 28 aa, Artificial Sequence
  Description of Artificial Sequence: Synthetic peptide
NEEEIKTTNPVDTDRYGTTATNLQSSNT

SEQ ID NO: 39554 - protein, 34 aa, Artificial Sequence
  Description of Artificial Sequence: Synthetic polypeptide
DEEEIATTNPVATEQYGSVSATTDQELVNGENDD

SEQ ID NO: 39555 - protein, 28 aa, Artificial Sequence
  Description of Artificial Sequence: Synthetic peptide
SEVEIAATNPTATEQFGSVSENEQQGDF

SEQ ID NO: 39556 - protein, 34 aa, Artificial Sequence
  Description of Artificial Sequence: Synthetic polypeptide
DEEEIRQTNPVATEQYGSVSITCAPVQEAKGNDT

SEQ ID NO: 39557 - protein, 28 aa, Artificial Sequence
  Description of Artificial Sequence: Synthetic peptide
DEEHRRTTNIVATNQLGDIRDNLQGGNN

SEQ ID NO: 39558 - protein, 32 aa, Artificial Sequence
  Description of Artificial Sequence: Synthetic polypeptide
DEEEIRTTNPTATEQYGEVSEMNEQCQGDDTF

SEQ ID NO: 39559 - protein, 30 aa, Artificial Sequence
  Description of Artificial Sequence: Synthetic polypeptide
DEQEIAATNPVATECYGSVSEDLQDQGDDS

SEQ ID NO: 39560 - protein, 31 aa, Artificial Sequence
  Description of Artificial Sequence: Synthetic polypeptide
DEGEIRTTNPVATFHYGNVDDANLQLDGNDE

SEQ ID NO: 39561 - protein, 28 aa, Artificial Sequence
  Description of Artificial Sequence: Synthetic peptide
VEEGIGTTNIVATLQEGSLHDNLQRSER

SEQ ID NO: 39562 - protein, 28 aa, Artificial Sequence
  Description of Artificial Sequence: Synthetic peptide
DEEEIRATNGVRTDIYGQVADNLQYDNT

SEQ ID NO: 39563 - protein, 28 aa, Artificial Sequence
  Description of Artificial Sequence: Synthetic peptide
QEEEITATNPVGTECYGSVSENPAVGPH

SEQ ID NO: 39564 - protein, 29 aa, Artificial Sequence
  Description of Artificial Sequence: Synthetic peptide
QEGEITATNPVATECFGSVSVGNLQQGDP

SEQ ID NO: 39565 - protein, 28 aa, Artificial Sequence
  Description of Artificial Sequence: Synthetic peptide
DEDEICCTNPTATEIFGGVSENWQQGNT

SEQ ID NO: 39566 - protein, 35 aa, Artificial Sequence
  Description of Artificial Sequence: Synthetic polypeptide
DEEEIRTTNPVATEQYGSVSDTLADQQMSKGEEPR

SEQ ID NO: 39567 - protein, 33 aa, Artificial Sequence
  Description of Artificial Sequence: Synthetic polypeptide
SEEEIRTTNPTATEQYGSVISTMNEQESGDTDG

SEQ ID NO: 39568 - protein, 28 aa, Artificial Sequence
  Description of Artificial Sequence: Synthetic peptide
NEGEIECTNPCATESWGTVATNLQRGMM

SEQ ID NO: 39569 - protein, 28 aa, Artificial Sequence
  Description of Artificial Sequence: Synthetic peptide
AENEIAQTNPDATEQYGVVSTDQENGND

SEQ ID NO: 39570 - protein, 28 aa, Artificial Sequence
  Description of Artificial Sequence: Synthetic peptide
DEQEVAATNPVGTEIYGGVATNLQRTTT

SEQ ID NO: 39571 - protein, 28 aa, Artificial Sequence
  Description of Artificial Sequence: Synthetic peptide
DEQEVAATNPVGTEVYGGVATNLQRTTT

SEQ ID NO: 39572 - protein, 32 aa, Artificial Sequence
  Description of Artificial Sequence: Synthetic polypeptide
QENEIATTNPVATECYGSVSDTDLEIHNGENR

SEQ ID NO: 39573 - protein, 28 aa, Artificial Sequence
  Description of Artificial Sequence: Synthetic peptide
DENEIRTTNPVATEQWGDYSEIEMQGDA

SEQ ID NO: 39574 - protein, 28 aa, Artificial Sequence
  Description of Artificial Sequence: Synthetic peptide
DEEVIAITNIVATEEYGVVSDNQQASNN

SEQ ID NO: 39575 - protein, 32 aa, Artificial Sequence
  Description of Artificial Sequence: Synthetic polypeptide
DEEEIVTTNPDATEQYGEVASTGGDQITGDNY

SEQ ID NO: 39576 - protein, 32 aa, Artificial Sequence
  Description of Artificial Sequence: Synthetic polypeptide
DEEEIRTTNPTATEQYGEVSEANPQELGVDTH

SEQ ID NO: 39577 - protein, 30 aa, Artificial Sequence
  Description of Artificial Sequence: Synthetic polypeptide
DEEEIATTNPVATEQYGEASAEVLQHAEEK

SEQ ID NO: 39578 - protein, 28 aa, Artificial Sequence
  Description of Artificial Sequence: Synthetic peptide
DEQEVAATNIVSSEHYGVVATNLQRGNT

SEQ ID NO: 39579 - protein, 28 aa, Artificial Sequence
  Description of Artificial Sequence: Synthetic peptide
DEQEIATTNIVATECYGSSSEDLENGEF

SEQ ID NO: 39580 - protein, 33 aa, Artificial Sequence
  Description of Artificial Sequence: Synthetic polypeptide
DEEEIATTNPTATEQFGGVSTMNEQLQEGDNTF

SEQ ID NO: 39581 - protein, 30 aa, Artificial Sequence
  Description of Artificial Sequence: Synthetic polypeptide
MENEIRTTNPVATECYGSVADELQEVGEDL

SEQ ID NO: 39582 - protein, 28 aa, Artificial Sequence
  Description of Artificial Sequence: Synthetic peptide
DEEVIRNTNIVATEQIEEVATNKQRRGG

SEQ ID NO: 39583 - protein, 29 aa, Artificial Sequence
  Description of Artificial Sequence: Synthetic peptide
SDQEIACTNPVATEIYGVVASNLEREGNR

SEQ ID NO: 39584 - protein, 28 aa, Artificial Sequence
  Description of Artificial Sequence: Synthetic peptide
DEEDIRTTSIVITDQLGLVTTNIQYGNT

SEQ ID NO: 39585 - protein, 32 aa, Artificial Sequence
  Description of Artificial Sequence: Synthetic polypeptide
NETEIRTTNPVATEQYGSVSDYCPPPQASGNS

SEQ ID NO: 39586 - protein, 28 aa, Artificial Sequence
  Description of Artificial Sequence: Synthetic peptide
DEQEGRITNDVAFEIYGSVHDNLQNGTK

SEQ ID NO: 39587 - protein, 32 aa, Artificial Sequence
  Description of Artificial Sequence: Synthetic polypeptide
DEEEIRTTNPVATEQYGSVSELDPVELNGIDS

SEQ ID NO: 39588 - protein, 28 aa, Artificial Sequence
  Description of Artificial Sequence: Synthetic peptide
QESEIATTNPVGTEGYGVMASTLQHGNI

SEQ ID NO: 39589 - protein, 31 aa, Artificial Sequence
  Description of Artificial Sequence: Synthetic polypeptide
QEHEICTTNPCATECYGSVSDTDLQETNGNM

SEQ ID NO: 39590 - protein, 30 aa, Artificial Sequence
  Description of Artificial Sequence: Synthetic polypeptide
DENEIASTNPVASEQYGVVSTDLQDQGEDL

SEQ ID NO: 39591 - protein, 28 aa, Artificial Sequence
  Description of Artificial Sequence: Synthetic peptide
DEEEITTTNPVDTRPYGTTATNLQSSTT

SEQ ID NO: 39592 - protein, 34 aa, Artificial Sequence
  Description of Artificial Sequence: Synthetic polypeptide
SEEEIRTTNPVATEQYGEVISTMNLPQIEGIDTA

SEQ ID NO: 39593 - protein, 28 aa, Artificial Sequence
  Description of Artificial Sequence: Synthetic peptide
DEEEIATTNIVATSQYGGQRTDIQAKNG

SEQ ID NO: 39594 - protein, 28 aa, Artificial Sequence
  Description of Artificial Sequence: Synthetic peptide
DEDEIRTTNIVGWEQYGTVADNLQNSTT

SEQ ID NO: 39595 - protein, 28 aa, Artificial Sequence
  Description of Artificial Sequence: Synthetic peptide
DEEELRTTNIYATSIYTSVSTNDQGKHG

SEQ ID NO: 39596 - protein, 28 aa, Artificial Sequence
  Description of Artificial Sequence: Synthetic peptide
AENEIAQTNPFATEQYGVVSTDQERGED

SEQ ID NO: 39597 - protein, 28 aa, Artificial Sequence
  Description of Artificial Sequence: Synthetic peptide
DEEQIAGTNIVDTRNYGSMSENLQRGSG

SEQ ID NO: 39598 - protein, 28 aa, Artificial Sequence
  Description of Artificial Sequence: Synthetic peptide
DEVEICCTNPCATEQYGDVATDPNPGNY

SEQ ID NO: 39599 - protein, 34 aa, Artificial Sequence
  Description of Artificial Sequence: Synthetic polypeptide
AEEEIRTTNPVATEQYGVVDDTTNGLVQLVGEDR

SEQ ID NO: 39600 - protein, 30 aa, Artificial Sequence
  Description of Artificial Sequence: Synthetic polypeptide
DENEIRTTNPVATECWGSVSEEDENRNGDT

SEQ ID NO: 39601 - protein, 34 aa, Artificial Sequence
  Description of Artificial Sequence: Synthetic polypeptide
DEEEIRTTNPVATEQYGSVFCEMNPLCCAGFNDC

SEQ ID NO: 39602 - protein, 35 aa, Artificial Sequence
  Description of Artificial Sequence: Synthetic polypeptide
DEEEIRTTNPFATEQYGSVTSDTPNPLDLPEGENP

SEQ ID NO: 39603 - protein, 28 aa, Artificial Sequence
  Description of Artificial Sequence: Synthetic peptide
DEEEAASVNIIRTDSYGNVSNNLQRGNR

SEQ ID NO: 39604 - protein, 35 aa, Artificial Sequence
  Description of Artificial Sequence: Synthetic polypeptide
DEEEIRTTNPVATEQYGHSHVHQTPPDTLIRGENP

SEQ ID NO: 39605 - protein, 28 aa, Artificial Sequence
  Description of Artificial Sequence: Synthetic peptide
STEEIRTTNIVGTEEYGHTATNLQTANT

SEQ ID NO: 39606 - protein, 34 aa, Artificial Sequence
  Description of Artificial Sequence: Synthetic polypeptide
DEEEIRTTNPVATEQYGSASTCCPGQLFKGDNDN

SEQ ID NO: 39607 - protein, 28 aa, Artificial Sequence
  Description of Artificial Sequence: Synthetic peptide
DEEEIDTTNIYANNVYGIASTQVGRGNR

SEQ ID NO: 39608 - protein, 32 aa, Artificial Sequence
  Description of Artificial Sequence: Synthetic polypeptide
DENEIATTNPVATECYGSVSATDLQEHEGEDL

SEQ ID NO: 39609 - protein, 31 aa, Artificial Sequence
  Description of Artificial Sequence: Synthetic polypeptide
DEDEVKTTNPVATEPYGQVSADLLQRAGPQR

SEQ ID NO: 39610 - protein, 31 aa, Artificial Sequence
  Description of Artificial Sequence: Synthetic polypeptide
DEVEITTTNPVATEHYGGVSATGNPEIQGNF

SEQ ID NO: 39611 - protein, 29 aa, Artificial Sequence
  Description of Artificial Sequence: Synthetic peptide
DEQEIRTTNPVATECWGNVSENEMMQGTA

SEQ ID NO: 39612 - protein, 34 aa, Artificial Sequence
  Description of Artificial Sequence: Synthetic polypeptide
DEEEIRTTNPVATEQYGSVFCEMNPLCCAGDNDC

SEQ ID NO: 39613 - protein, 34 aa, Artificial Sequence
  Description of Artificial Sequence: Synthetic polypeptide
DEEEIRTTNPTATEQYGSVYSTLDLQDIEGDTTG

SEQ ID NO: 39614 - protein, 30 aa, Artificial Sequence
  Description of Artificial Sequence: Synthetic polypeptide
DEQEVRCTNPVASEIYGCVAANNLERNGNR

SEQ ID NO: 39615 - protein, 31 aa, Artificial Sequence
  Description of Artificial Sequence: Synthetic polypeptide
GEEEIATTNPVATEQYGEVAEDLDESEGNDR

SEQ ID NO: 39616 - protein, 28 aa, Artificial Sequence
  Description of Artificial Sequence: Synthetic peptide
DEEEIRNTSIVAQDQYGHVKTNLGRSTT

SEQ ID NO: 39617 - protein, 28 aa, Artificial Sequence
  Description of Artificial Sequence: Synthetic peptide
AEVEIAATNPVATENFGWVASNLQRGTI

SEQ ID NO: 39618 - protein, 28 aa, Artificial Sequence
  Description of Artificial Sequence: Synthetic peptide
EEEEIRFKNGVALDRYGSLSTNAEKGNR

SEQ ID NO: 39619 - protein, 28 aa, Artificial Sequence
  Description of Artificial Sequence: Synthetic peptide
AENEIAQTNPVATEQYGDVSTGDEHGEQ

SEQ ID NO: 39620 - protein, 28 aa, Artificial Sequence
  Description of Artificial Sequence: Synthetic peptide
DEDEINTTNGVATEVYGVVADNLQSSTT

SEQ ID NO: 39621 - protein, 34 aa, Artificial Sequence
  Description of Artificial Sequence: Synthetic polypeptide
DEEEIGTTNPVATEQYGSVSVENEGGGFRDGINH

SEQ ID NO: 39622 - protein, 32 aa, Artificial Sequence
  Description of Artificial Sequence: Synthetic polypeptide
DEEEIATTNPVATECYGSVSATDLEIINGEDL

SEQ ID NO: 39623 - protein, 28 aa, Artificial Sequence
  Description of Artificial Sequence: Synthetic peptide
DGDDIRTTNIVATDGYGSTSTNHWRANT

SEQ ID NO: 39624 - protein, 28 aa, Artificial Sequence
  Description of Artificial Sequence: Synthetic peptide
DEQEGATTNPVGTEVYGGVRTNLQNTTT

SEQ ID NO: 39625 - protein, 34 aa, Artificial Sequence
  Description of Artificial Sequence: Synthetic polypeptide
DEEEIATTNPVATEQYGSVSITGDQVENNGDNDS

SEQ ID NO: 39626 - protein, 30 aa, Artificial Sequence
  Description of Artificial Sequence: Synthetic polypeptide
DEEEIAATNPVASECYGSTSTEPLETGDNI

SEQ ID NO: 39627 - protein, 29 aa, Artificial Sequence
  Description of Artificial Sequence: Synthetic peptide
CEEEVAATNPCATEQYGCVSATTVQRGQF

SEQ ID NO: 39628 - protein, 36 aa, Artificial Sequence
  Description of Artificial Sequence: Synthetic polypeptide
DEEEIRTTNPVATEQYGSVCSETCPGVLDRKGTNDV

SEQ ID NO: 39629 - protein, 32 aa, Artificial Sequence
  Description of Artificial Sequence: Synthetic polypeptide
DEVEISTTNPVATEHFGGVSTANLPQIGNNWQ

SEQ ID NO: 39630 - protein, 36 aa, Artificial Sequence
  Description of Artificial Sequence: Synthetic polypeptide
DEEEIRTTNPFATEQYGSVTSITPGPLVDLRGDNPR

SEQ ID NO: 39631 - protein, 28 aa, Artificial Sequence
  Description of Artificial Sequence: Synthetic peptide
NEIEIVTTNPVSTEMYGNCSTLVQRLNT

SEQ ID NO: 39632 - protein, 30 aa, Artificial Sequence
  Description of Artificial Sequence: Synthetic polypeptide
MENEIATTNPVATECYGSVSEDLQDSGDDM

SEQ ID NO: 39633 - protein, 33 aa, Artificial Sequence
  Description of Artificial Sequence: Synthetic polypeptide
DEEEIATTNPVATEQYGDVSCEEEPDQQLGDNV

SEQ ID NO: 39634 - protein, 34 aa, Artificial Sequence
  Description of Artificial Sequence: Synthetic polypeptide
DEVEIRTTNPVATEAYGNVPSLTNNVDLDDGVNW

SEQ ID NO: 39635 - protein, 29 aa, Artificial Sequence
  Description of Artificial Sequence: Synthetic peptide
NDQEIRTTNPCATEVYGCVASNLEREPND

SEQ ID NO: 39636 - protein, 28 aa, Artificial Sequence
  Description of Artificial Sequence: Synthetic peptide
DEVEISTTNPEASENYGHVSTGQLVGPE

SEQ ID NO: 39637 - protein, 37 aa, Artificial Sequence
  Description of Artificial Sequence: Synthetic polypeptide
DEEEIRTTNPFATEQYGSVASVTLNNDTLVRKGDEPR

SEQ ID NO: 39638 - protein, 28 aa, Artificial Sequence
  Description of Artificial Sequence: Synthetic peptide
DEEEIATTNPVATRPYGGTRDNEQYQAT

SEQ ID NO: 39639 - protein, 29 aa, Artificial Sequence
  Description of Artificial Sequence: Synthetic peptide
DDSEVASTNPVSTEGYGNVANNLQRVGQR

SEQ ID NO: 39640 - protein, 28 aa, Artificial Sequence
  Description of Artificial Sequence: Synthetic peptide
DIEEIKTTNSVAEEHVGSVSDNMQSTGT

SEQ ID NO: 39641 - protein, 34 aa, Artificial Sequence
  Description of Artificial Sequence: Synthetic polypeptide
DEEEIRTTNPIATEQYGSVYSTEDGVQAQNEVTD

SEQ ID NO: 39642 - protein, 28 aa, Artificial Sequence
  Description of Artificial Sequence: Synthetic peptide
DEREIAFTNIVATEQSGSTTTNVDLGGT

SEQ ID NO: 39643 - protein, 28 aa, Artificial Sequence
  Description of Artificial Sequence: Synthetic peptide
DEEEIITNNIVHLDRYGSTSDNFLRGNQ

SEQ ID NO: 39644 - protein, 28 aa, Artificial Sequence
  Description of Artificial Sequence: Synthetic peptide
NEEEIKTVNIVATEEYSEVSDNILSGVR

SEQ ID NO: 39645 - protein, 28 aa, Artificial Sequence
  Description of Artificial Sequence: Synthetic peptide
DEVEIRTTNTIAFENVGAVHTNIDGGTR

SEQ ID NO: 39646 - protein, 28 aa, Artificial Sequence
  Description of Artificial Sequence: Synthetic peptide
KEEEINTTNIASTEHYGLVSDQLLSGNT

SEQ ID NO: 39647 - protein, 30 aa, Artificial Sequence
  Description of Artificial Sequence: Synthetic polypeptide
MENEIATTNPVATECYGSVSEDEQDHEGEQ

SEQ ID NO: 39648 - protein, 31 aa, Artificial Sequence
  Description of Artificial Sequence: Synthetic polypeptide
QEEEIRATNPVASEQYGVVGTDLQESDGMDN

SEQ ID NO: 39649 - protein, 28 aa, Artificial Sequence
  Description of Artificial Sequence: Synthetic peptide
DEEEIVTGNIVANEKVGLLSTNLGQKNT

SEQ ID NO: 39650 - protein, 28 aa, Artificial Sequence
  Description of Artificial Sequence: Synthetic peptide
REENLRTTNIVAMEHYGIVHDNLGSNNR

SEQ ID NO: 39651 - protein, 34 aa, Artificial Sequence
  Description of Artificial Sequence: Synthetic polypeptide
KEEEIRTTNPVATEIYGSVSCMGNWQYVDGENDC

SEQ ID NO: 39652 - protein, 28 aa, Artificial Sequence
  Description of Artificial Sequence: Synthetic peptide
DEQELTTSRIVATEQQGLVATILQNGNT

SEQ ID NO: 39653 - protein, 31 aa, Artificial Sequence
  Description of Artificial Sequence: Synthetic polypeptide
QEHEIATTNPVATEQYGWVSTNDEDFKGDDP

SEQ ID NO: 39654 - protein, 28 aa, Artificial Sequence
  Description of Artificial Sequence: Synthetic peptide
DEEEIRTTNIRGTEIYGKTATQLQNAAT

SEQ ID NO: 39655 - protein, 36 aa, Artificial Sequence
  Description of Artificial Sequence: Synthetic polypeptide
DEEEIRTTNPVATEQYGSVSDCTMGGLCCPEGENDD

SEQ ID NO: 39656 - protein, 37 aa, Artificial Sequence
  Description of Artificial Sequence: Synthetic polypeptide
DEEEIRTTNPDATEQYGSVCSVTLENGVIIRKGENLR

SEQ ID NO: 39657 - protein, 28 aa, Artificial Sequence
  Description of Artificial Sequence: Synthetic peptide
DEVEICCTNPCATEVYGDVATDPNPGNY

SEQ ID NO: 39658 - protein, 31 aa, Artificial Sequence
  Description of Artificial Sequence: Synthetic polypeptide
GDEEIATTNPVATEQYGEVAEDLDESEGNDR

SEQ ID NO: 39659 - protein, 32 aa, Artificial Sequence
  Description of Artificial Sequence: Synthetic polypeptide
DEVEIATTNPCATEPYGDVSCTDLQCQAGNDA

SEQ ID NO: 39660 - protein, 28 aa, Artificial Sequence
  Description of Artificial Sequence: Synthetic peptide
DEEGVNTTNIVTQEQVGSTSTQLQYLNG

SEQ ID NO: 39661 - protein, 29 aa, Artificial Sequence
  Description of Artificial Sequence: Synthetic peptide
SEEEINSVNPVATETYGTVATILQHAGMM

SEQ ID NO: 39662 - protein, 30 aa, Artificial Sequence
  Description of Artificial Sequence: Synthetic polypeptide
QEEEIATTNPVATEQYGEASAEVLQHAEEK

SEQ ID NO: 39663 - protein, 28 aa, Artificial Sequence
  Description of Artificial Sequence: Synthetic peptide
NEEEIKTTNPVDTDRYGTTATNLQSSTT

SEQ ID NO: 39664 - protein, 34 aa, Artificial Sequence
  Description of Artificial Sequence: Synthetic polypeptide
DNEEIRSTNPVATEQYGSVYNATNGEPQREGDPQ

SEQ ID NO: 39665 - protein, 32 aa, Artificial Sequence
  Description of Artificial Sequence: Synthetic polypeptide
SEVEIACTNPTATEQYGSVISEMNEQREGTDR

SEQ ID NO: 39666 - protein, 28 aa, Artificial Sequence
  Description of Artificial Sequence: Synthetic peptide
DIEEIATVNITATETYGSVSDNKQGLTT

SEQ ID NO: 39667 - protein, 28 aa, Artificial Sequence
  Description of Artificial Sequence: Synthetic peptide
QEGEIAPTNPCSSEQYGIVACNLQSGTR

SEQ ID NO: 39668 - protein, 28 aa, Artificial Sequence
  Description of Artificial Sequence: Synthetic peptide
DEEEIATTNPIATEVLGGTRDNLQYSTT

SEQ ID NO: 39669 - protein, 28 aa, Artificial Sequence
  Description of Artificial Sequence: Synthetic peptide
DNINIATTNIVDTEQYGSVDDQEGRGNG

SEQ ID NO: 39670 - protein, 32 aa, Artificial Sequence
  Description of Artificial Sequence: Synthetic polypeptide
QEEEIRATNPVATECYGSVSANDLEEHNGEDD

SEQ ID NO: 39671 - protein, 28 aa, Artificial Sequence
  Description of Artificial Sequence: Synthetic peptide
NEMAIETANNVALEHYGSTSDNLLSGNR

SEQ ID NO: 39672 - protein, 34 aa, Artificial Sequence
  Description of Artificial Sequence: Synthetic polypeptide
DEEEIATTNPVATEQYGDVSATTDGQQLVNGEND

SEQ ID NO: 39673 - protein, 32 aa, Artificial Sequence
  Description of Artificial Sequence: Synthetic polypeptide
DEHEIRTTNPCATEVYGDVSCEMDLCCHGNDR

SEQ ID NO: 39674 - protein, 28 aa, Artificial Sequence
  Description of Artificial Sequence: Synthetic peptide
SEQEVATTNIVATEQYGQTATNEQSQNT

SEQ ID NO: 39675 - protein, 34 aa, Artificial Sequence
  Description of Artificial Sequence: Synthetic polypeptide
AEEEIATTNPVATEQYGVVDDTTNGLVERGEEDR

SEQ ID NO: 39676 - protein, 32 aa, Artificial Sequence
  Description of Artificial Sequence: Synthetic polypeptide
DEEEIRTTNPVATEQYGSWSCDIPEQNNEEPS

SEQ ID NO: 39677 - protein, 28 aa, Artificial Sequence
  Description of Artificial Sequence: Synthetic peptide
DGEEVATNNIMKTENQGSTTTNLQAGNR

SEQ ID NO: 39678 - protein, 28 aa, Artificial Sequence
  Description of Artificial Sequence: Synthetic peptide
NEEEITTTNPVDTDRYGTTHTNLQSSTT

SEQ ID NO: 39679 - protein, 28 aa, Artificial Sequence
  Description of Artificial Sequence: Synthetic peptide
QEEEITATNPVGTECYGSVAENPAVGPH

SEQ ID NO: 39680 - protein, 34 aa, Artificial Sequence
  Description of Artificial Sequence: Synthetic polypeptide
SEEEIRATNPTATEQYGSVISEMNGEQDQEGNTR

SEQ ID NO: 39681 - protein, 33 aa, Artificial Sequence
  Description of Artificial Sequence: Synthetic polypeptide
SEEEIRTTNPTATEQFGSVISTMNEQESGDTDG

SEQ ID NO: 39682 - protein, 32 aa, Artificial Sequence
  Description of Artificial Sequence: Synthetic polypeptide
DEEEIATTNPTATEQYGEVSEMNEQCQGDDTF

SEQ ID NO: 39683 - protein, 32 aa, Artificial Sequence
  Description of Artificial Sequence: Synthetic polypeptide
QENEIATTNPVATECYGSVSDTDLEIHNGENQ

SEQ ID NO: 39684 - protein, 35 aa, Artificial Sequence
  Description of Artificial Sequence: Synthetic polypeptide
DEEEIRTTNPFATEQYGSVTSITPGPLVFPGLNPD

SEQ ID NO: 39685 - protein, 36 aa, Artificial Sequence
  Description of Artificial Sequence: Synthetic polypeptide
DEEEIRTTNPVATEQYGSVCSTTQGGLVLCEAGNLD

SEQ ID NO: 39686 - protein, 28 aa, Artificial Sequence
  Description of Artificial Sequence: Synthetic peptide
NDEEIRTTNGVAWEEFGQTATNLQSANT

SEQ ID NO: 39687 - protein, 28 aa, Artificial Sequence
  Description of Artificial Sequence: Synthetic peptide
DELQGTTTNIYATEQIGTVSTNDQRSTN

SEQ ID NO: 39688 - protein, 30 aa, Artificial Sequence
  Description of Artificial Sequence: Synthetic polypeptide
DEDEIATTNPVSSEIYGCVSASNLEFPPNR

SEQ ID NO: 39689 - protein, 32 aa, Artificial Sequence
  Description of Artificial Sequence: Synthetic polypeptide
DEEEIVTTNPVATECYGWVSETGPLEPKGDEV

SEQ ID NO: 39690 - protein, 33 aa, Artificial Sequence
  Description of Artificial Sequence: Synthetic polypeptide
DEQEIATTNPFATEQYGSVSITLNPDMSKGNPS

SEQ ID NO: 39691 - protein, 32 aa, Artificial Sequence
  Description of Artificial Sequence: Synthetic polypeptide
DEDEVKTTNPVATEPYGQVSADLLQNRAGPQR

SEQ ID NO: 39692 - protein, 28 aa, Artificial Sequence
  Description of Artificial Sequence: Synthetic peptide
DWEGIRTLNGVATCIVGSVSTGLGSTNT

SEQ ID NO: 39693 - protein, 32 aa, Artificial Sequence
  Description of Artificial Sequence: Synthetic polypeptide
SEGEIRTTNPVCTEQYGSVISTDGWPQTGTFA

SEQ ID NO: 39694 - protein, 28 aa, Artificial Sequence
  Description of Artificial Sequence: Synthetic peptide
AEQNLIQTNILATEQYGSVSDNVQAANR

SEQ ID NO: 39695 - protein, 28 aa, Artificial Sequence
  Description of Artificial Sequence: Synthetic peptide
DEENIEETNNVTNEQYGSISTQLLQANT

SEQ ID NO: 39696 - protein, 30 aa, Artificial Sequence
  Description of Artificial Sequence: Synthetic polypeptide
QENEIVTTNPVASECYGSVSTELEVTGEEQ

SEQ ID NO: 39697 - protein, 36 aa, Artificial Sequence
  Description of Artificial Sequence: Synthetic polypeptide
DEEEIRTTNPFATEQYGSVTSITPGPLVDLDGDNPR

SEQ ID NO: 39698 - protein, 34 aa, Artificial Sequence
  Description of Artificial Sequence: Synthetic polypeptide
DEEEIRTTNPFATEQYGSVSLTPPPLPFIDKGEP

SEQ ID NO: 39699 - protein, 30 aa, Artificial Sequence
  Description of Artificial Sequence: Synthetic polypeptide
DENEIRTTNPVATEQWGDVSEIEMNAAGDA

SEQ ID NO: 39700 - protein, 28 aa, Artificial Sequence
  Description of Artificial Sequence: Synthetic peptide
DEEEIRITNMVGWEEYGTVGDQLQALNT

SEQ ID NO: 39701 - protein, 33 aa, Artificial Sequence
  Description of Artificial Sequence: Synthetic polypeptide
DEVEIATTNPTATEQYGGVSTMNEQDQEGDNTF

SEQ ID NO: 39702 - protein, 32 aa, Artificial Sequence
  Description of Artificial Sequence: Synthetic polypeptide
SEEEIRTTNPTATEQYGEVSEGNPQDSGDTDI

SEQ ID NO: 39703 - protein, 34 aa, Artificial Sequence
  Description of Artificial Sequence: Synthetic polypeptide
DEEEIAQTNPVATEQYGSVSITGDQVENNGDNDS

SEQ ID NO: 39704 - protein, 30 aa, Artificial Sequence
  Description of Artificial Sequence: Synthetic polypeptide
VEDEIRTTNPVASEAYGCVGAMNLERNGTD

SEQ ID NO: 39705 - protein, 28 aa, Artificial Sequence
  Description of Artificial Sequence: Synthetic peptide
QEQEITATNPVASECYGWVSTDLEQGEA

SEQ ID NO: 39706 - protein, 33 aa, Artificial Sequence
  Description of Artificial Sequence: Synthetic polypeptide
DEEEIRTTNPDATEQYGSVFCENPLTDEIDGES

SEQ ID NO: 39707 - protein, 32 aa, Artificial Sequence
  Description of Artificial Sequence: Synthetic polypeptide
DEVEIATTNPTATEIFGSVSTNGEPQLEGDNQ

SEQ ID NO: 39708 - protein, 28 aa, Artificial Sequence
  Description of Artificial Sequence: Synthetic peptide
DNEEGNTTNIVATEVLFSTATNLGYGNT

SEQ ID NO: 39709 - protein, 28 aa, Artificial Sequence
  Description of Artificial Sequence: Synthetic peptide
DEEEIRTTNIVATEIWGQTADNIQDTTT

SEQ ID NO: 39710 - protein, 28 aa, Artificial Sequence
  Description of Artificial Sequence: Synthetic peptide
DERELHNNNIVAFEQLTSVTNNLQRGNN

SEQ ID NO: 39711 - protein, 32 aa, Artificial Sequence
  Description of Artificial Sequence: Synthetic polypeptide
DEHEIRTTNPVATEQYGVVDCEMDLCCHGNDA

SEQ ID NO: 39712 - protein, 35 aa, Artificial Sequence
  Description of Artificial Sequence: Synthetic polypeptide
DEEEIRTTNPVATEQYWSVEETPNPLQEDDGDEPP

SEQ ID NO: 39713 - protein, 28 aa, Artificial Sequence
  Description of Artificial Sequence: Synthetic peptide
QEEEICCTNPESTEQYGCVSVADQLGPH

SEQ ID NO: 39714 - protein, 28 aa, Artificial Sequence
  Description of Artificial Sequence: Synthetic peptide
DEESIASVNPVCTETYGSVVDNFQSGSQ

SEQ ID NO: 39715 - protein, 33 aa, Artificial Sequence
  Description of Artificial Sequence: Synthetic polypeptide
DEEEIRTTNPVATEQYGVVSLELDPVELNGIDS

SEQ ID NO: 39716 - protein, 33 aa, Artificial Sequence
  Description of Artificial Sequence: Synthetic polypeptide
DEEEIAATNPFATEQYGQVSIELNPQDRKGTNS

SEQ ID NO: 39717 - protein, 35 aa, Artificial Sequence
  Description of Artificial Sequence: Synthetic polypeptide
DEEEIRTTNPVATEQYGSVFCEMNPLCCADGDNDC

SEQ ID NO: 39718 - protein, 36 aa, Artificial Sequence
  Description of Artificial Sequence: Synthetic polypeptide
DEEEIRTTNPVATEQYGSVSSTTPAGPNMRNGMNPV

SEQ ID NO: 39719 - protein, 30 aa, Artificial Sequence
  Description of Artificial Sequence: Synthetic polypeptide
DEEEISTTNPVATEWWGSVDDADMFQGNDS

SEQ ID NO: 39720 - protein, 29 aa, Artificial Sequence
  Description of Artificial Sequence: Synthetic peptide
DEAEIAQTNPVATEMYGVTSCTLQSHGDY

SEQ ID NO: 39721 - protein, 28 aa, Artificial Sequence
  Description of Artificial Sequence: Synthetic peptide
QESEIATTNPVGTEGYGVMASTLQHGDI

SEQ ID NO: 39722 - protein, 33 aa, Artificial Sequence
  Description of Artificial Sequence: Synthetic polypeptide
SENEIRTTNPVATEQYGCSHYSEALQDQYGANP

SEQ ID NO: 39723 - protein, 33 aa, Artificial Sequence
  Description of Artificial Sequence: Synthetic polypeptide
DEVEIATTNPTATEQYGGVSEGNPQLQEGDNTN

SEQ ID NO: 39724 - protein, 34 aa, Artificial Sequence
  Description of Artificial Sequence: Synthetic polypeptide
DEEEIRTTNPEATEQYGSVSTLEPDQEHDGDEDW

SEQ ID NO: 39725 - protein, 28 aa, Artificial Sequence
  Description of Artificial Sequence: Synthetic peptide
SELELNATNIVATHQYGTDSDNLLRGNT

SEQ ID NO: 39726 - protein, 28 aa, Artificial Sequence
  Description of Artificial Sequence: Synthetic peptide
DEEEINTTNIVAFEQYYKASTYAGSGTT

SEQ ID NO: 39727 - protein, 31 aa, Artificial Sequence
  Description of Artificial Sequence: Synthetic polypeptide
MENEIATTNPVATEMYGVVSEDLQDTEGNDM

SEQ ID NO: 39728 - protein, 33 aa, Artificial Sequence
  Description of Artificial Sequence: Synthetic polypeptide
DEQEITTTNPVATEQYGVVSCEMNDQCEQGNDY

SEQ ID NO: 39729 - protein, 32 aa, Artificial Sequence
  Description of Artificial Sequence: Synthetic polypeptide
DENEIATTNPVATECYGVVSATDLQDQNGEDL

SEQ ID NO: 39730 - protein, 32 aa, Artificial Sequence
  Description of Artificial Sequence: Synthetic polypeptide
DEGEITTTNPVATECYGWVSTGELQIVNGEDT

SEQ ID NO: 39731 - protein, 28 aa, Artificial Sequence
  Description of Artificial Sequence: Synthetic peptide
DESETRTTNIVATEQYGTTVTVEQSSTT

SEQ ID NO: 39732 - protein, 28 aa, Artificial Sequence
  Description of Artificial Sequence: Synthetic peptide
DEEEVAITNIVATEQLGKTATNLQSSTT

SEQ ID NO: 39733 - protein, 28 aa, Artificial Sequence
  Description of Artificial Sequence: Synthetic peptide
DEEEIATTNPVAWEPYGGTADNEQNQTT

SEQ ID NO: 39734 - protein, 28 aa, Artificial Sequence
  Description of Artificial Sequence: Synthetic peptide
DEEEIATTNPVAWEVYGGTADNEQNQTT

SEQ ID NO: 39735 - protein, 28 aa, Artificial Sequence
  Description of Artificial Sequence: Synthetic peptide
DESEVATTNIVAWEQYGVVASNLQSKST

SEQ ID NO: 39736 - protein, 28 aa, Artificial Sequence
  Description of Artificial Sequence: Synthetic peptide
DEEAIRTTNRVGYEEFGYVVTNLQNATT

SEQ ID NO: 39737 - protein, 31 aa, Artificial Sequence
  Description of Artificial Sequence: Synthetic polypeptide
QEAEIASTNPVATECYGSVSEMALQERGDDP

SEQ ID NO: 39738 - protein, 28 aa, Artificial Sequence
  Description of Artificial Sequence: Synthetic peptide
DEEEINDTNIVANEVYGGVSDSHQRTDN

SEQ ID NO: 39739 - protein, 28 aa, Artificial Sequence
  Description of Artificial Sequence: Synthetic peptide
DEEEIATTNPVAWEPYGQTADNEQNQTT

SEQ ID NO: 39740 - protein, 28 aa, Artificial Sequence
  Description of Artificial Sequence: Synthetic peptide
DEQEVAATNPVGTEIYGGVATNLQNTTT

SEQ ID NO: 39741 - protein, 28 aa, Artificial Sequence
  Description of Artificial Sequence: Synthetic peptide
SEEEISSTNPDCTEQYGFASTGQQHGME

SEQ ID NO: 39742 - protein, 28 aa, Artificial Sequence
  Description of Artificial Sequence: Synthetic peptide
DEEEIATTRIIDTEQYGSTVENIQAGAT

SEQ ID NO: 39743 - protein, 28 aa, Artificial Sequence
  Description of Artificial Sequence: Synthetic peptide
QEEEIVTTNPVATEQYGEAPEVCQHEEK

SEQ ID NO: 39744 - protein, 34 aa, Artificial Sequence
  Description of Artificial Sequence: Synthetic polypeptide
DEEEIAQTNPVATEQYGSVSITGDQEENNGDNDS

SEQ ID NO: 39745 - protein, 34 aa, Artificial Sequence
  Description of Artificial Sequence: Synthetic polypeptide
DEEEIAQTNPVATEQYGSVSATTDQELDNGENDD

SEQ ID NO: 39746 - protein, 30 aa, Artificial Sequence
  Description of Artificial Sequence: Synthetic polypeptide
DEEEIATTNPVATEQYGEAPAEVLQHAEEK

SEQ ID NO: 39747 - protein, 33 aa, Artificial Sequence
  Description of Artificial Sequence: Synthetic polypeptide
DEEEIATTNPVATEQYGGVISEMNEPQDQEGDF

SEQ ID NO: 39748 - protein, 28 aa, Artificial Sequence
  Description of Artificial Sequence: Synthetic peptide
SEQEIRTTNIVGTEEYGTVAINLQNQSA

SEQ ID NO: 39749 - protein, 35 aa, Artificial Sequence
  Description of Artificial Sequence: Synthetic polypeptide
DEEEIRTTNPFATEQYGSVSITPGPLVCCDGFNPD

SEQ ID NO: 39750 - protein, 36 aa, Artificial Sequence
  Description of Artificial Sequence: Synthetic polypeptide
DEEEIRTTNPVATEQYGSVSTTDAGDVEIQEGENDD

SEQ ID NO: 39751 - protein, 28 aa, Artificial Sequence
  Description of Artificial Sequence: Synthetic peptide
SEVEIAATNPVATEIFGEVSENEQQGDF

SEQ ID NO: 39752 - protein, 28 aa, Artificial Sequence
  Description of Artificial Sequence: Synthetic peptide
DEEEIATTNPVAIEVYGGTRDNAQNQTT

SEQ ID NO: 39753 - protein, 28 aa, Artificial Sequence
  Description of Artificial Sequence: Synthetic peptide
DWDETATTNIVATEIVGSVRDSLQRGAM

SEQ ID NO: 39754 - protein, 28 aa, Artificial Sequence
  Description of Artificial Sequence: Synthetic peptide
DEEVLRTTNNVASEEQTSVATNLGTKAR

SEQ ID NO: 39755 - protein, 28 aa, Artificial Sequence
  Description of Artificial Sequence: Synthetic peptide
SEESIATTNIVGTKAYGSVADNEQNGNT

SEQ ID NO: 39756 - protein, 28 aa, Artificial Sequence
  Description of Artificial Sequence: Synthetic peptide
DENGISTGNIVATDQYGSHADNFQRNNG

SEQ ID NO: 39757 - protein, 35 aa, Artificial Sequence
  Description of Artificial Sequence: Synthetic polypeptide
DEEEIGTTNPVATEQYGSVSVENEGGGFRDGINFH

SEQ ID NO: 39758 - protein, 28 aa, Artificial Sequence
  Description of Artificial Sequence: Synthetic peptide
DEEEIATTNPVATRPYGGTRDNEQNQAT

SEQ ID NO: 39759 - protein, 28 aa, Artificial Sequence
  Description of Artificial Sequence: Synthetic peptide
DEEGLQNTQNVATEQYLTTSTNLQEKNG

SEQ ID NO: 39760 - protein, 34 aa, Artificial Sequence
  Description of Artificial Sequence: Synthetic polypeptide
DENEIAQTNPVATEQYGSVSVTGGLVEDRGDNDI

SEQ ID NO: 39761 - protein, 31 aa, Artificial Sequence
  Description of Artificial Sequence: Synthetic polypeptide
QETEIRSTNPCATEQYGSTATDGLQLDNGND

SEQ ID NO: 39762 - protein, 28 aa, Artificial Sequence
  Description of Artificial Sequence: Synthetic peptide
GEEEIRTTRIVATQEQGTTATNLQSSTT

SEQ ID NO: 39763 - protein, 34 aa, Artificial Sequence
  Description of Artificial Sequence: Synthetic polypeptide
DEEEIRTTNPFATEQYGSASTCCPGLLFKGDNDN

SEQ ID NO: 39764 - protein, 32 aa, Artificial Sequence
  Description of Artificial Sequence: Synthetic polypeptide
DEHEIRTTNPCATESYGSVSTEEWEPQELENG

SEQ ID NO: 39765 - protein, 28 aa, Artificial Sequence
  Description of Artificial Sequence: Synthetic peptide
DAEEIRTTNGIATSQIGKIDNQLGQGNR

SEQ ID NO: 39766 - protein, 28 aa, Artificial Sequence
  Description of Artificial Sequence: Synthetic peptide
DEEEIAPTNPVATEPYGGTRDNEQNQAT

SEQ ID NO: 39767 - protein, 28 aa, Artificial Sequence
  Description of Artificial Sequence: Synthetic peptide
DEGAIRTTNIVATLRYGSVASNVLAGTV

SEQ ID NO: 39768 - protein, 32 aa, Artificial Sequence
  Description of Artificial Sequence: Synthetic polypeptide
SEEEIYTTNPIATEQYGVVAATNLPQMSKELR

SEQ ID NO: 39769 - protein, 28 aa, Artificial Sequence
  Description of Artificial Sequence: Synthetic peptide
SEEEIRTTNRVAWEEYGRLANNLQNAST

SEQ ID NO: 39770 - protein, 33 aa, Artificial Sequence
  Description of Artificial Sequence: Synthetic polypeptide
DEEEIRTTNPCATEIYGSVFITMALEPVAGNDS

SEQ ID NO: 39771 - protein, 28 aa, Artificial Sequence
  Description of Artificial Sequence: Synthetic peptide
DEEEIRTNNAVATENIGGTTTMIRGGNV

SEQ ID NO: 39772 - protein, 28 aa, Artificial Sequence
  Description of Artificial Sequence: Synthetic peptide
SEEEIYATNPEATEHYGSVSNGPQHETV

SEQ ID NO: 39773 - protein, 30 aa, Artificial Sequence
  Description of Artificial Sequence: Synthetic polypeptide
DEIEICTTNPVATEGYGTCASVTALQGLMI

SEQ ID NO: 39774 - protein, 28 aa, Artificial Sequence
  Description of Artificial Sequence: Synthetic peptide
DEQEIRTDRIVGTEIQGSITTNLLGGNT

SEQ ID NO: 39775 - protein, 28 aa, Artificial Sequence
  Description of Artificial Sequence: Synthetic peptide
DEDEIATTNPVDTRPYGTTATNLQSSTT

SEQ ID NO: 39776 - protein, 36 aa, Artificial Sequence
  Description of Artificial Sequence: Synthetic polypeptide
DEEEIRTTNPVATEQYGSVISTMGGEPYLREGDNCF

SEQ ID NO: 39777 - protein, 28 aa, Artificial Sequence
  Description of Artificial Sequence: Synthetic peptide
DEEEIRTTNIVAWDQYGVTASNEQNAST

SEQ ID NO: 39778 - protein, 29 aa, Artificial Sequence
  Description of Artificial Sequence: Synthetic peptide
DENEIRCTNPVATEWWGIVSENEMMQGTA

SEQ ID NO: 39779 - protein, 32 aa, Artificial Sequence
  Description of Artificial Sequence: Synthetic polypeptide
DEVEISTTNPVSTEQYGSVSATVADVQIGETF

SEQ ID NO: 39780 - protein, 36 aa, Artificial Sequence
  Description of Artificial Sequence: Synthetic polypeptide
DEEEIRTTNPVATEQYGSVSITPNPLVFIDKGDEPP

SEQ ID NO: 39781 - protein, 28 aa, Artificial Sequence
  Description of Artificial Sequence: Synthetic peptide
DEEEIATTNPVAWEVYGGTRDNEQNQTT

SEQ ID NO: 39782 - protein, 28 aa, Artificial Sequence
  Description of Artificial Sequence: Synthetic peptide
DEEEIKITNIVAYESYGTTTGNLQNTNT

SEQ ID NO: 39783 - protein, 34 aa, Artificial Sequence
  Description of Artificial Sequence: Synthetic polypeptide
DEEEIRTTNPVATEQYGSVSTEDNGPEYYKEEEE

SEQ ID NO: 39784 - protein, 32 aa, Artificial Sequence
  Description of Artificial Sequence: Synthetic polypeptide
QEHEICTTNPCATECYGSVSDTDLQETNGNDM

SEQ ID NO: 39785 - protein, 28 aa, Artificial Sequence
  Description of Artificial Sequence: Synthetic peptide
DEEEANDTNIIANEQYTSVSDNLLRQTT

SEQ ID NO: 39786 - protein, 28 aa, Artificial Sequence
  Description of Artificial Sequence: Synthetic peptide
DEQTINTVNGITTEQYGSVSTSASAGNT

SEQ ID NO: 39787 - protein, 28 aa, Artificial Sequence
  Description of Artificial Sequence: Synthetic peptide
DSSEIRTTNSVATLIQGETSSNLLWGNG

SEQ ID NO: 39788 - protein, 33 aa, Artificial Sequence
  Description of Artificial Sequence: Synthetic polypeptide
SEEEIRTTNPTATEQFGSVSTANWQLIEGETDI

SEQ ID NO: 39789 - protein, 30 aa, Artificial Sequence
  Description of Artificial Sequence: Synthetic polypeptide
MENEIAATNPVATECYGSVSEDLQDSGDDM

SEQ ID NO: 39790 - protein, 28 aa, Artificial Sequence
  Description of Artificial Sequence: Synthetic peptide
DEEEVAATNIVSTEIQGELGTNLERANR

SEQ ID NO: 39791 - protein, 33 aa, Artificial Sequence
  Description of Artificial Sequence: Synthetic polypeptide
DEQEIATTNPVATECYGSVSATDLQEHEGEEDL

SEQ ID NO: 39792 - protein, 32 aa, Artificial Sequence
  Description of Artificial Sequence: Synthetic polypeptide
DEEEIVTTNPDATEQYGEVASEGGDLITGDNY

SEQ ID NO: 39793 - protein, 31 aa, Artificial Sequence
  Description of Artificial Sequence: Synthetic polypeptide
DENEIASTNPVASEQYGVVSTDLQDQNGEDL

SEQ ID NO: 39794 - protein, 28 aa, Artificial Sequence
  Description of Artificial Sequence: Synthetic peptide
DEAVIRTTNIGFWEQYGSVADNLQGAAT

SEQ ID NO: 39795 - protein, 28 aa, Artificial Sequence
  Description of Artificial Sequence: Synthetic peptide
DWQEINFTNIVTEEQYGSASTILGTGNG

SEQ ID NO: 39796 - protein, 28 aa, Artificial Sequence
  Description of Artificial Sequence: Synthetic peptide
VEEELNTTNGIDQDQYLSVTTNLQNGNG

SEQ ID NO: 39797 - protein, 31 aa, Artificial Sequence
  Description of Artificial Sequence: Synthetic polypeptide
VEDEIRTTNPVATEAYGCVGMNLEDRNLTER

SEQ ID NO: 39798 - protein, 31 aa, Artificial Sequence
  Description of Artificial Sequence: Synthetic polypeptide
VENEICTTNPVATECYGSVSDTELEIHGEEH

SEQ ID NO: 39799 - protein, 28 aa, Artificial Sequence
  Description of Artificial Sequence: Synthetic peptide
DEEEIATTNPVAIEVYGGTRDNAQYQAT

SEQ ID NO: 39800 - protein, 34 aa, Artificial Sequence
  Description of Artificial Sequence: Synthetic polypeptide
DEEEIRTTNPVATEQYGSVFCEMNDCCDDGFNPC

SEQ ID NO: 39801 - protein, 28 aa, Artificial Sequence
  Description of Artificial Sequence: Synthetic peptide
DEEEGRTVNIVATERWGSTHQNELRANT

SEQ ID NO: 39802 - protein, 28 aa, Artificial Sequence
  Description of Artificial Sequence: Synthetic peptide
DEEEITTTNPVDTDRWGTTSTNVQSSTT

SEQ ID NO: 39803 - protein, 33 aa, Artificial Sequence
  Description of Artificial Sequence: Synthetic polypeptide
DEEEIRTTNPVATEVYGSVGITEELEDNDGDEL

SEQ ID NO: 39804 - protein, 32 aa, Artificial Sequence
  Description of Artificial Sequence: Synthetic polypeptide
NETEIRTTNPVATETYGSVSDYCPPPQASGNS

SEQ ID NO: 39805 - protein, 32 aa, Artificial Sequence
  Description of Artificial Sequence: Synthetic polypeptide
DEQEIATTNPVATECYGSVSATDLEIINGEDL

SEQ ID NO: 39806 - protein, 28 aa, Artificial Sequence
  Description of Artificial Sequence: Synthetic peptide
SEEEINTTNIVATRQNLTVSDQIQRYNS

SEQ ID NO: 39807 - protein, 28 aa, Artificial Sequence
  Description of Artificial Sequence: Synthetic peptide
DENEIAQTNPCSTEQYGVVSEDQERGEA

SEQ ID NO: 39808 - protein, 33 aa, Artificial Sequence
  Description of Artificial Sequence: Synthetic polypeptide
DEEEIRTTNPVATEQYGDVSCEMDLCCHAENDA

SEQ ID NO: 39809 - protein, 28 aa, Artificial Sequence
  Description of Artificial Sequence: Synthetic peptide
DEEEIRTTNGYATKEFGVVVDNEQSQNE

SEQ ID NO: 39810 - protein, 28 aa, Artificial Sequence
  Description of Artificial Sequence: Synthetic peptide
DEEEITTTNPVDTDRYGTTHTNVQSSTT

SEQ ID NO: 39811 - protein, 30 aa, Artificial Sequence
  Description of Artificial Sequence: Synthetic polypeptide
QEGEITATNPVATECFGSVSVGNLQQGPDP

SEQ ID NO: 39812 - protein, 28 aa, Artificial Sequence
  Description of Artificial Sequence: Synthetic peptide
SEGEIATTNPIATENYGEVSVNWIQGPQ

SEQ ID NO: 39813 - protein, 32 aa, Artificial Sequence
  Description of Artificial Sequence: Synthetic polypeptide
DEGEITATNPVATECFGSVISTGNWQQGPDDR

SEQ ID NO: 39814 - protein, 32 aa, Artificial Sequence
  Description of Artificial Sequence: Synthetic polypeptide
DEQEITTTNPCATEQYGVVSCTADQCEQGNDY

SEQ ID NO: 39815 - protein, 28 aa, Artificial Sequence
  Description of Artificial Sequence: Synthetic peptide
DEQEGAATNPVGTEVYGGVRTNLQNTTT

SEQ ID NO: 39816 - protein, 34 aa, Artificial Sequence
  Description of Artificial Sequence: Synthetic polypeptide
NEEEIRTTNPCATEQYGSVSTGEGDQEQQDGNDC

SEQ ID NO: 39817 - protein, 28 aa, Artificial Sequence
  Description of Artificial Sequence: Synthetic peptide
DEEVISTSNGVATEMLGGVNDNISRGNT

SEQ ID NO: 39818 - protein, 33 aa, Artificial Sequence
  Description of Artificial Sequence: Synthetic polypeptide
DESEIRTTNPVATECWGSVSCINEPQDHEGENG

SEQ ID NO: 39819 - protein, 28 aa, Artificial Sequence
  Description of Artificial Sequence: Synthetic peptide
DWAEIRTNNIVAREQQTSNNTNIQSGNG

SEQ ID NO: 39820 - protein, 28 aa, Artificial Sequence
  Description of Artificial Sequence: Synthetic peptide
DEDEITTTNPIDTRPYGTTSTNLQSSTT

SEQ ID NO: 39821 - protein, 28 aa, Artificial Sequence
  Description of Artificial Sequence: Synthetic peptide
DEQGARFNNIVATEEYGLVSDQLGRGGR

SEQ ID NO: 39822 - protein, 33 aa, Artificial Sequence
  Description of Artificial Sequence: Synthetic polypeptide
DENEIAQTNPVATEQYGSVSTGGPVEDRGDNDI

SEQ ID NO: 39823 - protein, 28 aa, Artificial Sequence
  Description of Artificial Sequence: Synthetic peptide
DEGEIQTTNIVTTLQYGSVGSNLITRAG

SEQ ID NO: 39824 - protein, 28 aa, Artificial Sequence
  Description of Artificial Sequence: Synthetic peptide
DGEGIRTANIVATDQYTSVTDRCLRGND

SEQ ID NO: 39825 - protein, 28 aa, Artificial Sequence
  Description of Artificial Sequence: Synthetic peptide
DEEEIVTTNPVSTECFGVVSTSGCCPEI

SEQ ID NO: 39826 - protein, 28 aa, Artificial Sequence
  Description of Artificial Sequence: Synthetic peptide
DEENISTENITATEHVGSVATYIQSGNT

SEQ ID NO: 39827 - protein, 31 aa, Artificial Sequence
  Description of Artificial Sequence: Synthetic polypeptide
DDEEIRCTNPIAYEIYGAVGASNLERNGNDR

SEQ ID NO: 39828 - protein, 32 aa, Artificial Sequence
  Description of Artificial Sequence: Synthetic polypeptide
DEEEIRTTNPVATEQYGVVSELDPVELNGIDS

SEQ ID NO: 39829 - protein, 32 aa, Artificial Sequence
  Description of Artificial Sequence: Synthetic polypeptide
DEEEIRTTNPIATEQYGATWSNAENWAPGNYI

SEQ ID NO: 39830 - protein, 34 aa, Artificial Sequence
  Description of Artificial Sequence: Synthetic polypeptide
DEEEISCTNPDATEQYGWVASLTTNLQQDDGIND

SEQ ID NO: 39831 - protein, 33 aa, Artificial Sequence
  Description of Artificial Sequence: Synthetic polypeptide
AEQEIVTTNPVATEQYGEVSTGNPLESINGVNQ

SEQ ID NO: 39832 - protein, 28 aa, Artificial Sequence
  Description of Artificial Sequence: Synthetic peptide
DIEEITTNNNVATENEGSLATNLERLTN

SEQ ID NO: 39833 - protein, 31 aa, Artificial Sequence
  Description of Artificial Sequence: Synthetic polypeptide
DEEEIWTTNPVATEGYGVVCSNCILDLKGEQ

SEQ ID NO: 39834 - protein, 28 aa, Artificial Sequence
  Description of Artificial Sequence: Synthetic peptide
NEQEIRTTNIVATEEYGKVADNEQNSTT

SEQ ID NO: 39835 - protein, 30 aa, Artificial Sequence
  Description of Artificial Sequence: Synthetic polypeptide
DENEIRTTNPVATECWGSYSEEDENRNGDT

SEQ ID NO: 39836 - protein, 36 aa, Artificial Sequence
  Description of Artificial Sequence: Synthetic polypeptide
DEEEIRTTNPFATEQYGSVSVTEAGPVDLRNGENPR

SEQ ID NO: 39837 - protein, 28 aa, Artificial Sequence
  Description of Artificial Sequence: Synthetic peptide
QEEEIATTNPVATEQYGEAPEVCQHEEK

SEQ ID NO: 39838 - protein, 33 aa, Artificial Sequence
  Description of Artificial Sequence: Synthetic polypeptide
DEMEIVTTNPVATEQYGSVCSATDGPVEFEGND

SEQ ID NO: 39839 - protein, 28 aa, Artificial Sequence
  Description of Artificial Sequence: Synthetic peptide
DEEEINQTNITATSIYGQLSWNLQRSTG

SEQ ID NO: 39840 - protein, 29 aa, Artificial Sequence
  Description of Artificial Sequence: Synthetic peptide
QEQEIATVNPVSTEVYGEVSEVLQHAGGR

SEQ ID NO: 39841 - protein, 28 aa, Artificial Sequence
  Description of Artificial Sequence: Synthetic peptide
HETEICSTNPVATEVYGNVAMLLQQGQI

SEQ ID NO: 39842 - protein, 34 aa, Artificial Sequence
  Description of Artificial Sequence: Synthetic polypeptide
SEEEIRTTNPVATEQFGEVISTMNLPQIEGIDTA

SEQ ID NO: 39843 - protein, 28 aa, Artificial Sequence
  Description of Artificial Sequence: Synthetic peptide
DEQNIEDTNIVATEHYGSTSTSVGRGAT

SEQ ID NO: 39844 - protein, 31 aa, Artificial Sequence
  Description of Artificial Sequence: Synthetic polypeptide
DEVEIAATNPTATEQFGGVSTNPQLREGTTN

SEQ ID NO: 39845 - protein, 28 aa, Artificial Sequence
  Description of Artificial Sequence: Synthetic peptide
DEEFGVQTNSVRTDHLGSVSTNLQGGAT

SEQ ID NO: 39846 - protein, 33 aa, Artificial Sequence
  Description of Artificial Sequence: Synthetic polypeptide
DEVEIATTNPTATEQYGSVISENEQDREGDTTF

SEQ ID NO: 39847 - protein, 28 aa, Artificial Sequence
  Description of Artificial Sequence: Synthetic peptide
DEEEIQQLNIIANEQWGTVSDNLIGGNS

SEQ ID NO: 39848 - protein, 33 aa, Artificial Sequence
  Description of Artificial Sequence: Synthetic polypeptide
SEEEIRTTNPVATETFGSVISACNGPQNGINTV

SEQ ID NO: 39849 - protein, 28 aa, Artificial Sequence
  Description of Artificial Sequence: Synthetic peptide
FEHELCAVNPVATEPWGCVSENVQRGNT

SEQ ID NO: 39850 - protein, 31 aa, Artificial Sequence
  Description of Artificial Sequence: Synthetic polypeptide
DEEEIVATNPVSTELYGVVSCENEQQEGNDL

SEQ ID NO: 39851 - protein, 28 aa, Artificial Sequence
  Description of Artificial Sequence: Synthetic peptide
AENEIAQTNPVATEQYGVVSEDQEDGEA

SEQ ID NO: 39852 - protein, 36 aa, Artificial Sequence
  Description of Artificial Sequence: Synthetic polypeptide
DEEEIRTTNPFATEQYGSVCSITPNPLVQIDKGDEP

SEQ ID NO: 39853 - protein, 28 aa, Artificial Sequence
  Description of Artificial Sequence: Synthetic peptide
DEENIRYTNEVATEQESTTHTRLLRANN

SEQ ID NO: 39854 - protein, 34 aa, Artificial Sequence
  Description of Artificial Sequence: Synthetic polypeptide
DEEEIRTTNPTATEQYGSVYSALDLQDIEGDTTG

SEQ ID NO: 39855 - protein, 35 aa, Artificial Sequence
  Description of Artificial Sequence: Synthetic polypeptide
DEEEIRQTNPVATEQYGSVSVTPNPVQENKGDEDF

SEQ ID NO: 39856 - protein, 28 aa, Artificial Sequence
  Description of Artificial Sequence: Synthetic peptide
DEEEIATTNNVATRPYGGTRDNLQYQAT

SEQ ID NO: 39857 - protein, 28 aa, Artificial Sequence
  Description of Artificial Sequence: Synthetic peptide
VEEEIDTTNIVATENYGCTSTTIGIANT

SEQ ID NO: 39858 - protein, 28 aa, Artificial Sequence
  Description of Artificial Sequence: Synthetic peptide
MENEIAQTNPVATENYGQASTPQELGND

SEQ ID NO: 39859 - protein, 28 aa, Artificial Sequence
  Description of Artificial Sequence: Synthetic peptide
DEEEINTTNIVRNEHYGSNHDNALGGTR

SEQ ID NO: 39860 - protein, 33 aa, Artificial Sequence
  Description of Artificial Sequence: Synthetic polypeptide
DEEEIRTTNPVATEQYGDVSCEMDLCCHAENDQ

SEQ ID NO: 39861 - protein, 33 aa, Artificial Sequence
  Description of Artificial Sequence: Synthetic polypeptide
DEEEIAQTNPVATEQYGSVSITDQEENNGDNDS

SEQ ID NO: 39862 - protein, 33 aa, Artificial Sequence
  Description of Artificial Sequence: Synthetic polypeptide
SEEEIRATNPVATEQFGSVSEMNPQLIEGDNDF

SEQ ID NO: 39863 - protein, 28 aa, Artificial Sequence
  Description of Artificial Sequence: Synthetic peptide
SEEEIRTTNPCAHMFFGCVSTGLDIGTE

SEQ ID NO: 39864 - protein, 28 aa, Artificial Sequence
  Description of Artificial Sequence: Synthetic peptide
SEEEIMCTNPIATEIFGVVSTDVQSGLL

SEQ ID NO: 39865 - protein, 32 aa, Artificial Sequence
  Description of Artificial Sequence: Synthetic polypeptide
KEEEIRTTNPVATECYGHVSTGQNQDYKENEL

SEQ ID NO: 39866 - protein, 31 aa, Artificial Sequence
  Description of Artificial Sequence: Synthetic polypeptide
DETEIRTTNPIATECYGATATEDLQEPKGNI

SEQ ID NO: 39867 - protein, 28 aa, Artificial Sequence
  Description of Artificial Sequence: Synthetic peptide
DEEEIRSTNGFAYEIYGMTATNLTNVNT

SEQ ID NO: 39868 - protein, 29 aa, Artificial Sequence
  Description of Artificial Sequence: Synthetic peptide
AEAELNTTNPVATECYGEVSANNVQRPPH

SEQ ID NO: 39869 - protein, 34 aa, Artificial Sequence
  Description of Artificial Sequence: Synthetic polypeptide
DEEEIAQTNPVATEQYGSVSTTPQVELEEGENDT

SEQ ID NO: 39870 - protein, 28 aa, Artificial Sequence
  Description of Artificial Sequence: Synthetic peptide
DWGEIRTSNDYDTEQYGNVSTGLGYGAG

SEQ ID NO: 39871 - protein, 28 aa, Artificial Sequence
  Description of Artificial Sequence: Synthetic peptide
DTEEVNTTNGFAWDQLASVSTNIRRGNG

SEQ ID NO: 39872 - protein, 28 aa, Artificial Sequence
  Description of Artificial Sequence: Synthetic peptide
QEEEITATNPVATECFGTVSADWQQGTS

SEQ ID NO: 39873 - protein, 32 aa, Artificial Sequence
  Description of Artificial Sequence: Synthetic polypeptide
QEEEIATTNPVATECYGSVSATDLEEHNGEDD

SEQ ID NO: 39874 - protein, 28 aa, Artificial Sequence
  Description of Artificial Sequence: Synthetic peptide
DEQGIRTTNIVATDQQTRVSTQDQYGTT

SEQ ID NO: 39875 - protein, 28 aa, Artificial Sequence
  Description of Artificial Sequence: Synthetic peptide
DEQEIDTTNIVATENWGSLADNLDSSND

SEQ ID NO: 39876 - protein, 28 aa, Artificial Sequence
  Description of Artificial Sequence: Synthetic peptide
DESEIATTNVLITSEYGLVVNNLQNGNT

SEQ ID NO: 39877 - protein, 33 aa, Artificial Sequence
  Description of Artificial Sequence: Synthetic polypeptide
QEEEIATTNPVATECYGVVSETNLQETNGEDDP

SEQ ID NO: 39878 - protein, 28 aa, Artificial Sequence
  Description of Artificial Sequence: Synthetic peptide
SEVEIAATNPTATEQFGEVSENEQQGDF

SEQ ID NO: 39879 - protein, 28 aa, Artificial Sequence
  Description of Artificial Sequence: Synthetic peptide
DEEEINNTLIVATEGLLGTSNNFQGGNR

SEQ ID NO: 39880 - protein, 33 aa, Artificial Sequence
  Description of Artificial Sequence: Synthetic polypeptide
QEEEIATTNPVATECYGSVSATDLQDTKGEEDP

SEQ ID NO: 39881 - protein, 28 aa, Artificial Sequence
  Description of Artificial Sequence: Synthetic peptide
NEGEIECTNPCASESWGTVATNLQRGMM

SEQ ID NO: 39882 - protein, 28 aa, Artificial Sequence
  Description of Artificial Sequence: Synthetic peptide
SEEALSQNNIYATEQYGTVSTNLLGGNT

SEQ ID NO: 39883 - protein, 32 aa, Artificial Sequence
  Description of Artificial Sequence: Synthetic polypeptide
YEEEIRCTNPVCTEQYGSVSNGNDEVYNGENS

SEQ ID NO: 39884 - protein, 28 aa, Artificial Sequence
  Description of Artificial Sequence: Synthetic peptide
DEEEIRTTLITATDNYSSVSTIIGSTND

SEQ ID NO: 39885 - protein, 35 aa, Artificial Sequence
  Description of Artificial Sequence: Synthetic polypeptide
DEEEIRTTNPFATEQYGSVTSITPGPLVDLPGDND

SEQ ID NO: 39886 - protein, 37 aa, Artificial Sequence
  Description of Artificial Sequence: Synthetic polypeptide
DEEEIRTTNPVATEQYGSYVSSITGPLNQVYDGDNPN

SEQ ID NO: 39887 - protein, 31 aa, Artificial Sequence
  Description of Artificial Sequence: Synthetic polypeptide
DEEEIRTTNPVATEQWGDHYSEIEMNQAGDA

SEQ ID NO: 39888 - protein, 28 aa, Artificial Sequence
  Description of Artificial Sequence: Synthetic peptide
DEEEINAASNVATEHEGSVTDNLQGKNE

SEQ ID NO: 39889 - protein, 28 aa, Artificial Sequence
  Description of Artificial Sequence: Synthetic peptide
SDEEIATTNPTATEMYGAVNTGPMVGNS

SEQ ID NO: 39890 - protein, 35 aa, Artificial Sequence
  Description of Artificial Sequence: Synthetic polypeptide
DEEEIRTTNPFATEQYGSVSITPGPLVDLPGDNPD

SEQ ID NO: 39891 - protein, 28 aa, Artificial Sequence
  Description of Artificial Sequence: Synthetic peptide
DEEEINTTNIVTRRQYGGTGTNARRQNN

SEQ ID NO: 39892 - protein, 35 aa, Artificial Sequence
  Description of Artificial Sequence: Synthetic polypeptide
DEEEIRTTNPVATEQYGSVSVTIPPVQDIKGDEPM

SEQ ID NO: 39893 - protein, 34 aa, Artificial Sequence
  Description of Artificial Sequence: Synthetic polypeptide
DEEEIAQTNPVATEQYGSVSATTGQELDNGENDD

SEQ ID NO: 39894 - protein, 31 aa, Artificial Sequence
  Description of Artificial Sequence: Synthetic polypeptide
KEEEIATTNPVATEQYGEVSEDLQEAQEEDM

SEQ ID NO: 39895 - protein, 36 aa, Artificial Sequence
  Description of Artificial Sequence: Synthetic polypeptide
DEEEIRTTNPVATEQYGSVSSLTMEGLVESEGENLQ

SEQ ID NO: 39896 - protein, 28 aa, Artificial Sequence
  Description of Artificial Sequence: Synthetic peptide
DEQEIAITNIVATKQFGTVATNEQRSAE

SEQ ID NO: 39897 - protein, 35 aa, Artificial Sequence
  Description of Artificial Sequence: Synthetic polypeptide
DEEEIRTTNPVATEQYGSVISATENPDAINDTHDG

SEQ ID NO: 39898 - protein, 36 aa, Artificial Sequence
  Description of Artificial Sequence: Synthetic polypeptide
DEQEIRTTNPVATEQYGSVQSLTDTLAQIQDEGNNI

SEQ ID NO: 39899 - protein, 31 aa, Artificial Sequence
  Description of Artificial Sequence: Synthetic polypeptide
MENEIRTTNPVATECYGSVADELQEVEGEDL

SEQ ID NO: 39900 - protein, 28 aa, Artificial Sequence
  Description of Artificial Sequence: Synthetic peptide
DEENLNTTNISATENLGSVSTNNQNKAQ

SEQ ID NO: 39901 - protein, 30 aa, Artificial Sequence
  Description of Artificial Sequence: Synthetic polypeptide
DENEIRTTNPVATECWGIYSENDENGGDDR

SEQ ID NO: 39902 - protein, 31 aa, Artificial Sequence
  Description of Artificial Sequence: Synthetic polypeptide
QEQEIATVNPVSTEQYGEASATVLQSRAGGR

SEQ ID NO: 39903 - protein, 28 aa, Artificial Sequence
  Description of Artificial Sequence: Synthetic peptide
DEEEIRITNIVATERYGYTANEQQQSNI

SEQ ID NO: 39904 - protein, 33 aa, Artificial Sequence
  Description of Artificial Sequence: Synthetic polypeptide
DEEEIAQTNPVATEQYGSVSTDPVQEIKGVEDL

SEQ ID NO: 39905 - protein, 36 aa, Artificial Sequence
  Description of Artificial Sequence: Synthetic polypeptide
DEEEIRTTNPVATEQYGSVCDETCPGVLDRKGTNDV

SEQ ID NO: 39906 - protein, 35 aa, Artificial Sequence
  Description of Artificial Sequence: Synthetic polypeptide
DEEEIRTTNPVATEQYGSVISATENPDAINGTHDG

SEQ ID NO: 39907 - protein, 34 aa, Artificial Sequence
  Description of Artificial Sequence: Synthetic polypeptide
DEEEIRTTNPEATEQYGSVSSPTEAQVEADEGDF

SEQ ID NO: 39908 - protein, 28 aa, Artificial Sequence
  Description of Artificial Sequence: Synthetic peptide
DEEETNTTNPIDTRQLGTVSDNVQGSNT

SEQ ID NO: 39909 - protein, 34 aa, Artificial Sequence
  Description of Artificial Sequence: Synthetic polypeptide
DEEEIAQTNPVATEQYGSVSATTDQELVNGENDD

SEQ ID NO: 39910 - protein, 28 aa, Artificial Sequence
  Description of Artificial Sequence: Synthetic peptide
DAEGVITNNDVTTEVYGTVRTNLSAGNR

SEQ ID NO: 39911 - protein, 32 aa, Artificial Sequence
  Description of Artificial Sequence: Synthetic polypeptide
DENEIRTTNPVSTEPYGTVSMENIQQQQNGNH

SEQ ID NO: 39912 - protein, 28 aa, Artificial Sequence
  Description of Artificial Sequence: Synthetic peptide
QENEIATTNPVATECYGDVPECLQHEEL

SEQ ID NO: 39913 - protein, 28 aa, Artificial Sequence
  Description of Artificial Sequence: Synthetic peptide
NDEEIRTTNATRAENYGSVSDNLGYTNG

SEQ ID NO: 39914 - protein, 28 aa, Artificial Sequence
  Description of Artificial Sequence: Synthetic peptide
DEEEIGNTNIVIWSQYGNVWTNIYRGGG

SEQ ID NO: 39915 - protein, 32 aa, Artificial Sequence
  Description of Artificial Sequence: Synthetic polypeptide
DEQEIATTNPVATECYGSVSATDLEEHEGEDL

SEQ ID NO: 39916 - protein, 28 aa, Artificial Sequence
  Description of Artificial Sequence: Synthetic peptide
DESEQNNNNIVATEQIGGVSTNAGSGNI

SEQ ID NO: 39917 - protein, 28 aa, Artificial Sequence
  Description of Artificial Sequence: Synthetic peptide
SEEETRITNIVATEHTGSVATNQQNSST

SEQ ID NO: 39918 - protein, 28 aa, Artificial Sequence
  Description of Artificial Sequence: Synthetic peptide
DEEELRTNLITATEQYGRVNDHLGRTGR

SEQ ID NO: 39919 - protein, 28 aa, Artificial Sequence
  Description of Artificial Sequence: Synthetic peptide
DEQEIRTTSDVAWDEYGYVSSNEQSTNT

SEQ ID NO: 39920 - protein, 29 aa, Artificial Sequence
  Description of Artificial Sequence: Synthetic peptide
DEAEICATNPVATEVYGSCSDVVQHAGPM

SEQ ID NO: 39921 - protein, 28 aa, Artificial Sequence
  Description of Artificial Sequence: Synthetic peptide
DEEEIAITNIVAWKQYGQTATNLQNATT

SEQ ID NO: 39922 - protein, 28 aa, Artificial Sequence
  Description of Artificial Sequence: Synthetic peptide
DEEEIRTTNPFATEQYWSWEDPDDPEEP

SEQ ID NO: 39923 - protein, 35 aa, Artificial Sequence
  Description of Artificial Sequence: Synthetic polypeptide
DETEIRTTNPVATEQYGSVSDTLADQQMSKGEEPR

SEQ ID NO: 39924 - protein, 33 aa, Artificial Sequence
  Description of Artificial Sequence: Synthetic polypeptide
DEVEIATTNPTATEQYGSVSEMNEQDQEGDNDF

SEQ ID NO: 39925 - protein, 33 aa, Artificial Sequence
  Description of Artificial Sequence: Synthetic polypeptide
HEEEIMTTNPVATEQYGGVNTGNWPQMQGANTE

SEQ ID NO: 39926 - protein, 28 aa, Artificial Sequence
  Description of Artificial Sequence: Synthetic peptide
DEQEIQTNNIVATENYLSVSNNDARATT

SEQ ID NO: 39927 - protein, 28 aa, Artificial Sequence
  Description of Artificial Sequence: Synthetic peptide
DEEEINITNIVATEIYGVVAANEQSASS

SEQ ID NO: 39928 - protein, 33 aa, Artificial Sequence
  Description of Artificial Sequence: Synthetic polypeptide
DEEEIRTTNPVATEQYGDVSECPVQEHAGVEDL

SEQ ID NO: 39929 - protein, 36 aa, Artificial Sequence
  Description of Artificial Sequence: Synthetic polypeptide
DEEEIRTTNPVATEQYGSVSTTDAGDVEIREGENDD

SEQ ID NO: 39930 - protein, 28 aa, Artificial Sequence
  Description of Artificial Sequence: Synthetic peptide
DNEEISTNNGLRTEHYGSWSDNHQGKNR

SEQ ID NO: 39931 - protein, 28 aa, Artificial Sequence
  Description of Artificial Sequence: Synthetic peptide
DEEEIRTNNIVSNRHSGSDHTNIQGRNR

SEQ ID NO: 39932 - protein, 28 aa, Artificial Sequence
  Description of Artificial Sequence: Synthetic peptide
DEEETNTTNPIDTLQLGTVSDNVQGSNT

SEQ ID NO: 39933 - protein, 28 aa, Artificial Sequence
  Description of Artificial Sequence: Synthetic peptide
DEFEIAATNPVGTEMFGTVSDAEQIGTR

SEQ ID NO: 39934 - protein, 28 aa, Artificial Sequence
  Description of Artificial Sequence: Synthetic peptide
QENEIATTNPVATECYGDVPECLQHEEN

SEQ ID NO: 39935 - protein, 28 aa, Artificial Sequence
  Description of Artificial Sequence: Synthetic peptide
NEEEIKTTNIVGTEQYGVTARNLQNSTT

SEQ ID NO: 39936 - protein, 32 aa, Artificial Sequence
  Description of Artificial Sequence: Synthetic polypeptide
DEQEIATTNPVATECYGSVSATDLEDHEGEDL

SEQ ID NO: 39937 - protein, 32 aa, Artificial Sequence
  Description of Artificial Sequence: Synthetic polypeptide
QENEIVATNPVATECYGVVSTNLEMREGENDD

SEQ ID NO: 39938 - protein, 28 aa, Artificial Sequence
  Description of Artificial Sequence: Synthetic peptide
DEEEIQNTNDIETERYGRRATQLQYGND

SEQ ID NO: 39939 - protein, 28 aa, Artificial Sequence
  Description of Artificial Sequence: Synthetic peptide
DEDEIGSTNPVSYEWWGSVSTALMPGTM

SEQ ID NO: 39940 - protein, 34 aa, Artificial Sequence
  Description of Artificial Sequence: Synthetic polypeptide
DEEEIRTTNPIATECYGSVCSDTGNLQDQEDEEY

SEQ ID NO: 39941 - protein, 28 aa, Artificial Sequence
  Description of Artificial Sequence: Synthetic peptide
DEVEIASTNPVGTEQYGIIPTNEEHFNG

SEQ ID NO: 39942 - protein, 28 aa, Artificial Sequence
  Description of Artificial Sequence: Synthetic peptide
REEEIRTTNGVAWESIGKVVDNLQNSTT

SEQ ID NO: 39943 - protein, 35 aa, Artificial Sequence
  Description of Artificial Sequence: Synthetic polypeptide
DEEEIRQTNPVATEQYGSVSITCAPVQEAKGDNDT

SEQ ID NO: 39944 - protein, 28 aa, Artificial Sequence
  Description of Artificial Sequence: Synthetic peptide
DEDHIRTTNRVITEQLDQVATNEQSSNT

SEQ ID NO: 39945 - protein, 28 aa, Artificial Sequence
  Description of Artificial Sequence: Synthetic peptide
YDHELATTNPCSTESYGCVCTNWQRENR

SEQ ID NO: 39946 - protein, 31 aa, Artificial Sequence
  Description of Artificial Sequence: Synthetic polypeptide
QETEIRSTNPCATEQYGSTASDGLQLDNGND

SEQ ID NO: 39947 - protein, 28 aa, Artificial Sequence
  Description of Artificial Sequence: Synthetic peptide
SEEEIKTTNIVANEEYGYVSNDLQNTTT

SEQ ID NO: 39948 - protein, 33 aa, Artificial Sequence
  Description of Artificial Sequence: Synthetic polypeptide
DEVEIATTNPTATEQYGGVSTMNEQDQEGDNDF

SEQ ID NO: 39949 - protein, 35 aa, Artificial Sequence
  Description of Artificial Sequence: Synthetic polypeptide
DEEEIRTTNPFATEQYGSVSITPGPLVCCDGDNPD

SEQ ID NO: 39950 - protein, 33 aa, Artificial Sequence
  Description of Artificial Sequence: Synthetic polypeptide
DENEIRTTNPVASEIYGSVSTEDQVQLNNGDNT

SEQ ID NO: 39951 - protein, 28 aa, Artificial Sequence
  Description of Artificial Sequence: Synthetic peptide
DEEEVKATNIVGTEQYGVTATNLQNQTT

SEQ ID NO: 39952 - protein, 28 aa, Artificial Sequence
  Description of Artificial Sequence: Synthetic peptide
DEQDIRTTNIVANEQYGSRHTQLDGLSS

SEQ ID NO: 39953 - protein, 32 aa, Artificial Sequence
  Description of Artificial Sequence: Synthetic polypeptide
DENEINSTNPVATEQYGSVSATELEDMNGEEA

SEQ ID NO: 39954 - protein, 30 aa, Artificial Sequence
  Description of Artificial Sequence: Synthetic polypeptide
SDQEIACTNPVATEIYGVVAASNLEREGNR

SEQ ID NO: 39955 - protein, 28 aa, Artificial Sequence
  Description of Artificial Sequence: Synthetic peptide
DEDNIATTNIFDNDNYGSVSTNLGRKAR

SEQ ID NO: 39956 - protein, 33 aa, Artificial Sequence
  Description of Artificial Sequence: Synthetic polypeptide
QEEEIATTNPVATECYGVVSEMNLQETNGEDDP

SEQ ID NO: 39957 - protein, 28 aa, Artificial Sequence
  Description of Artificial Sequence: Synthetic peptide
DEEEITSTSIVACEETGSTGTNLQNTST

SEQ ID NO: 39958 - protein, 30 aa, Artificial Sequence
  Description of Artificial Sequence: Synthetic polypeptide
DEDEIATTNPVSSEIFGCVSASNLEFPPNR

SEQ ID NO: 39959 - protein, 36 aa, Artificial Sequence
  Description of Artificial Sequence: Synthetic polypeptide
DEEEIRTTNPFATEQYGSVTSITPGPLVCCDGFNPD

SEQ ID NO: 39960 - protein, 28 aa, Artificial Sequence
  Description of Artificial Sequence: Synthetic peptide
YDHELATTNPCSTESYGCVCTNWQNENR

SEQ ID NO: 39961 - protein, 31 aa, Artificial Sequence
  Description of Artificial Sequence: Synthetic polypeptide
MEQEIAATNPVATEMYGSVSEELQDIEGEDM

SEQ ID NO: 39962 - protein, 34 aa, Artificial Sequence
  Description of Artificial Sequence: Synthetic polypeptide
DEEEIATTNPVATEQYGDVSCEEEPDQLTLGDNV

SEQ ID NO: 39963 - protein, 28 aa, Artificial Sequence
  Description of Artificial Sequence: Synthetic peptide
DEQEINITNIVDTEQWGTVETGQQQSNV

SEQ ID NO: 39964 - protein, 31 aa, Artificial Sequence
  Description of Artificial Sequence: Synthetic polypeptide
DDQEIRCTNPIAYEIYGAVGASNLERNGNDR

SEQ ID NO: 39965 - protein, 28 aa, Artificial Sequence
  Description of Artificial Sequence: Synthetic peptide
DGEEIATTNGVDTEAYGMTVTNQQSAGT

SEQ ID NO: 39966 - protein, 37 aa, Artificial Sequence
  Description of Artificial Sequence: Synthetic polypeptide
DEEEIRTTNPDATEQYGSVASCTIGNGVIEREGVNDV

SEQ ID NO: 39967 - protein, 28 aa, Artificial Sequence
  Description of Artificial Sequence: Synthetic peptide
QEGEIAPTNPCSSEQYGIVACNLQSGTT

SEQ ID NO: 39968 - protein, 28 aa, Artificial Sequence
  Description of Artificial Sequence: Synthetic peptide
DEQHIVTTNGIDTENYGTVATQLQNTNT

SEQ ID NO: 39969 - protein, 28 aa, Artificial Sequence
  Description of Artificial Sequence: Synthetic peptide
DGQEIATTNSVATERYGEVITQNQNQTT

SEQ ID NO: 39970 - protein, 32 aa, Artificial Sequence
  Description of Artificial Sequence: Synthetic polypeptide
DETEIRATNPAATEQYGDVSTQEQQFLNPGLE

SEQ ID NO: 39971 - protein, 32 aa, Artificial Sequence
  Description of Artificial Sequence: Synthetic polypeptide
DEEEIATTNPTATEQYGEVSEMNECCQEDDTF

SEQ ID NO: 39972 - protein, 34 aa, Artificial Sequence
  Description of Artificial Sequence: Synthetic polypeptide
DEEEIRTTNPDATEQYGSVFCENPLTDCNEGEDN

SEQ ID NO: 39973 - protein, 34 aa, Artificial Sequence
  Description of Artificial Sequence: Synthetic polypeptide
DENEIAQTNPVATEQYGSVSVTGGPVEDRGDNDI

SEQ ID NO: 39974 - protein, 31 aa, Artificial Sequence
  Description of Artificial Sequence: Synthetic polypeptide
QEGEITATNPVATECFGSVSAVGNLQQGPDP

SEQ ID NO: 39975 - protein, 32 aa, Artificial Sequence
  Description of Artificial Sequence: Synthetic polypeptide
DENEINSTNPVATEIYGSVSATELEDMNGEEA

SEQ ID NO: 39976 - protein, 28 aa, Artificial Sequence
  Description of Artificial Sequence: Synthetic peptide
DEGEGRTTNIVRTDNYGMTGTQLTGGNS

SEQ ID NO: 39977 - protein, 33 aa, Artificial Sequence
  Description of Artificial Sequence: Synthetic polypeptide
DEEEIRTTNPVATEQYGDVSCECCPCCHAGEDL

SEQ ID NO: 39978 - protein, 28 aa, Artificial Sequence
  Description of Artificial Sequence: Synthetic peptide
DESEARTQNGVDIEQYGLVSSDKQNGTT

SEQ ID NO: 39979 - protein, 36 aa, Artificial Sequence
  Description of Artificial Sequence: Synthetic polypeptide
DEEEIRTTNPFATEQYGSVCSITPPPLVQIDKGDEP

SEQ ID NO: 39980 - protein, 37 aa, Artificial Sequence
  Description of Artificial Sequence: Synthetic polypeptide
DEEEIRTTNPDATEQYGSVCSVTLENGVIIQKGENLA

SEQ ID NO: 39981 - protein, 32 aa, Artificial Sequence
  Description of Artificial Sequence: Synthetic polypeptide
NEEEIRTTNPVCTEVYGTVSSEEIQQAGENDT

SEQ ID NO: 39982 - protein, 37 aa, Artificial Sequence
  Description of Artificial Sequence: Synthetic polypeptide
DEQEIRTTNPVATEQYGSVQSLTIDTLADIQDEGNNI

SEQ ID NO: 39983 - protein, 34 aa, Artificial Sequence
  Description of Artificial Sequence: Synthetic polypeptide
DEEEIRTTNPDATEQYGSVFCECNPLTDEIDGES

SEQ ID NO: 39984 - protein, 31 aa, Artificial Sequence
  Description of Artificial Sequence: Synthetic polypeptide
DENEIRTTNPVATEQWGDHYSEIEMNQAGDA

SEQ ID NO: 39985 - protein, 28 aa, Artificial Sequence
  Description of Artificial Sequence: Synthetic peptide
DESELNTVNIVASEVYGEVASQLQNANR

SEQ ID NO: 39986 - protein, 28 aa, Artificial Sequence
  Description of Artificial Sequence: Synthetic peptide
GEDEIRTNNIVDTEQYDIVSENNQNSTT

SEQ ID NO: 39987 - protein, 33 aa, Artificial Sequence
  Description of Artificial Sequence: Synthetic polypeptide
DEVEISTTNPVSTEQYGSVSATVADVQIGETTF

SEQ ID NO: 39988 - protein, 33 aa, Artificial Sequence
  Description of Artificial Sequence: Synthetic polypeptide
SEEEIRATNPVATEQFGSVSEMNPQLIEGDDDF

SEQ ID NO: 39989 - protein, 28 aa, Artificial Sequence
  Description of Artificial Sequence: Synthetic peptide
DEVEICCTNPCATEVYGDVATDPNPGTY

SEQ ID NO: 39990 - protein, 28 aa, Artificial Sequence
  Description of Artificial Sequence: Synthetic peptide
SEGEIATTNPIATENYGEVSVDWIQGPQ

SEQ ID NO: 39991 - protein, 31 aa, Artificial Sequence
  Description of Artificial Sequence: Synthetic polypeptide
MENEIATTNPVATECYGSVSEDEQDHEGEDQ

SEQ ID NO: 39992 - protein, 28 aa, Artificial Sequence
  Description of Artificial Sequence: Synthetic peptide
DWQEIRTTLPFATEQYWSWETPDDPGEG

SEQ ID NO: 39993 - protein, 28 aa, Artificial Sequence
  Description of Artificial Sequence: Synthetic peptide
QEEEIVTTNPVSTECFGVVSTSGCCPEI

SEQ ID NO: 39994 - protein, 28 aa, Artificial Sequence
  Description of Artificial Sequence: Synthetic peptide
DEQEIRIVNRVMTEEYGSHGNNNQTSNT

SEQ ID NO: 39995 - protein, 28 aa, Artificial Sequence
  Description of Artificial Sequence: Synthetic peptide
DEEEVACTNIVSSENWGTVANNLQRTGR

SEQ ID NO: 39996 - protein, 32 aa, Artificial Sequence
  Description of Artificial Sequence: Synthetic polypeptide
QEEEIAATNPVATECYGSVSATDLEEHNGEDD

SEQ ID NO: 39997 - protein, 28 aa, Artificial Sequence
  Description of Artificial Sequence: Synthetic peptide
SEEEIKITNIVGTKEYGTDATNLQSANT

SEQ ID NO: 39998 - protein, 28 aa, Artificial Sequence
  Description of Artificial Sequence: Synthetic peptide
DEEEKSTTNIMGAEQYGSGATNNQTQST

SEQ ID NO: 39999 - protein, 37 aa, Artificial Sequence
  Description of Artificial Sequence: Synthetic polypeptide
DEQEIRTTNPVATEQYGSVQSLTIDTLAQIQDEGNNI

SEQ ID NO: 40000 - protein, 36 aa, Artificial Sequence
  Description of Artificial Sequence: Synthetic polypeptide
DEEEIRTTNPFATEQYGSVSSITPGPLVCCDGDNPD

SEQ ID NO: 40001 - protein, 37 aa, Artificial Sequence
  Description of Artificial Sequence: Synthetic polypeptide
DEEEIRTTNPDATEQYGSVCSVTLENGVIIRKGENLA

SEQ ID NO: 40002 - protein, 32 aa, Artificial Sequence
  Description of Artificial Sequence: Synthetic polypeptide
QEHEIATTNPVATEQYGWVSTENDEDFKGDDP

SEQ ID NO: 40003 - protein, 28 aa, Artificial Sequence
  Description of Artificial Sequence: Synthetic peptide
NEEGVAITNIVATEIYGKVADNLQDSNT

SEQ ID NO: 40004 - protein, 35 aa, Artificial Sequence
  Description of Artificial Sequence: Synthetic polypeptide
DEEEIAQTNPVATEQYGSVSATTGQVELDNGENDD

SEQ ID NO: 40005 - protein, 30 aa, Artificial Sequence
  Description of Artificial Sequence: Synthetic polypeptide
SDQEIACTNPVATEIFGVVAASNLEREGNR

SEQ ID NO: 40006 - protein, 33 aa, Artificial Sequence
  Description of Artificial Sequence: Synthetic polypeptide
DEEEIRSTNPVATEVYGSVGITEELEDNDGDEL

SEQ ID NO: 40007 - protein, 32 aa, Artificial Sequence
  Description of Artificial Sequence: Synthetic polypeptide
DEEEIVCTNPVATECYGWVSETGPLEPKGDEV

SEQ ID NO: 40008 - protein, 33 aa, Artificial Sequence
  Description of Artificial Sequence: Synthetic polypeptide
NETEIRTTNPVATETYGSVSDYCPPPQASGNDS

SEQ ID NO: 40009 - protein, 28 aa, Artificial Sequence
  Description of Artificial Sequence: Synthetic peptide
DEQEIRTTNIVATLSWNSTSDQIQNLNT

SEQ ID NO: 40010 - protein, 36 aa, Artificial Sequence
  Description of Artificial Sequence: Synthetic polypeptide
DEEEIRTTNPFATEQYGSVTSITPGPLVDLPGDNPD

SEQ ID NO: 40011 - protein, 33 aa, Artificial Sequence
  Description of Artificial Sequence: Synthetic polypeptide
DEVEIATTNPTATEQYGGVSEMNEQDQEGDNTF

SEQ ID NO: 40012 - protein, 28 aa, Artificial Sequence
  Description of Artificial Sequence: Synthetic peptide
DGEMIRTNNNVDTEQIGTVNDNLYYGGD

SEQ ID NO: 40013 - protein, 32 aa, Artificial Sequence
  Description of Artificial Sequence: Synthetic polypeptide
DEDEVKTTNPVATEPYGQVSADLLQNIAGPQR

SEQ ID NO: 40014 - protein, 28 aa, Artificial Sequence
  Description of Artificial Sequence: Synthetic peptide
DELEGINTNWIATENYTTVRNNLQRKNA

SEQ ID NO: 40015 - protein, 35 aa, Artificial Sequence
  Description of Artificial Sequence: Synthetic polypeptide
DEEEIRTTNPVATEQYGSVFCEMNDVCCDDGFNPC

SEQ ID NO: 40016 - protein, 34 aa, Artificial Sequence
  Description of Artificial Sequence: Synthetic polypeptide
DEEEIATTNPVATEQYGDVSCEEEPDQQTLGDNV

SEQ ID NO: 40017 - protein, 36 aa, Artificial Sequence
  Description of Artificial Sequence: Synthetic polypeptide
DEEEIRTTNPFATEQYGSVSITPNPLVFIDKGDEPP

SEQ ID NO: 40018 - protein, 32 aa, Artificial Sequence
  Description of Artificial Sequence: Synthetic polypeptide
KENEIRTTNPVATECYGHVSTGQNQDYKENEL

SEQ ID NO: 40019 - protein, 36 aa, Artificial Sequence
  Description of Artificial Sequence: Synthetic polypeptide
DEEEIRTTNPVATEQYGSVCSTTQGGLVLCEAGDLD

SEQ ID NO: 40020 - protein, 28 aa, Artificial Sequence
  Description of Artificial Sequence: Synthetic peptide
SESEIRTTNIVATDEFGVVVTNNNSTNT

SEQ ID NO: 40021 - protein, 28 aa, Artificial Sequence
  Description of Artificial Sequence: Synthetic peptide
EEEEILATNITATEQWGVVVRNFQSANA

SEQ ID NO: 40022 - protein, 33 aa, Artificial Sequence
  Description of Artificial Sequence: Synthetic polypeptide
DEVEIATTNPTATEIFGSVSTENGEPQLEGDNQ

SEQ ID NO: 40023 - protein, 28 aa, Artificial Sequence
  Description of Artificial Sequence: Synthetic peptide
SEEEIRIGNIVDTEIYGTVATNEQSTTT

SEQ ID NO: 40024 - protein, 28 aa, Artificial Sequence
  Description of Artificial Sequence: Synthetic peptide
DDEEVACTNIVSSEIWGTTATNLQRGTR

SEQ ID NO: 40025 - protein, 32 aa, Artificial Sequence
  Description of Artificial Sequence: Synthetic polypeptide
QENEIVATNPVATECYGVVSTNLEMGEGENDD

SEQ ID NO: 40026 - protein, 36 aa, Artificial Sequence
  Description of Artificial Sequence: Synthetic polypeptide
DEEEIRTTNPFATEQYGSVSVTEAGPVDLRNGENPS

SEQ ID NO: 40027 - protein, 28 aa, Artificial Sequence
  Description of Artificial Sequence: Synthetic peptide
DEVEIASTNPVGTEQYGIIPTNEEHFLG

SEQ ID NO: 40028 - protein, 34 aa, Artificial Sequence
  Description of Artificial Sequence: Synthetic polypeptide
DEEEIRTTNPIATECYGSTCSDTGNLQDQEDEEY

SEQ ID NO: 40029 - protein, 28 aa, Artificial Sequence
  Description of Artificial Sequence: Synthetic peptide
SEETIKTTNIVGTEQYGTTVNNLQNQTA

SEQ ID NO: 40030 - protein, 31 aa, Artificial Sequence
  Description of Artificial Sequence: Synthetic polypeptide
QEAEIASTNPVATECYGSVSEMALQETGDDP

SEQ ID NO: 40031 - protein, 33 aa, Artificial Sequence
  Description of Artificial Sequence: Synthetic polypeptide
DEEEIRTTNPVATEQYGSWSCDIPEQNNEVEPS

SEQ ID NO: 40032 - protein, 28 aa, Artificial Sequence
  Description of Artificial Sequence: Synthetic peptide
SEEEITATNNITTEMYGKTETNLQGSNT

SEQ ID NO: 40033 - protein, 28 aa, Artificial Sequence
  Description of Artificial Sequence: Synthetic peptide
DEEEVASTNCVSSKIYGAVATNLERANT

SEQ ID NO: 40034 - protein, 28 aa, Artificial Sequence
  Description of Artificial Sequence: Synthetic peptide
DEEEIKTTNGVAYEIFGTTADNLQNATT

SEQ ID NO: 40035 - protein, 28 aa, Artificial Sequence
  Description of Artificial Sequence: Synthetic peptide
DEQEINTTNNVAYVQYLETSNNWQAGGT

SEQ ID NO: 40036 - protein, 37 aa, Artificial Sequence
  Description of Artificial Sequence: Synthetic polypeptide
DEEEIRTTNPFATEQYGSVASVTLNNDTLVRKGDEPV

SEQ ID NO: 40037 - protein, 34 aa, Artificial Sequence
  Description of Artificial Sequence: Synthetic polypeptide
SEEEIRTTNPVATEQFGEVISTMNDPQIEGIDTA

SEQ ID NO: 40038 - protein, 34 aa, Artificial Sequence
  Description of Artificial Sequence: Synthetic polypeptide
DNVEIRSTNPVATEQYGSVYNATNGEPQREGDPQ

SEQ ID NO: 40039 - protein, 28 aa, Artificial Sequence
  Description of Artificial Sequence: Synthetic peptide
DEEEIRITNIVGTKEYGKTADNLQSSTT

SEQ ID NO: 40040 - protein, 28 aa, Artificial Sequence
  Description of Artificial Sequence: Synthetic peptide
DEEEGATTNPVAIEVLGGTRDNLQYRAT

SEQ ID NO: 40041 - protein, 28 aa, Artificial Sequence
  Description of Artificial Sequence: Synthetic peptide
DDEEGQTNNIVAWEVYGHTSTGLQYQNN

SEQ ID NO: 40042 - protein, 34 aa, Artificial Sequence
  Description of Artificial Sequence: Synthetic polypeptide
DEEEIRTTNPVATEQYGDVSCEMDLQCCHAEDDA

SEQ ID NO: 40043 - protein, 28 aa, Artificial Sequence
  Description of Artificial Sequence: Synthetic peptide
AENEIAQTNPCSTEQYGVVSEDQERGEA

SEQ ID NO: 40044 - protein, 33 aa, Artificial Sequence
  Description of Artificial Sequence: Synthetic polypeptide
DEVEIAATNPTATEQYGGVSEGNPQLQEGDNTN

SEQ ID NO: 40045 - protein, 28 aa, Artificial Sequence
  Description of Artificial Sequence: Synthetic peptide
SEEEVKTTNIVATERYGATATNEQNSTT

SEQ ID NO: 40046 - protein, 28 aa, Artificial Sequence
  Description of Artificial Sequence: Synthetic peptide
DEEEVATANIIASKIWQEVADNLQRGNR

SEQ ID NO: 40047 - protein, 34 aa, Artificial Sequence
  Description of Artificial Sequence: Synthetic polypeptide
DEEEIRTTNPVATEQYGVVSLELDPVELNGIDLS

SEQ ID NO: 40048 - protein, 35 aa, Artificial Sequence
  Description of Artificial Sequence: Synthetic polypeptide
DEEEIAQTNPVATEQYGSVSITGDQVEENNGDNDS

SEQ ID NO: 40049 - protein, 28 aa, Artificial Sequence
  Description of Artificial Sequence: Synthetic peptide
GENEINTNNIVATLQYGGVLDNAQGGAT

SEQ ID NO: 40050 - protein, 28 aa, Artificial Sequence
  Description of Artificial Sequence: Synthetic peptide
DEHEIATTNPVATEQYGDAFEDECHEDQ

SEQ ID NO: 40051 - protein, 37 aa, Artificial Sequence
  Description of Artificial Sequence: Synthetic polypeptide
DEEEIRTTNPFATEQYGSVASVTLDNDTLVQKGDEPV

SEQ ID NO: 40052 - protein, 28 aa, Artificial Sequence
  Description of Artificial Sequence: Synthetic peptide
DEEEITTTNPVDTDRWGTTHTNVQGSTT

SEQ ID NO: 40053 - protein, 34 aa, Artificial Sequence
  Description of Artificial Sequence: Synthetic polypeptide
DENEIAQTNPVATEQYGSVSTGGPVEDRKGDNDI

SEQ ID NO: 40054 - protein, 28 aa, Artificial Sequence
  Description of Artificial Sequence: Synthetic peptide
QEEEITATNPVGTECYGCVAENPAVGPH

SEQ ID NO: 40055 - protein, 28 aa, Artificial Sequence
  Description of Artificial Sequence: Synthetic peptide
DEEEITTTNIEDTEQGGTTSDQEQWGTT

SEQ ID NO: 40056 - protein, 29 aa, Artificial Sequence
  Description of Artificial Sequence: Synthetic peptide
DEAEIAQTNPVATEMYGVTCCTLQSHGDY

SEQ ID NO: 40057 - protein, 31 aa, Artificial Sequence
  Description of Artificial Sequence: Synthetic polypeptide
MENEIATTNPVATECYGSVADELQEVEGEDL

SEQ ID NO: 40058 - protein, 28 aa, Artificial Sequence
  Description of Artificial Sequence: Synthetic peptide
EDEEIATTNIVDTDIVGHVSTDLQNTNT

SEQ ID NO: 40059 - protein, 33 aa, Artificial Sequence
  Description of Artificial Sequence: Synthetic polypeptide
DEEEIRTTNPVATEQYGDVSCEMDLCCHAEDDQ

SEQ ID NO: 40060 - protein, 29 aa, Artificial Sequence
  Description of Artificial Sequence: Synthetic peptide
DDSEVASTNPVSTEGYGNVANTLQRVGQR

SEQ ID NO: 40061 - protein, 33 aa, Artificial Sequence
  Description of Artificial Sequence: Synthetic polypeptide
QEHEICTTNPCATECYGSVSDTDLQETNGDNDM

SEQ ID NO: 40062 - protein, 32 aa, Artificial Sequence
  Description of Artificial Sequence: Synthetic polypeptide
DEEEIATTNPTATEQYGEVSEMNEQCQEDDTF

SEQ ID NO: 40063 - protein, 35 aa, Artificial Sequence
  Description of Artificial Sequence: Synthetic polypeptide
DETEICTTNPVATEQYGSVSDTLADQQMSKGEEPR

SEQ ID NO: 40064 - protein, 31 aa, Artificial Sequence
  Description of Artificial Sequence: Synthetic polypeptide
MENEIAATNPVATECYGSVSEDLQDSEGDDM

SEQ ID NO: 40065 - protein, 32 aa, Artificial Sequence
  Description of Artificial Sequence: Synthetic polypeptide
DETEIRTTNPIATEQYGATWSNAENWAPGNYI

SEQ ID NO: 40066 - protein, 33 aa, Artificial Sequence
  Description of Artificial Sequence: Synthetic polypeptide
HEDEIMTTNPVATEQYGGVNTGNWPQMQGANTE

SEQ ID NO: 40067 - protein, 28 aa, Artificial Sequence
  Description of Artificial Sequence: Synthetic peptide
DEEEIRQTLIDAYENYGSIETIDDGDNR

SEQ ID NO: 40068 - protein, 34 aa, Artificial Sequence
  Description of Artificial Sequence: Synthetic polypeptide
QEEEIATTNPVATECYGSVSATEDLQDTKGEEDP

SEQ ID NO: 40069 - protein, 28 aa, Artificial Sequence
  Description of Artificial Sequence: Synthetic peptide
DEDEIGSTNPVSYEWWGDVSTALMPGTM

SEQ ID NO: 40070 - protein, 30 aa, Artificial Sequence
  Description of Artificial Sequence: Synthetic polypeptide
AEAELNTTNPVATECYGEVSANNVQRAPPH

SEQ ID NO: 40071 - protein, 28 aa, Artificial Sequence
  Description of Artificial Sequence: Synthetic peptide
DEQETRTGNIVATEEYGTTATNEQSSST

SEQ ID NO: 40072 - protein, 31 aa, Artificial Sequence
  Description of Artificial Sequence: Synthetic polypeptide
QEEEIATTNPVATEQYGEASAEVLQNHAEEK

SEQ ID NO: 40073 - protein, 34 aa, Artificial Sequence
  Description of Artificial Sequence: Synthetic polypeptide
DEEEIATTNPVATEQYGGVISEMNEPQDQEGDDF

SEQ ID NO: 40074 - protein, 28 aa, Artificial Sequence
  Description of Artificial Sequence: Synthetic peptide
SEAEINTTNNMMTEQYTSVSDNVGGATR

SEQ ID NO: 40075 - protein, 28 aa, Artificial Sequence
  Description of Artificial Sequence: Synthetic peptide
NEDEIRITNIVAADIYGVVADNLQGANT

SEQ ID NO: 40076 - protein, 33 aa, Artificial Sequence
  Description of Artificial Sequence: Synthetic polypeptide
DEQEIATTNPVATECYGSVSATDLEEHEGEEDL

SEQ ID NO: 40077 - protein, 28 aa, Artificial Sequence
  Description of Artificial Sequence: Synthetic peptide
DEQEIRITNIVATKEYGTVADNEQQTTT

SEQ ID NO: 40078 - protein, 30 aa, Artificial Sequence
  Description of Artificial Sequence: Synthetic polypeptide
DENEIRTTNPVATECWGIYSEEDENGNGDT

SEQ ID NO: 40079 - protein, 28 aa, Artificial Sequence
  Description of Artificial Sequence: Synthetic peptide
DERGIITNNIIRTEQYGGTTTNQQQGNT

SEQ ID NO: 40080 - protein, 33 aa, Artificial Sequence
  Description of Artificial Sequence: Synthetic polypeptide
DEEEIRTTNPTATFIYGCVDDDTALELRDGNDF

SEQ ID NO: 40081 - protein, 33 aa, Artificial Sequence
  Description of Artificial Sequence: Synthetic polypeptide
SEVEIATTNPVATEQFGGVISTMNEQQEGDTTR

SEQ ID NO: 40082 - protein, 28 aa, Artificial Sequence
  Description of Artificial Sequence: Synthetic peptide
AENEIAQTNPCATEQYGVVSEDQEDGEA

SEQ ID NO: 40083 - protein, 28 aa, Artificial Sequence
  Description of Artificial Sequence: Synthetic peptide
DEEEIRQTNGVAAEQITVVHTQLGSTTQ

SEQ ID NO: 40084 - protein, 28 aa, Artificial Sequence
  Description of Artificial Sequence: Synthetic peptide
DEEEISTVNIIANDNIGSVSENIQRQTS

SEQ ID NO: 40085 - protein, 28 aa, Artificial Sequence
  Description of Artificial Sequence: Synthetic peptide
FEHELCAVNPVATEPWGCVSENVQGGNT

SEQ ID NO: 40086 - protein, 38 aa, Artificial Sequence
  Description of Artificial Sequence: Synthetic polypeptide
DEEEIRTTNPVATEQYGSYVSSITQGPLNQVYDGDNPN

SEQ ID NO: 40087 - protein, 32 aa, Artificial Sequence
  Description of Artificial Sequence: Synthetic polypeptide
DEEEIATTNPVATECYGDVSCEELQIHAEEDI

SEQ ID NO: 40088 - protein, 28 aa, Artificial Sequence
  Description of Artificial Sequence: Synthetic peptide
AEEETTATNIVDNEQFGTTSTNLQNGST

SEQ ID NO: 40089 - protein, 31 aa, Artificial Sequence
  Description of Artificial Sequence: Synthetic polypeptide
QEQEIATVNPVSTEQYGEASATVLQSHAGGR

SEQ ID NO: 40090 - protein, 28 aa, Artificial Sequence
  Description of Artificial Sequence: Synthetic peptide
SEEEIRTTNIVATTEYGKTVNNWQNSTA

SEQ ID NO: 40091 - protein, 34 aa, Artificial Sequence
  Description of Artificial Sequence: Synthetic polypeptide
AEQEIVTTNPVATEQYGEVSITGNPLESINGVNQ

SEQ ID NO: 40092 - protein, 33 aa, Artificial Sequence
  Description of Artificial Sequence: Synthetic polypeptide
DENEIATTNPVATECYGVVSATDLQDQNGDEDL

SEQ ID NO: 40093 - protein, 28 aa, Artificial Sequence
  Description of Artificial Sequence: Synthetic peptide
DDEHTRNTNIVATDEYGTVVDNLQSQNT

SEQ ID NO: 40094 - protein, 28 aa, Artificial Sequence
  Description of Artificial Sequence: Synthetic peptide
DEEEIKITNIVATERQGVTATNEQNTTT

SEQ ID NO: 40095 - protein, 28 aa, Artificial Sequence
  Description of Artificial Sequence: Synthetic peptide
DEEEVRITSGVAWEQYGRTATELINSNT

SEQ ID NO: 40096 - protein, 32 aa, Artificial Sequence
  Description of Artificial Sequence: Synthetic polypeptide
DEEEIVATNPVSTELYGVVSCENGEQQEGNDL

SEQ ID NO: 40097 - protein, 31 aa, Artificial Sequence
  Description of Artificial Sequence: Synthetic polypeptide
DEEEIWTVNPVATEGYGVVCSNCILDLKGEQ

SEQ ID NO: 40098 - protein, 32 aa, Artificial Sequence
  Description of Artificial Sequence: Synthetic polypeptide
DENEIASTNPVASEQYGVVSATDLQDQNGEDL

SEQ ID NO: 40099 - protein, 28 aa, Artificial Sequence
  Description of Artificial Sequence: Synthetic peptide
DNEEIATTNIVGWEVYGHTATNEQGGTT

SEQ ID NO: 40100 - protein, 28 aa, Artificial Sequence
  Description of Artificial Sequence: Synthetic peptide
NEQEIATTNDVDTEQYGGTSNNIVIGTT

SEQ ID NO: 40101 - protein, 32 aa, Artificial Sequence
  Description of Artificial Sequence: Synthetic polypeptide
DEVEISATNPVSTEHFGGVSTANLPQIGNNWQ

SEQ ID NO: 40102 - protein, 33 aa, Artificial Sequence
  Description of Artificial Sequence: Synthetic polypeptide
SENEIRTTNPVATEQYGCSHYSEALQDQYGAQP

SEQ ID NO: 40103 - protein, 36 aa, Artificial Sequence
  Description of Artificial Sequence: Synthetic polypeptide
DEEEIRTTNPVATEQYGSVVFCEMNPLCCADGDNDC

SEQ ID NO: 40104 - protein, 37 aa, Artificial Sequence
  Description of Artificial Sequence: Synthetic polypeptide
DEEEIRTTNPVATEQYGSVISVTMGGEPQLNEGDNCG

SEQ ID NO: 40105 - protein, 35 aa, Artificial Sequence
  Description of Artificial Sequence: Synthetic polypeptide
DEEEIAQTNPVATEQYGSVSATTDQVELVNGENDD

SEQ ID NO: 40106 - protein, 28 aa, Artificial Sequence
  Description of Artificial Sequence: Synthetic peptide
DEEEINTTQNFAQEQYGTTNDNIQRLVG

SEQ ID NO: 40107 - protein, 30 aa, Artificial Sequence
  Description of Artificial Sequence: Synthetic polypeptide
DEQEISTTNPVATEWWGSVDDADMFQGNDS

SEQ ID NO: 40108 - protein, 28 aa, Artificial Sequence
  Description of Artificial Sequence: Synthetic peptide
AEDEIRTTNIGTTEQQGNVSDNLYGKAT

SEQ ID NO: 40109 - protein, 32 aa, Artificial Sequence
  Description of Artificial Sequence: Synthetic polypeptide
QEEEIAATNPVATECYGSVSANDLEEHNGEDD

SEQ ID NO: 40110 - protein, 28 aa, Artificial Sequence
  Description of Artificial Sequence: Synthetic peptide
DEENLNTENIVANEQYLSVNENLRNGTN

SEQ ID NO: 40111 - protein, 31 aa, Artificial Sequence
  Description of Artificial Sequence: Synthetic polypeptide
QEEEIRATNPVASEQWGVVGTDLQESDGMDN

SEQ ID NO: 40112 - protein, 35 aa, Artificial Sequence
  Description of Artificial Sequence: Synthetic polypeptide
DEEEIRTTNPVATEQYGSVSTEDNGPEYYKEEEPE

SEQ ID NO: 40113 - protein, 37 aa, Artificial Sequence
  Description of Artificial Sequence: Synthetic polypeptide
DEEEIRTTNPVATEQYGSVHSITPNPLVFIDKGDEPP

SEQ ID NO: 40114 - protein, 34 aa, Artificial Sequence
  Description of Artificial Sequence: Synthetic polypeptide
DEEEISCTNPDATENYGWVASLTTNLQQDDGIND

SEQ ID NO: 40115 - protein, 28 aa, Artificial Sequence
  Description of Artificial Sequence: Synthetic peptide
DEFEIAATNPVGTEMFGTVSDAEQIETR

SEQ ID NO: 40116 - protein, 28 aa, Artificial Sequence
  Description of Artificial Sequence: Synthetic peptide
DEQEVACTNIVSSEMYGAVANNLQRTTR

SEQ ID NO: 40117 - protein, 36 aa, Artificial Sequence
  Description of Artificial Sequence: Synthetic polypeptide
DEEEIRTTNPFATEQYGSVSSITPGPLVDLPGDNPD

SEQ ID NO: 40118 - protein, 28 aa, Artificial Sequence
  Description of Artificial Sequence: Synthetic peptide
DEQEIRTVNGVHTEQIGGVVDHEQSQNT

SEQ ID NO: 40119 - protein, 35 aa, Artificial Sequence
  Description of Artificial Sequence: Synthetic polypeptide
DEEEIRTTNPDATEQYGSVSCENPLVDCNEGHEDN

SEQ ID NO: 40120 - protein, 31 aa, Artificial Sequence
  Description of Artificial Sequence: Synthetic polypeptide
VEDEIRTTNPVASEAYGCVGMNLEDRNLTER

SEQ ID NO: 40121 - protein, 34 aa, Artificial Sequence
  Description of Artificial Sequence: Synthetic polypeptide
DEEEIRTTNPVATEQYGDVSCEMDLQCCHAEDDQ

SEQ ID NO: 40122 - protein, 32 aa, Artificial Sequence
  Description of Artificial Sequence: Synthetic polypeptide
DEVEIATTNPCCTEPYGDVSCTDLQCQAGNDA

SEQ ID NO: 40123 - protein, 30 aa, Artificial Sequence
  Description of Artificial Sequence: Synthetic polypeptide
DENEIRTTNPVATECWGIYSEEDENRNGDT

SEQ ID NO: 40124 - protein, 32 aa, Artificial Sequence
  Description of Artificial Sequence: Synthetic polypeptide
SEEEITTTNPTATEQYGEVSEGNPQDSGDTDI

SEQ ID NO: 40125 - protein, 28 aa, Artificial Sequence
  Description of Artificial Sequence: Synthetic peptide
SEEEIRTTNIIADEQVQGVVTNIQSKGT

SEQ ID NO: 40126 - protein, 37 aa, Artificial Sequence
  Description of Artificial Sequence: Synthetic polypeptide
DEEEIRTTNPFATEQYGSVASVTLDNDTLVRKGDEPV

SEQ ID NO: 40127 - protein, 33 aa, Artificial Sequence
  Description of Artificial Sequence: Synthetic polypeptide
DEGEITATNPVATECFGSVISTGNGWQQGPDDR

SEQ ID NO: 40128 - protein, 33 aa, Artificial Sequence
  Description of Artificial Sequence: Synthetic polypeptide
DEMEIVTTNPVATEQYGTVCSATDGPVEFEGND

SEQ ID NO: 40129 - protein, 28 aa, Artificial Sequence
  Description of Artificial Sequence: Synthetic peptide
QESEIASTNPVGTEGYGVMASTLQHGDI

SEQ ID NO: 40130 - protein, 28 aa, Artificial Sequence
  Description of Artificial Sequence: Synthetic peptide
SEQEIKTTNIIAWEQYGVTATNLQNSTS

SEQ ID NO: 40131 - protein, 31 aa, Artificial Sequence
  Description of Artificial Sequence: Synthetic polypeptide
DENEIRTTNPVATEQWGDVSEIEMNAAELDA

SEQ ID NO: 40132 - protein, 32 aa, Artificial Sequence
  Description of Artificial Sequence: Synthetic polypeptide
SEGEIRTTNPVCTEQYGTVISTDGWPQTGTFA

SEQ ID NO: 40133 - protein, 36 aa, Artificial Sequence
  Description of Artificial Sequence: Synthetic polypeptide
DEEEIRQTNPVATEQYGSVSVTPPNPVQENKGDEDF

SEQ ID NO: 40134 - protein, 31 aa, Artificial Sequence
  Description of Artificial Sequence: Synthetic polypeptide
SEEEIRATNPVATECYGWMATELQDYEGEDD

SEQ ID NO: 40135 - protein, 37 aa, Artificial Sequence
  Description of Artificial Sequence: Synthetic polypeptide
DEEEIRTTNPVATEQYGSVISVTMGGEPDLNEGDNCG

SEQ ID NO: 40136 - protein, 32 aa, Artificial Sequence
  Description of Artificial Sequence: Synthetic polypeptide
DEQEITTTNPCATEQYGVVSCEADQCEQGNDY

SEQ ID NO: 40137 - protein, 33 aa, Artificial Sequence
  Description of Artificial Sequence: Synthetic polypeptide
SEVEIATTNPTATEQYGSVSEMNEQDQEGDNDF

SEQ ID NO: 40138 - protein, 32 aa, Artificial Sequence
  Description of Artificial Sequence: Synthetic polypeptide
VENEICTTNPVATECYGSVSDTELEIHNGEEH

SEQ ID NO: 40139 - protein, 28 aa, Artificial Sequence
  Description of Artificial Sequence: Synthetic peptide
SEIEINTTNNTATDQVLSVSRNVQNGGT

SEQ ID NO: 40140 - protein, 32 aa, Artificial Sequence
  Description of Artificial Sequence: Synthetic polypeptide
DEVEISATNPVSTEHFGGVSTANLPQIGNDWQ

SEQ ID NO: 40141 - protein, 37 aa, Artificial Sequence
  Description of Artificial Sequence: Synthetic polypeptide
DEEEIRTTNPFATEQYGSVTSITPGPLVDLDNGDNPR

SEQ ID NO: 40142 - protein, 28 aa, Artificial Sequence
  Description of Artificial Sequence: Synthetic peptide
DEEGIITNNIAATEQLGAVSDQIQYGTD

SEQ ID NO: 40143 - protein, 33 aa, Artificial Sequence
  Description of Artificial Sequence: Synthetic polypeptide
DEEEIRTTNPVATEQYGDVSCEMDLCCHAEDDA

SEQ ID NO: 40144 - protein, 33 aa, Artificial Sequence
  Description of Artificial Sequence: Synthetic polypeptide
SEEEIRTTNPVATETFGCVISACNGPQNGINTV

SEQ ID NO: 40145 - protein, 28 aa, Artificial Sequence
  Description of Artificial Sequence: Synthetic peptide
DEDEIRTTNIVAWDQYGKTADNEQTSTT

SEQ ID NO: 40146 - protein, 32 aa, Artificial Sequence
  Description of Artificial Sequence: Synthetic polypeptide
SEVEIACTNPTATEQYGSVISEMNEQREGTDF

SEQ ID NO: 40147 - protein, 33 aa, Artificial Sequence
  Description of Artificial Sequence: Synthetic polypeptide
DEEEIRTTNPVATEQYGDVSCECCPCCHAGEDQ

SEQ ID NO: 40148 - protein, 32 aa, Artificial Sequence
  Description of Artificial Sequence: Synthetic polypeptide
DENEIRTTNPVSTEPYGTVSMEDIQQQQNGNH

SEQ ID NO: 40149 - protein, 28 aa, Artificial Sequence
  Description of Artificial Sequence: Synthetic peptide
DEEEIRITNIVGGDSQGKTATNLQNSNT

SEQ ID NO: 40150 - protein, 35 aa, Artificial Sequence
  Description of Artificial Sequence: Synthetic polypeptide
DEVEIRTTNPVATEAYGNVPSLTNNGVDLDDGVNW

SEQ ID NO: 40151 - protein, 35 aa, Artificial Sequence
  Description of Artificial Sequence: Synthetic polypeptide
YEEEIRTTNPVATEQYGSVISATENPDAINDTHDG

SEQ ID NO: 40152 - protein, 30 aa, Artificial Sequence
  Description of Artificial Sequence: Synthetic polypeptide
DENEIRTTNPVATEQWGDVSEIEMNAAEDA

SEQ ID NO: 40153 - protein, 31 aa, Artificial Sequence
  Description of Artificial Sequence: Synthetic polypeptide
VEEEIRTTNPIATYQFGCVDADTDLQTILLR

SEQ ID NO: 40154 - protein, 33 aa, Artificial Sequence
  Description of Artificial Sequence: Synthetic polypeptide
DESEIRTTNPVATECWGGVSCINEPQDHEGENG

SEQ ID NO: 40155 - protein, 28 aa, Artificial Sequence
  Description of Artificial Sequence: Synthetic peptide
SEVEIAATNPTATEIFGEVSENEQQGDF

SEQ ID NO: 40156 - protein, 31 aa, Artificial Sequence
  Description of Artificial Sequence: Synthetic polypeptide
GDEEIACTNPVATEQYGEVAEDLDESEGNDR

SEQ ID NO: 40157 - protein, 35 aa, Artificial Sequence
  Description of Artificial Sequence: Synthetic polypeptide
AEEEIATTNPVATEQYGVVDDATTNGLVERGEEDR

SEQ ID NO: 40158 - protein, 31 aa, Artificial Sequence
  Description of Artificial Sequence: Synthetic polypeptide
DETEIRTTNPIATECWGATATEDLQEPKGNI

SEQ ID NO: 40159 - protein, 28 aa, Artificial Sequence
  Description of Artificial Sequence: Synthetic peptide
IEEEIATTNISACRIYGSVADNNQYGTT

SEQ ID NO: 40160 - protein, 36 aa, Artificial Sequence
  Description of Artificial Sequence: Synthetic polypeptide
DEEEIRTTNPVATEQYGSVCDETCPGVLDLKGTNDV

SEQ ID NO: 40161 - protein, 28 aa, Artificial Sequence
  Description of Artificial Sequence: Synthetic peptide
DIEEIRTNHIVASEQYGGVSDQIQGTTN

SEQ ID NO: 40162 - protein, 37 aa, Artificial Sequence
  Description of Artificial Sequence: Synthetic polypeptide
DEEEIRTTNPVATEQYGSVSSLTMEGLVETSEGENLQ

SEQ ID NO: 40163 - protein, 36 aa, Artificial Sequence
  Description of Artificial Sequence: Synthetic polypeptide
DEEEIRTTNPVATEQYGSVSSTTPAGPNMRNGMDPV

SEQ ID NO: 40164 - protein, 35 aa, Artificial Sequence
  Description of Artificial Sequence: Synthetic polypeptide
DEEEIGCTNPVATEQYGSVSVENEGGGFRDGINFH

SEQ ID NO: 40165 - protein, 28 aa, Artificial Sequence
  Description of Artificial Sequence: Synthetic peptide
VAENINATNIVANEQYTGISDNLQGTNR

SEQ ID NO: 40166 - protein, 35 aa, Artificial Sequence
  Description of Artificial Sequence: Synthetic polypeptide
SEEEIRATNPTATEQYGSVISEMNGEQDQEGDNTR

SEQ ID NO: 40167 - protein, 33 aa, Artificial Sequence
  Description of Artificial Sequence: Synthetic polypeptide
DEQEIATTNPFATEQYGQVSITLNPDMSKGNPS

SEQ ID NO: 40168 - protein, 34 aa, Artificial Sequence
  Description of Artificial Sequence: Synthetic polypeptide
DEEEIRCTNPTATEHYGSVYSALDLQDIEGDTTG

SEQ ID NO: 40169 - protein, 36 aa, Artificial Sequence
  Description of Artificial Sequence: Synthetic polypeptide
DEEEIRTTNPVATEQYGSVFCEMNGDVCCDDGFNPC

SEQ ID NO: 40170 - protein, 34 aa, Artificial Sequence
  Description of Artificial Sequence: Synthetic polypeptide
DEEEISCTNPDATENYGWVASLTTNIQQDDGIND

SEQ ID NO: 40171 - protein, 28 aa, Artificial Sequence
  Description of Artificial Sequence: Synthetic peptide
IEENISTTNGVGTDQYGKTGSNLQNAST

SEQ ID NO: 40172 - protein, 28 aa, Artificial Sequence
  Description of Artificial Sequence: Synthetic peptide
AENEIAQTNPCSTEQYGVVSEDQEDGEA

SEQ ID NO: 40173 - protein, 35 aa, Artificial Sequence
  Description of Artificial Sequence: Synthetic polypeptide
YEEEIRTTNPVATEQYGSVIDATENPDAINDTHDG

SEQ ID NO: 40174 - protein, 28 aa, Artificial Sequence
  Description of Artificial Sequence: Synthetic peptide
DGEEIRQTNIVCTDTYGETVTQSQDSNT

SEQ ID NO: 40175 - protein, 37 aa, Artificial Sequence
  Description of Artificial Sequence: Synthetic polypeptide
DEEEIRTTNPVATEQYGSVSSLTMEGLVETSEGETLQ

SEQ ID NO: 40176 - protein, 28 aa, Artificial Sequence
  Description of Artificial Sequence: Synthetic peptide
IEEDIATTDITAGERYDDVSTRLTRTNT

SEQ ID NO: 40177 - protein, 36 aa, Artificial Sequence
  Description of Artificial Sequence: Synthetic polypeptide
DEEEIRTTNPVATEQYGSVDEETEPEVQETDGDDPY

SEQ ID NO: 40178 - protein, 28 aa, Artificial Sequence
  Description of Artificial Sequence: Synthetic peptide
SEEEIRDTNSLATERVNSVSAEHSSAND

SEQ ID NO: 40179 - protein, 32 aa, Artificial Sequence
  Description of Artificial Sequence: Synthetic polypeptide
SEVEIACTNPTATEQYGEVISEMNEQREGTDF

SEQ ID NO: 40180 - protein, 28 aa, Artificial Sequence
  Description of Artificial Sequence: Synthetic peptide
VEEEVAATNIVASEVYGTVANNLEHGTN

SEQ ID NO: 40181 - protein, 32 aa, Artificial Sequence
  Description of Artificial Sequence: Synthetic polypeptide
DEDEVKTTNPVATEPYGQCSADLLQNIAGPQR

SEQ ID NO: 40182 - protein, 28 aa, Artificial Sequence
  Description of Artificial Sequence: Synthetic peptide
DGEEVNNNNNITTEIYGSVSTNCGQQNG

SEQ ID NO: 40183 - protein, 32 aa, Artificial Sequence
  Description of Artificial Sequence: Synthetic polypeptide
QENEIVATNPVATECYGVVSTELEMGEGENDD

SEQ ID NO: 40184 - protein, 33 aa, Artificial Sequence
  Description of Artificial Sequence: Synthetic polypeptide
DEEEIVCTNPVATECYGWVSETGPLELPKGDEV

SEQ ID NO: 40185 - protein, 28 aa, Artificial Sequence
  Description of Artificial Sequence: Synthetic peptide
NEEEVAATNIISSEIYGSTATNLQWLGR

SEQ ID NO: 40186 - protein, 28 aa, Artificial Sequence
  Description of Artificial Sequence: Synthetic peptide
DEGEAATTNGVATRQYGKLADNKQNKAT

SEQ ID NO: 40187 - protein, 35 aa, Artificial Sequence
  Description of Artificial Sequence: Synthetic polypeptide
DENEIAQTNPVATEQYGSVSATTGLVELVEGDNDD

SEQ ID NO: 40188 - protein, 37 aa, Artificial Sequence
  Description of Artificial Sequence: Synthetic polypeptide
DEEEIRTTNPDATEQYGSVASCTIGNGVIEREGVEDV

SEQ ID NO: 40189 - protein, 28 aa, Artificial Sequence
  Description of Artificial Sequence: Synthetic peptide
DEQEIRTVLRDATQQYWSVDTIDDIGEW

SEQ ID NO: 40190 - protein, 36 aa, Artificial Sequence
  Description of Artificial Sequence: Synthetic polypeptide
DEEEIRTTNPFATEQYGSVSSITPGPLVCCDGDEPD

SEQ ID NO: 40191 - protein, 37 aa, Artificial Sequence
  Description of Artificial Sequence: Synthetic polypeptide
DEEEIRTTNPDATEQYGSVCSVTLENGVIIQKGEELA

SEQ ID NO: 40192 - protein, 35 aa, Artificial Sequence
  Description of Artificial Sequence: Synthetic polypeptide
DEVEIGTTNPVATEAYGNVPSLTNNGVDLDDGVNW

SEQ ID NO: 40193 - protein, 28 aa, Artificial Sequence
  Description of Artificial Sequence: Synthetic peptide
DDQEIRVTNIVGTEQYGTVVNREQSSST

SEQ ID NO: 40194 - protein, 35 aa, Artificial Sequence
  Description of Artificial Sequence: Synthetic polypeptide
AENEIATTNPVATEQYGVVDDATTNGLVERGEEDR

SEQ ID NO: 40195 - protein, 29 aa, Artificial Sequence
  Description of Artificial Sequence: Synthetic peptide
DDSEVASTNPVSTEGYGNVANTIQRVGQR

SEQ ID NO: 40196 - protein, 31 aa, Artificial Sequence
  Description of Artificial Sequence: Synthetic polypeptide
GDEEIACTNPVATEQYGEVAEDLDESEGTDR

SEQ ID NO: 40197 - protein, 32 aa, Artificial Sequence
  Description of Artificial Sequence: Synthetic polypeptide
VENEICCTNPVATECYGSVSDTELEIHNGEEH

SEQ ID NO: 40198 - protein, 28 aa, Artificial Sequence
  Description of Artificial Sequence: Synthetic peptide
DEGEIATTNNVITRPYGGTRDNLQYQAT

SEQ ID NO: 40199 - protein, 35 aa, Artificial Sequence
  Description of Artificial Sequence: Synthetic polypeptide
DEEEIAQTNPVATEQYGSVSVTMDPVQEIKGVEDL

SEQ ID NO: 40200 - protein, 28 aa, Artificial Sequence
  Description of Artificial Sequence: Synthetic peptide
DWQEINTTNIVTNEQYGLITDILGRGTV

SEQ ID NO: 40201 - protein, 28 aa, Artificial Sequence
  Description of Artificial Sequence: Synthetic peptide
SEEEIRITNIVATDRVGTVAINQQNSTT

SEQ ID NO: 40202 - protein, 28 aa, Artificial Sequence
  Description of Artificial Sequence: Synthetic peptide
FEHELCAVNPVCTEPWGCVSENVQGGNT

SEQ ID NO: 40203 - protein, 28 aa, Artificial Sequence
  Description of Artificial Sequence: Synthetic peptide
DEEEISATDIVAWEEYGAVANNKQSSTT

SEQ ID NO: 40204 - protein, 33 aa, Artificial Sequence
  Description of Artificial Sequence: Synthetic polypeptide
SEVEIATTNPVATEQFGGVISTMNEQQEGDTTF

SEQ ID NO: 40205 - protein, 35 aa, Artificial Sequence
  Description of Artificial Sequence: Synthetic polypeptide
DENEIAQTNPVATEQYGSVSATTGDVELVEGDNDD

SEQ ID NO: 40206 - protein, 28 aa, Artificial Sequence
  Description of Artificial Sequence: Synthetic peptide
DGEEVRITNNRGYEQIGHTTTNLQSGST

SEQ ID NO: 40207 - protein, 34 aa, Artificial Sequence
  Description of Artificial Sequence: Synthetic polypeptide
AEEEIATTNPVATEQYGDVSCEEEPDQLTLGDNV

SEQ ID NO: 40208 - protein, 28 aa, Artificial Sequence
  Description of Artificial Sequence: Synthetic peptide
NEEEITTTNPVDTDRWGTTHTNVQSSTT

SEQ ID NO: 40209 - protein, 33 aa, Artificial Sequence
  Description of Artificial Sequence: Synthetic polypeptide
DEVEIAATNPTATEQYGGVSEMNEQDQEGDNTF

SEQ ID NO: 40210 - protein, 28 aa, Artificial Sequence
  Description of Artificial Sequence: Synthetic peptide
DTSEINTTNNNFTQQQASKDTNLQGTGN

SEQ ID NO: 40211 - protein, 32 aa, Artificial Sequence
  Description of Artificial Sequence: Synthetic polypeptide
KENEICTTNPVATECYGHVSTGQNSDYKENEL

SEQ ID NO: 40212 - protein, 28 aa, Artificial Sequence
  Description of Artificial Sequence: Synthetic peptide
SEGEIAATNPIATENYGEVSVDWIQGPQ

SEQ ID NO: 40213 - protein, 35 aa, Artificial Sequence
  Description of Artificial Sequence: Synthetic polypeptide
DENEIAQTNPVATEQYGSVSATTGQVELDNGENDD

SEQ ID NO: 40214 - protein, 33 aa, Artificial Sequence
  Description of Artificial Sequence: Synthetic polypeptide
SEGEIRTTNPVCTEQYGTVISTDGWPQTGDTFA

SEQ ID NO: 40215 - protein, 35 aa, Artificial Sequence
  Description of Artificial Sequence: Synthetic polypeptide
DEEEIRTTNPVATEQYGESWSCDIPEQMNNEVEPS

SEQ ID NO: 40216 - protein, 28 aa, Artificial Sequence
  Description of Artificial Sequence: Synthetic peptide
NEEEIITTNPVDTLRWGTTHTNVPGSNT

SEQ ID NO: 40217 - protein, 32 aa, Artificial Sequence
  Description of Artificial Sequence: Synthetic polypeptide
DENEIRTTNPVSTEPYGTISMEDIQQQQNGNH

SEQ ID NO: 40218 - protein, 37 aa, Artificial Sequence
  Description of Artificial Sequence: Synthetic polypeptide
DEEEIRTTNPVATEQYGSVSFCEMNGDVCCDDGFNPC

SEQ ID NO: 40219 - protein, 34 aa, Artificial Sequence
  Description of Artificial Sequence: Synthetic polypeptide
DNVEIRSTNPVATEQYGSVYNADNGEPQREGDPQ

SEQ ID NO: 40220 - protein, 34 aa, Artificial Sequence
  Description of Artificial Sequence: Synthetic polypeptide
DEEEIRTTNPVATEQYGESWSCDIPEQNNEVEPS

SEQ ID NO: 40221 - protein, 34 aa, Artificial Sequence
  Description of Artificial Sequence: Synthetic polypeptide
DEEEIRTTNPVATEQYGDVSCECCPVCCHAGEDQ

SEQ ID NO: 40222 - protein, 32 aa, Artificial Sequence
  Description of Artificial Sequence: Synthetic polypeptide
DEEEIWTVNPVATEGYGVVCSNCILDLKGEPQ

SEQ ID NO: 40223 - protein, 33 aa, Artificial Sequence
  Description of Artificial Sequence: Synthetic polypeptide
DEQEIATTNPVCTEQYGDVDEMNDQCCHNGNDA

SEQ ID NO: 40224 - protein, 35 aa, Artificial Sequence
  Description of Artificial Sequence: Synthetic polypeptide
DENEIAQTNPVATEQYGSVSATTDQVELDNGENDD

SEQ ID NO: 40225 - protein, 37 aa, Artificial Sequence
  Description of Artificial Sequence: Synthetic polypeptide
DEEEIRTTNPFATEQYGSVCSITPNPLVFIDKGDEPP

SEQ ID NO: 40226 - protein, 28 aa, Artificial Sequence
  Description of Artificial Sequence: Synthetic peptide
DEQEIKATNIVATEEWGVTADNLQSTTT

SEQ ID NO: 40227 - protein, 36 aa, Artificial Sequence
  Description of Artificial Sequence: Synthetic polypeptide
DEEEIRTTNPFATEQYGSVSVTEAGPVDLFNGEEPS

SEQ ID NO: 40228 - protein, 28 aa, Artificial Sequence
  Description of Artificial Sequence: Synthetic peptide
DEEEIATTNNVAIEVYGGTRDQAQYQAT

SEQ ID NO: 40229 - protein, 28 aa, Artificial Sequence
  Description of Artificial Sequence: Synthetic peptide
DEDEIKITNNFAREQYGATVDQELQKNT

SEQ ID NO: 40230 - protein, 37 aa, Artificial Sequence
  Description of Artificial Sequence: Synthetic polypeptide
DEEEIRTTNPFATEQYGSVTSITPGPLVDLDNGDNPP

SEQ ID NO: 40231 - protein, 35 aa, Artificial Sequence
  Description of Artificial Sequence: Synthetic polypeptide
DENEIAQTNPVATEQYGSVSATTDQVELVNGENDD

SEQ ID NO: 40232 - protein, 31 aa, Artificial Sequence
  Description of Artificial Sequence: Synthetic polypeptide
QEEEIATTNPVATEQYGEAPAEVLQNHAEEK

SEQ ID NO: 40233 - protein, 28 aa, Artificial Sequence
  Description of Artificial Sequence: Synthetic peptide
DEENINTTNPVDLDNVGTVSDPIGGGNG

SEQ ID NO: 40234 - protein, 33 aa, Artificial Sequence
  Description of Artificial Sequence: Synthetic polypeptide
SEVEIATTNPTATEQFGSVSEMNEQDQEGDNDF

SEQ ID NO: 40235 - protein, 36 aa, Artificial Sequence
  Description of Artificial Sequence: Synthetic polypeptide
DEEEIRTTNPFATEQYGSVSVTEAGPVDLRNGEEPS

SEQ ID NO: 40236 - protein, 33 aa, Artificial Sequence
  Description of Artificial Sequence: Synthetic polypeptide
DENEIASTNPVATECYGVVSATDLQDQNGDEDL

SEQ ID NO: 40237 - protein, 28 aa, Artificial Sequence
  Description of Artificial Sequence: Synthetic peptide
DESETKLTNIVATEMYGKTVTNDYQSNT

SEQ ID NO: 40238 - protein, 33 aa, Artificial Sequence
  Description of Artificial Sequence: Synthetic polypeptide
DEEEIATTNPTATEQYGEVSEMNECCQSEDDTF

SEQ ID NO: 40239 - protein, 28 aa, Artificial Sequence
  Description of Artificial Sequence: Synthetic peptide
DESEVASTNIVSTKMYGVVATQLENGTR

SEQ ID NO: 40240 - protein, 28 aa, Artificial Sequence
  Description of Artificial Sequence: Synthetic peptide
QEDEIAQTNPVATEQYGEAPEVCQHEEK

SEQ ID NO: 40241 - protein, 36 aa, Artificial Sequence
  Description of Artificial Sequence: Synthetic polypeptide
DEEEIRQTNPVATEQYGVVSVTPPNPVQENKGDEDF

SEQ ID NO: 40242 - protein, 31 aa, Artificial Sequence
  Description of Artificial Sequence: Synthetic polypeptide
DENEIRTTNPVATEQWGDVHEIEMNAAELDA

SEQ ID NO: 40243 - protein, 28 aa, Artificial Sequence
  Description of Artificial Sequence: Synthetic peptide
IEGEIATTNSVAWETCGHVATNNQNQGT

SEQ ID NO: 40244 - protein, 33 aa, Artificial Sequence
  Description of Artificial Sequence: Synthetic polypeptide
QEHEICTTNPCATECYGVVSDTDLQETNGDNDM

SEQ ID NO: 40245 - protein, 28 aa, Artificial Sequence
  Description of Artificial Sequence: Synthetic peptide
DEDEINTTNPIDTDNVGTTSTNVQGSTT

SEQ ID NO: 40246 - protein, 35 aa, Artificial Sequence
  Description of Artificial Sequence: Synthetic polypeptide
DEEEIRTTNPDATEQYGSVFCENPLTDCNEGHEDN

SEQ ID NO: 40247 - protein, 33 aa, Artificial Sequence
  Description of Artificial Sequence: Synthetic polypeptide
SEVEIAATNPTATEQYGGVSEGNPQLQEGDNTN

SEQ ID NO: 40248 - protein, 34 aa, Artificial Sequence
  Description of Artificial Sequence: Synthetic polypeptide
DEEEIRTTNPICTEQYGSVYSNEDGVQAQNEVTD

SEQ ID NO: 40249 - protein, 33 aa, Artificial Sequence
  Description of Artificial Sequence: Synthetic polypeptide
DEVEISTTNPVSTELYGSVSATVADVQIGETTF

SEQ ID NO: 40250 - protein, 34 aa, Artificial Sequence
  Description of Artificial Sequence: Synthetic polypeptide
AEQEIVTTNPVATEQYGEVSITGAPLESINGVNQ

SEQ ID NO: 40251 - protein, 34 aa, Artificial Sequence
  Description of Artificial Sequence: Synthetic polypeptide
DEQEIATTNPFATEQYGQVSITLNPPDMSKGNPS

SEQ ID NO: 40252 - protein, 33 aa, Artificial Sequence
  Description of Artificial Sequence: Synthetic polypeptide
DENEINSTNPVATEIYGSVSATELEDMNGEEDA

SEQ ID NO: 40253 - protein, 30 aa, Artificial Sequence
  Description of Artificial Sequence: Synthetic polypeptide
SDQEIACTNPVASEIFGVVAASNLEREGNR

SEQ ID NO: 40254 - protein, 32 aa, Artificial Sequence
  Description of Artificial Sequence: Synthetic polypeptide
QEGEITATNPVATECFGSVISAVGNLQQGPDP

SEQ ID NO: 40255 - protein, 28 aa, Artificial Sequence
  Description of Artificial Sequence: Synthetic peptide
DEEETRITNGVGTEIYGTTADNEQNSAT

SEQ ID NO: 40256 - protein, 32 aa, Artificial Sequence
  Description of Artificial Sequence: Synthetic polypeptide
QEHEIATTNPVATEIYGWVSTENDEDFKGDDP

SEQ ID NO: 40257 - protein, 28 aa, Artificial Sequence
  Description of Artificial Sequence: Synthetic peptide
DEQEVAATNIVSTKIYGVTANNLQSGNT

SEQ ID NO: 40258 - protein, 35 aa, Artificial Sequence
  Description of Artificial Sequence: Synthetic polypeptide
DETEICTTNPVATENYGSVSDTLADQQMSKGEEPR

SEQ ID NO: 40259 - protein, 28 aa, Artificial Sequence
  Description of Artificial Sequence: Synthetic peptide
NEEEIRTTNIFATEMYGATEMINQQSAT

SEQ ID NO: 40260 - protein, 31 aa, Artificial Sequence
  Description of Artificial Sequence: Synthetic polypeptide
VEDEIKTTNPVASEAYGCVGMNLEDRNLTER

SEQ ID NO: 40261 - protein, 33 aa, Artificial Sequence
  Description of Artificial Sequence: Synthetic polypeptide
QEEEIATTNPVATECYGVVSEMALQETNGEDDP

SEQ ID NO: 40262 - protein, 32 aa, Artificial Sequence
  Description of Artificial Sequence: Synthetic polypeptide
QEEEIRATNPVASEQWGVVGTTDLQESDGMDN

SEQ ID NO: 40263 - protein, 37 aa, Artificial Sequence
  Description of Artificial Sequence: Synthetic polypeptide
DEEEIRTTNPFATEQYGSVHSITPNPLVFIDKGDEPP

SEQ ID NO: 40264 - protein, 35 aa, Artificial Sequence
  Description of Artificial Sequence: Synthetic polypeptide
DEEEIGCTNPVATEQYGQVSVENEGGGFRDGINFH

SEQ ID NO: 40265 - protein, 32 aa, Artificial Sequence
  Description of Artificial Sequence: Synthetic polypeptide
DEQEITTTNPCATEVYGVVSCEADQCEQGNDY

SEQ ID NO: 40266 - protein, 34 aa, Artificial Sequence
  Description of Artificial Sequence: Synthetic polypeptide
NEEEIRTTNPCSTEQYGSVSSGEGDQEQQDGNDC

SEQ ID NO: 40267 - protein, 31 aa, Artificial Sequence
  Description of Artificial Sequence: Synthetic polypeptide
DENEIRTTNPVATEQWGDHYSEIEMNQAEDA

SEQ ID NO: 40268 - protein, 34 aa, Artificial Sequence
  Description of Artificial Sequence: Synthetic polypeptide
DEEEIRTTNPVATEQYGDVSCECCPVCCHAGEDL

SEQ ID NO: 40269 - protein, 29 aa, Artificial Sequence
  Description of Artificial Sequence: Synthetic peptide
DEAEIAQTNPVSTEMYGVTCCTLQSHGDY

SEQ ID NO: 40270 - protein, 28 aa, Artificial Sequence
  Description of Artificial Sequence: Synthetic peptide
SEDELKTTNIIATEEYGTVAVELQNSTR

SEQ ID NO: 40271 - protein, 28 aa, Artificial Sequence
  Description of Artificial Sequence: Synthetic peptide
DEEEIATTNIYARVEWGQVATNQQTSST

SEQ ID NO: 40272 - protein, 33 aa, Artificial Sequence
  Description of Artificial Sequence: Synthetic polypeptide
DEEEIATTNPTATEQYGEVSEMLEPCCQEDDTF

SEQ ID NO: 40273 - protein, 28 aa, Artificial Sequence
  Description of Artificial Sequence: Synthetic peptide
DEEEIRTTNIVSNKELGTTADNLQNAST

SEQ ID NO: 40274 - protein, 28 aa, Artificial Sequence
  Description of Artificial Sequence: Synthetic peptide
DEDEINTTNPIDTRPLGTTSTNVQSSTT

SEQ ID NO: 40275 - protein, 36 aa, Artificial Sequence
  Description of Artificial Sequence: Synthetic polypeptide
DEEEIRTTNPFATEQYGSVCSITPPPLVVIDKGDEP

SEQ ID NO: 40276 - protein, 31 aa, Artificial Sequence
  Description of Artificial Sequence: Synthetic polypeptide
DESEISACNPCATEHYGEVSTTDENQLQGDF

SEQ ID NO: 40277 - protein, 28 aa, Artificial Sequence
  Description of Artificial Sequence: Synthetic peptide
YENEITCTNPVCTEPYGGVAEDDCYGND

SEQ ID NO: 40278 - protein, 34 aa, Artificial Sequence
  Description of Artificial Sequence: Synthetic polypeptide
DEQEITTTNPVATEVYGVVSCEMNDQCEQEGNDY

SEQ ID NO: 40279 - protein, 28 aa, Artificial Sequence
  Description of Artificial Sequence: Synthetic peptide
QEGEIAPTNPCSSEHYGIVACNLQSGTT

SEQ ID NO: 40280 - protein, 28 aa, Artificial Sequence
  Description of Artificial Sequence: Synthetic peptide
DESEVNSVNGVSTEHYGGLATNLERAGR

SEQ ID NO: 40281 - protein, 33 aa, Artificial Sequence
  Description of Artificial Sequence: Synthetic polypeptide
SENEIRTTNPVATEQYGCSHYSEALQDQYEAQP

SEQ ID NO: 40282 - protein, 33 aa, Artificial Sequence
  Description of Artificial Sequence: Synthetic polypeptide
DESEIQTTNPVATECWGGVSCINEPQDHEGENG

SEQ ID NO: 40283 - protein, 36 aa, Artificial Sequence
  Description of Artificial Sequence: Synthetic polypeptide
DEEEIRTTNPVATEQYGFVSSTTPAGPNMRNGMDPV

SEQ ID NO: 40284 - protein, 37 aa, Artificial Sequence
  Description of Artificial Sequence: Synthetic polypeptide
DEEEIRTTNPVATEQYGSVVVFCEMNPLCCADGDNDC

SEQ ID NO: 40285 - protein, 34 aa, Artificial Sequence
  Description of Artificial Sequence: Synthetic polypeptide
QEEEIAATNPVATECYGSVSATEDLQDTKGEEDP

SEQ ID NO: 40286 - protein, 37 aa, Artificial Sequence
  Description of Artificial Sequence: Synthetic polypeptide
DEEEIRTTNPFATEQYGSVTSITPGPLVDLPNGDNPD

SEQ ID NO: 40287 - protein, 34 aa, Artificial Sequence
  Description of Artificial Sequence: Synthetic polypeptide
DENEIAQTNPVATEQYGVVSVTGGPVEDRGDNDI

SEQ ID NO: 40288 - protein, 28 aa, Artificial Sequence
  Description of Artificial Sequence: Synthetic peptide
NEEEIITTNPVDTLRWGTTHTNVQSSTT

SEQ ID NO: 40289 - protein, 36 aa, Artificial Sequence
  Description of Artificial Sequence: Synthetic polypeptide
DEEEIRQTNPVATEQYGVVSVTPPNPVLENKGDEDF

SEQ ID NO: 40290 - protein, 28 aa, Artificial Sequence
  Description of Artificial Sequence: Synthetic peptide
MENEIATTNPVATEVFGIVSETPDFFMS

SEQ ID NO: 40291 - protein, 31 aa, Artificial Sequence
  Description of Artificial Sequence: Synthetic polypeptide
QEAEIASTNPVATECYGVVSEMALQETGDDP

SEQ ID NO: 40292 - protein, 33 aa, Artificial Sequence
  Description of Artificial Sequence: Synthetic polypeptide
DEVEICTTNPTATEQYGEVISEANPQELGVDTH

SEQ ID NO: 40293 - protein, 32 aa, Artificial Sequence
  Description of Artificial Sequence: Synthetic polypeptide
QEEEIATTNPVATECYGDVSCECLQIHKEEDN

SEQ ID NO: 40294 - protein, 31 aa, Artificial Sequence
  Description of Artificial Sequence: Synthetic polypeptide
DETEIRTTNPIATECWGATATEDLQEPKGPI

SEQ ID NO: 40295 - protein, 33 aa, Artificial Sequence
  Description of Artificial Sequence: Synthetic polypeptide
DEEEIATTNPTATEQYGEVSEMNEQCQSEDDTF

SEQ ID NO: 40296 - protein, 28 aa, Artificial Sequence
  Description of Artificial Sequence: Synthetic peptide
DEDEIQTTNMVGTKEVGKTWTNEQASNT

SEQ ID NO: 40297 - protein, 34 aa, Artificial Sequence
  Description of Artificial Sequence: Synthetic polypeptide
DENEIAQTNPVATEQYGSVSTGGPVEDEKGDNDI

SEQ ID NO: 40298 - protein, 32 aa, Artificial Sequence
  Description of Artificial Sequence: Synthetic polypeptide
AEVEISATNPVSTEHFGGVSTANLPQIGNDWQ

SEQ ID NO: 40299 - protein, 28 aa, Artificial Sequence
  Description of Artificial Sequence: Synthetic peptide
NEEETRITNIVDTEQFGRTASNEQISNT

SEQ ID NO: 40300 - protein, 33 aa, Artificial Sequence
  Description of Artificial Sequence: Synthetic polypeptide
SEEEIRATNPVATEQFGEVSEMNPQLIEGDDDF

SEQ ID NO: 40301 - protein, 33 aa, Artificial Sequence
  Description of Artificial Sequence: Synthetic polypeptide
DENEIASTNPVASEQYGVVSATDLQDQNGDEDL

SEQ ID NO: 40302 - protein, 28 aa, Artificial Sequence
  Description of Artificial Sequence: Synthetic peptide
YDHELATTNPCSTESYGCVCCNWQNENR

SEQ ID NO: 40303 - protein, 32 aa, Artificial Sequence
  Description of Artificial Sequence: Synthetic polypeptide
DEHEIRTTNPCATESYGCVGTEEWEPQELENG

SEQ ID NO: 40304 - protein, 28 aa, Artificial Sequence
  Description of Artificial Sequence: Synthetic peptide
DEEEIAATNGFGWKQYGMVATNEQNKST

SEQ ID NO: 40305 - protein, 35 aa, Artificial Sequence
  Description of Artificial Sequence: Synthetic polypeptide
SEEEIRTTNPVATEQFGEVISTMNDPQMIEGIDTA

SEQ ID NO: 40306 - protein, 33 aa, Artificial Sequence
  Description of Artificial Sequence: Synthetic polypeptide
DEEEIATTNPTATEQYGEVSEMNEPCCQEDDTF

SEQ ID NO: 40307 - protein, 28 aa, Artificial Sequence
  Description of Artificial Sequence: Synthetic peptide
DEEELAATNIVATKSGGETATNLQVSAD

SEQ ID NO: 40308 - protein, 30 aa, Artificial Sequence
  Description of Artificial Sequence: Synthetic polypeptide
AEEEIATTNPVATEQYGEAPAEVCQHAEEK

SEQ ID NO: 40309 - protein, 37 aa, Artificial Sequence
  Description of Artificial Sequence: Synthetic polypeptide
DEEEIRTTNPFATEQYGSVSSITPGPLVDLPNGDNPD

SEQ ID NO: 40310 - protein, 31 aa, Artificial Sequence
  Description of Artificial Sequence: Synthetic polypeptide
QECEIRTTNPCSTEQYGSVDEMDDQQEQGDM

SEQ ID NO: 40311 - protein, 37 aa, Artificial Sequence
  Description of Artificial Sequence: Synthetic polypeptide
DEEEIRTTNPFATEQYGSVISVTMGGEPDLNEGDNCG

SEQ ID NO: 40312 - protein, 31 aa, Artificial Sequence
  Description of Artificial Sequence: Synthetic polypeptide
SEDEIVATNPVATETFGEVSENPQIEGDDDR

SEQ ID NO: 40313 - protein, 28 aa, Artificial Sequence
  Description of Artificial Sequence: Synthetic peptide
NEQHIRTTNIVATESYGVTADNEQNSTT

SEQ ID NO: 40314 - protein, 33 aa, Artificial Sequence
  Description of Artificial Sequence: Synthetic polypeptide
DEEEIRSTNPVATEVYGCVGITEELEDNDGDEL

SEQ ID NO: 40315 - protein, 37 aa, Artificial Sequence
  Description of Artificial Sequence: Synthetic polypeptide
DEEEIRTTNPFATEQYGSVTSITPGPDVDLDNGDNPP

SEQ ID NO: 40316 - protein, 28 aa, Artificial Sequence
  Description of Artificial Sequence: Synthetic peptide
DEEEINTTNPIDTDRWGTTHTNVQGSTT

SEQ ID NO: 40317 - protein, 28 aa, Artificial Sequence
  Description of Artificial Sequence: Synthetic peptide
DEIEWRATNIVGSEVYTGTASNLLSGTR

SEQ ID NO: 40318 - protein, 33 aa, Artificial Sequence
  Description of Artificial Sequence: Synthetic polypeptide
DEEEVRTTNPTATFIYGCVDDDTALELRDGNDF

SEQ ID NO: 40319 - protein, 28 aa, Artificial Sequence
  Description of Artificial Sequence: Synthetic peptide
DEQEVATVNGVATEIYGVVRDNHQNQAT

SEQ ID NO: 40320 - protein, 28 aa, Artificial Sequence
  Description of Artificial Sequence: Synthetic peptide
DEEEIRATNIVGWETYGGVRDQEQNKTN

SEQ ID NO: 40321 - protein, 38 aa, Artificial Sequence
  Description of Artificial Sequence: Synthetic polypeptide
DEQEIRTTNPVATEQYGYSVQSLTIDTLADIQDEGNNI

SEQ ID NO: 40322 - protein, 31 aa, Artificial Sequence
  Description of Artificial Sequence: Synthetic polypeptide
DDQEIRCTNPIAYEIYGAVGASNLEVNGNDR

SEQ ID NO: 40323 - protein, 28 aa, Artificial Sequence
  Description of Artificial Sequence: Synthetic peptide
QESEVASTNPVGTEGYGVMASTLQHGDI

SEQ ID NO: 40324 - protein, 28 aa, Artificial Sequence
  Description of Artificial Sequence: Synthetic peptide
QENEITATNPVGTECYGCVAENPAVGPH

SEQ ID NO: 40325 - protein, 35 aa, Artificial Sequence
  Description of Artificial Sequence: Synthetic polypeptide
DEEEIRTTNPDATEQYGSVFCENPLVDCNEGHEDN

SEQ ID NO: 40326 - protein, 31 aa, Artificial Sequence
  Description of Artificial Sequence: Synthetic polypeptide
MENEIATVNPVATECYGSVSEDEQDHEGEDQ

SEQ ID NO: 40327 - protein, 36 aa, Artificial Sequence
  Description of Artificial Sequence: Synthetic polypeptide
DEVEIGTTNPVATEAYGNVPSLTNNGVDLDDGVNEW

SEQ ID NO: 40328 - protein, 33 aa, Artificial Sequence
  Description of Artificial Sequence: Synthetic polypeptide
SEVEIAATNPTATEQYGGVSEMNEQDQEGDNTF

SEQ ID NO: 40329 - protein, 28 aa, Artificial Sequence
  Description of Artificial Sequence: Synthetic peptide
DEGEIAGTNIRATDTEGEVVDNLQYFTT

SEQ ID NO: 40330 - protein, 36 aa, Artificial Sequence
  Description of Artificial Sequence: Synthetic polypeptide
DEEEIRTTNPVATECYGFVSSTTPAGPNMRNGMDPV

SEQ ID NO: 40331 - protein, 35 aa, Artificial Sequence
  Description of Artificial Sequence: Synthetic polypeptide
QETEICTTNPVATENYGSVSDTLADQQMSKGEEPR

SEQ ID NO: 40332 - protein, 32 aa, Artificial Sequence
  Description of Artificial Sequence: Synthetic polypeptide
QEEEIRATNPVASEQWGVVGTTDLQESDPMDN

SEQ ID NO: 40333 - protein, 32 aa, Artificial Sequence
  Description of Artificial Sequence: Synthetic polypeptide
VEDEIKTTNPVASEAYGCVGAMNLEDRNLTER

SEQ ID NO: 40334 - protein, 37 aa, Artificial Sequence
  Description of Artificial Sequence: Synthetic polypeptide
DEEEIRTTNPVATEQYGSVVVFCEMNPDCCAFGFNDC

SEQ ID NO: 40335 - protein, 28 aa, Artificial Sequence
  Description of Artificial Sequence: Synthetic peptide
SEGEIAATNPISTENYGEVSVDWIQGPQ

SEQ ID NO: 40336 - protein, 33 aa, Artificial Sequence
  Description of Artificial Sequence: Synthetic polypeptide
VENEICCTNPVATECYGSVSDTELEIHNGEEDH

SEQ ID NO: 40337 - protein, 31 aa, Artificial Sequence
  Description of Artificial Sequence: Synthetic polypeptide
SENEIRTTNPVATECWGIYSEEDENGNGDDT

SEQ ID NO: 40338 - protein, 33 aa, Artificial Sequence
  Description of Artificial Sequence: Synthetic polypeptide
DEVEIATTNPTATEQYGEVSEMLEPCCQEDDTF

SEQ ID NO: 40339 - protein, 32 aa, Artificial Sequence
  Description of Artificial Sequence: Synthetic polypeptide
KENEICTTNPVATECYGHVSTGQNSDYKEMEL

SEQ ID NO: 40340 - protein, 28 aa, Artificial Sequence
  Description of Artificial Sequence: Synthetic peptide
DEEEIKATNNVGTESWGYWANGLQGSTT

SEQ ID NO: 40341 - protein, 30 aa, Artificial Sequence
  Description of Artificial Sequence: Synthetic polypeptide
DDSEVASTNPVSTEGYGNVANTIQSRVGQR

SEQ ID NO: 40342 - protein, 28 aa, Artificial Sequence
  Description of Artificial Sequence: Synthetic peptide
DEDEVASTNITSTEIYGVLANVVQRGGT

SEQ ID NO: 40343 - protein, 37 aa, Artificial Sequence
  Description of Artificial Sequence: Synthetic polypeptide
DEEEIRTTNPFATEQYGSVSSITPGPLVCCDNGDEPD

SEQ ID NO: 40344 - protein, 35 aa, Artificial Sequence
  Description of Artificial Sequence: Synthetic polypeptide
DENEIAQTNPVATEQYGSVSTPGGPVEDEKGDNDI

SEQ ID NO: 40345 - protein, 36 aa, Artificial Sequence
  Description of Artificial Sequence: Synthetic polypeptide
DENEIAQTNPVATEQYGSVSATTGGQVELDNGENDD

SEQ ID NO: 40346 - protein, 32 aa, Artificial Sequence
  Description of Artificial Sequence: Synthetic polypeptide
SEVEIACTNPTATEQYGEVISEMGEQREGTDF

SEQ ID NO: 40347 - protein, 28 aa, Artificial Sequence
  Description of Artificial Sequence: Synthetic peptide
GESEIVQTNITHTDQLGSTRTNLQSAGD

SEQ ID NO: 40348 - protein, 28 aa, Artificial Sequence
  Description of Artificial Sequence: Synthetic peptide
DEQEGANTNPVITEVLGGVRTQLLNTTT

SEQ ID NO: 40349 - protein, 34 aa, Artificial Sequence
  Description of Artificial Sequence: Synthetic polypeptide
DEEEIRTTNPVATEQYGDVSCECCPVCCHAEEDQ

SEQ ID NO: 40350 - protein, 28 aa, Artificial Sequence
  Description of Artificial Sequence: Synthetic peptide
DGDAIITTNNVAIEIGSTVSTRINQGSG

SEQ ID NO: 40351 - protein, 28 aa, Artificial Sequence
  Description of Artificial Sequence: Synthetic peptide
DEDEIRITNIIDENTYGQVATNEQQNTT

SEQ ID NO: 40352 - protein, 33 aa, Artificial Sequence
  Description of Artificial Sequence: Synthetic polypeptide
SEVEICTTNPTATEQYGEVISEANPQELGVDTH

SEQ ID NO: 40353 - protein, 33 aa, Artificial Sequence
  Description of Artificial Sequence: Synthetic polypeptide
QEHEIATTNPVATEIYGWVSTENDEDFKGDDEP

SEQ ID NO: 40354 - protein, 28 aa, Artificial Sequence
  Description of Artificial Sequence: Synthetic peptide
SEEATTGTNIVTEENYNKVSDNLQGNAT

SEQ ID NO: 40355 - protein, 28 aa, Artificial Sequence
  Description of Artificial Sequence: Synthetic peptide
DWQNINFTNIVTDDQYGLVSDIIQGGNT

SEQ ID NO: 40356 - protein, 32 aa, Artificial Sequence
  Description of Artificial Sequence: Synthetic polypeptide
GDEEIACTNPVATEQYGEVAEDPLDESEGTDR

SEQ ID NO: 40357 - protein, 30 aa, Artificial Sequence
  Description of Artificial Sequence: Synthetic polypeptide
AEEEIATTNPVATEGYGEAPAEVCQHAEEK

SEQ ID NO: 40358 - protein, 32 aa, Artificial Sequence
  Description of Artificial Sequence: Synthetic polypeptide
QENEIATTNPVATECYGDVSCECLQIHAEEDN

SEQ ID NO: 40359 - protein, 35 aa, Artificial Sequence
  Description of Artificial Sequence: Synthetic polypeptide
SENEIRTTNPVATEQFGEVISTMNDPQMIEGIDTA

SEQ ID NO: 40360 - protein, 28 aa, Artificial Sequence
  Description of Artificial Sequence: Synthetic peptide
DEDEIATTNNVITRPLGGTRDNLQYTAT

SEQ ID NO: 40361 - protein, 32 aa, Artificial Sequence
  Description of Artificial Sequence: Synthetic polypeptide
QEAEIASTNPVATECYGVVSEMALQETGEDDP

SEQ ID NO: 40362 - protein, 28 aa, Artificial Sequence
  Description of Artificial Sequence: Synthetic peptide
DEEEGNNTNPVDTRPLGGVRTQLLNTAT

SEQ ID NO: 40363 - protein, 34 aa, Artificial Sequence
  Description of Artificial Sequence: Synthetic polypeptide
DEQEIAATNPFATEQYGQVSITLNPPDMSKGNPS

SEQ ID NO: 40364 - protein, 35 aa, Artificial Sequence
  Description of Artificial Sequence: Synthetic polypeptide
AEQEIVTTNPVATEQYGEVSITGAPLTESINGVNQ

SEQ ID NO: 40365 - protein, 28 aa, Artificial Sequence
  Description of Artificial Sequence: Synthetic peptide
NEEEIITTNPVDTLRWGTTHTNVPGSTT

SEQ ID NO: 40366 - protein, 32 aa, Artificial Sequence
  Description of Artificial Sequence: Synthetic polypeptide
QENEIATTNPVATECYGDVSCECLQIHKEEDN

SEQ ID NO: 40367 - protein, 33 aa, Artificial Sequence
  Description of Artificial Sequence: Synthetic polypeptide
QEHEICTTNPCATECYGVVSDTDLEETNGDNDM

SEQ ID NO: 40368 - protein, 34 aa, Artificial Sequence
  Description of Artificial Sequence: Synthetic polypeptide
SEEEIRATNPVATEQFGEVISEMNPQLIEGDDDF

SEQ ID NO: 40369 - protein, 37 aa, Artificial Sequence
  Description of Artificial Sequence: Synthetic polypeptide
CEEEIRTTNPVATEQYGSVSSLTMEGLVETSEGETLQ

SEQ ID NO: 40370 - protein, 28 aa, Artificial Sequence
  Description of Artificial Sequence: Synthetic peptide
DEEGIIQTNGNATEIYGQIADNLYNNKT

SEQ ID NO: 40371 - protein, 30 aa, Artificial Sequence
  Description of Artificial Sequence: Synthetic polypeptide
SDQEIACTNPVASEIFGVVAASNLEPEGNR

SEQ ID NO: 40372 - protein, 35 aa, Artificial Sequence
  Description of Artificial Sequence: Synthetic polypeptide
DEDEIGCTNPVATEQYGQVSVENEGGGFRDGINFH

SEQ ID NO: 40373 - protein, 37 aa, Artificial Sequence
  Description of Artificial Sequence: Synthetic polypeptide
DEEEIRCTNPDATEQYGSVCSVTLENGVIIQKGEELA

SEQ ID NO: 40374 - protein, 34 aa, Artificial Sequence
  Description of Artificial Sequence: Synthetic polypeptide
DEEEIATTNPTATEQYGEVSEMNEPCCQSEDDTF

SEQ ID NO: 40375 - protein, 33 aa, Artificial Sequence
  Description of Artificial Sequence: Synthetic polypeptide
SEVEIAATNPTATEQFGGVSEGNPQLQEGDNTN

SEQ ID NO: 40376 - protein, 28 aa, Artificial Sequence
  Description of Artificial Sequence: Synthetic peptide
DEEETNTTNPIDTRRLGGTSDNVQNSGT

SEQ ID NO: 40377 - protein, 31 aa, Artificial Sequence
  Description of Artificial Sequence: Synthetic polypeptide
DDSEVASTNPVSTEGYGNVAANTIQSRVGQR

SEQ ID NO: 40378 - protein, 34 aa, Artificial Sequence
  Description of Artificial Sequence: Synthetic polypeptide
DEEEIATTNPTATEQYGEVSEMLEPCCQSEDDTF

SEQ ID NO: 40379 - protein, 28 aa, Artificial Sequence
  Description of Artificial Sequence: Synthetic peptide
DEEEGATTNNVITENYTGTMDQLQYSAT

SEQ ID NO: 40380 - protein, 28 aa, Artificial Sequence
  Description of Artificial Sequence: Synthetic peptide
DEEEINATNIYGWEIYGLTADNLQQSWT

SEQ ID NO: 40381 - protein, 31 aa, Artificial Sequence
  Description of Artificial Sequence: Synthetic polypeptide
DETEIRTTNPIATECWGATAAEDLQEPKGPI

SEQ ID NO: 40382 - protein, 34 aa, Artificial Sequence
  Description of Artificial Sequence: Synthetic polypeptide
DEEEISCTNPDATENYGWVASLTTNIQQDDGIMD

SEQ ID NO: 40383 - protein, 28 aa, Artificial Sequence
  Description of Artificial Sequence: Synthetic peptide
DEDEIATTNNIITRPLGGTRTNLQYSTT

SEQ ID NO: 40384 - protein, 33 aa, Artificial Sequence
  Description of Artificial Sequence: Synthetic polypeptide
DESEIQCTNPVATECWGGVSCINEPQDHEGENG

SEQ ID NO: 40385 - protein, 36 aa, Artificial Sequence
  Description of Artificial Sequence: Synthetic polypeptide
SEEEIRATNPTATEQYGSVISEMNGEPQDQEGDNTF

SEQ ID NO: 40386 - protein, 33 aa, Artificial Sequence
  Description of Artificial Sequence: Synthetic polypeptide
DEEEIVCTNPVATECYGWVSEMGPLELPKGDEV

SEQ ID NO: 40387 - protein, 28 aa, Artificial Sequence
  Description of Artificial Sequence: Synthetic peptide
DEEDINGTNIVINKQTGLTATNEQSRNT

SEQ ID NO: 40388 - protein, 33 aa, Artificial Sequence
  Description of Artificial Sequence: Synthetic polypeptide
QEEEIASTNPVATECYGVVSEMALQETNGEDDP

SEQ ID NO: 40389 - protein, 28 aa, Artificial Sequence
  Description of Artificial Sequence: Synthetic peptide
NEEEIQTNSIVATDNYDVLATNLMGTNS

SEQ ID NO: 40390 - protein, 34 aa, Artificial Sequence
  Description of Artificial Sequence: Synthetic polypeptide
DEEEIRCTNPTCTEHYGSVYSALDLQDIEGDTTG

SEQ ID NO: 40391 - protein, 28 aa, Artificial Sequence
  Description of Artificial Sequence: Synthetic peptide
SEEEINTTNIIDTDSWDVGVTNLQNSNT

SEQ ID NO: 40392 - protein, 28 aa, Artificial Sequence
  Description of Artificial Sequence: Synthetic peptide
DEEEISTINIVDTRVTGITAVNQQSANT

SEQ ID NO: 40393 - protein, 34 aa, Artificial Sequence
  Description of Artificial Sequence: Synthetic polypeptide
DEEEIAATNPFATEQYGQVCDIELNPQDSKGTNS

SEQ ID NO: 40394 - protein, 28 aa, Artificial Sequence
  Description of Artificial Sequence: Synthetic peptide
DEGEIATTNNVITRPLGGTRDNLQYQAT

SEQ ID NO: 40395 - protein, 35 aa, Artificial Sequence
  Description of Artificial Sequence: Synthetic polypeptide
DEEEIRTTNPDATEQYGSVFCEPPLTDCNEGIEDN

SEQ ID NO: 40396 - protein, 28 aa, Artificial Sequence
  Description of Artificial Sequence: Synthetic peptide
DESEIAATNIVAWEVYTSTRDNLLNSAQ

SEQ ID NO: 40397 - protein, 28 aa, Artificial Sequence
  Description of Artificial Sequence: Synthetic peptide
DEEEINTTNPIDTDNVGTTHTNVGGKTG

SEQ ID NO: 40398 - protein, 32 aa, Artificial Sequence
  Description of Artificial Sequence: Synthetic polypeptide
AEDEVKTTNPVATEPYGQCSADLLQNIAGPQR

SEQ ID NO: 40399 - protein, 37 aa, Artificial Sequence
  Description of Artificial Sequence: Synthetic polypeptide
DEEEIRTTNPVATEQYGSVVVFCEMNPDCCADGDNDC

SEQ ID NO: 40400 - protein, 29 aa, Artificial Sequence
  Description of Artificial Sequence: Synthetic peptide
DEAEIAQTNPVSTEMYGVTCCTIQSHGDY

SEQ ID NO: 40401 - protein, 28 aa, Artificial Sequence
  Description of Artificial Sequence: Synthetic peptide
DEDETATTNIVATIMWSNTATHLQSSNT

SEQ ID NO: 40402 - protein, 28 aa, Artificial Sequence
  Description of Artificial Sequence: Synthetic peptide
DEEEINTTNPIDTDRWGTTHTNVGGSTT

SEQ ID NO: 40403 - protein, 28 aa, Artificial Sequence
  Description of Artificial Sequence: Synthetic peptide
NEEEIITTNPIDTLRWGTTHTNVQGSTT

SEQ ID NO: 40404 - protein, 28 aa, Artificial Sequence
  Description of Artificial Sequence: Synthetic peptide
SEETIATTNSVAIKVYGKTIDNLQAADT

SEQ ID NO: 40405 - protein, 32 aa, Artificial Sequence
  Description of Artificial Sequence: Synthetic polypeptide
DENEITTTNPVSTEPYGTISMEDIQQQQNGNH

SEQ ID NO: 40406 - protein, 34 aa, Artificial Sequence
  Description of Artificial Sequence: Synthetic polypeptide
SENEIRTTNPVATEQYGCSHYSEALQQDQYEAQP

SEQ ID NO: 40407 - protein, 28 aa, Artificial Sequence
  Description of Artificial Sequence: Synthetic peptide
DESEIRITNGVGTRMYGQGSRNDISATT

SEQ ID NO: 40408 - protein, 28 aa, Artificial Sequence
  Description of Artificial Sequence: Synthetic peptide
DEEEIATANHVAYEVEGGLVDQLLNQNT

SEQ ID NO: 40409 - protein, 28 aa, Artificial Sequence
  Description of Artificial Sequence: Synthetic peptide
SEDEVRTTNIVGWEMYGVTATNTQSTSS

SEQ ID NO: 40410 - protein, 28 aa, Artificial Sequence
  Description of Artificial Sequence: Synthetic peptide
DEGEIRIGNIVAYEVTGQTATNVQSATT

SEQ ID NO: 40411 - protein, 37 aa, Artificial Sequence
  Description of Artificial Sequence: Synthetic polypeptide
DEEEIRTTNPVATEQYGSVSFCEMEGDVCCDDGFNPC

SEQ ID NO: 40412 - protein, 28 aa, Artificial Sequence
  Description of Artificial Sequence: Synthetic peptide
SEDEIRTENIVAWDTFGVTVTNLQNATT

SEQ ID NO: 40413 - protein, 28 aa, Artificial Sequence
  Description of Artificial Sequence: Synthetic peptide
DEEEVRTNNIIAYEIFGTTAINLGSANT

SEQ ID NO: 40414 - protein, 28 aa, Artificial Sequence
  Description of Artificial Sequence: Synthetic peptide
DSNEITTNNIVDTLDLGSVSENLGSATV

SEQ ID NO: 40415 - protein, 36 aa, Artificial Sequence
  Description of Artificial Sequence: Synthetic polypeptide
DENEIAQTNPVATEQYGSVSATTDGQVELDNGENDD

SEQ ID NO: 40416 - protein, 28 aa, Artificial Sequence
  Description of Artificial Sequence: Synthetic peptide
DEESIRNTLAVTTEIYRVVDDSDYGRGN

SEQ ID NO: 40417 - protein, 33 aa, Artificial Sequence
  Description of Artificial Sequence: Synthetic polypeptide
QENEINSTNPVATEIYGSVSATELEDMNGEEDA

SEQ ID NO: 40418 - protein, 28 aa, Artificial Sequence
  Description of Artificial Sequence: Synthetic peptide
DEEEIATTNIRGIKIYGAVADNELNQNT

SEQ ID NO: 40419 - protein, 33 aa, Artificial Sequence
  Description of Artificial Sequence: Synthetic polypeptide
DENEIASTNPVASECYGVVSATDLQDQNGDEDL

SEQ ID NO: 40420 - protein, 28 aa, Artificial Sequence
  Description of Artificial Sequence: Synthetic peptide
REEEILGTNHVAWDRWGAVVTNEQENTT

SEQ ID NO: 40421 - protein, 37 aa, Artificial Sequence
  Description of Artificial Sequence: Synthetic polypeptide
DEEEIRTTNPDATEQYGSVESCTPPPDTDEDEGENDD

SEQ ID NO: 40422 - protein, 36 aa, Artificial Sequence
  Description of Artificial Sequence: Synthetic polypeptide
AENEIATTNPVATEQYGVVDDATTNGLVELRGEEDR

SEQ ID NO: 40423 - protein, 29 aa, Artificial Sequence
  Description of Artificial Sequence: Synthetic peptide
CEGEVAATNPCATEHYGCVSACTVQQGQF

SEQ ID NO: 40424 - protein, 28 aa, Artificial Sequence
  Description of Artificial Sequence: Synthetic peptide
AEEDTKITNGVGTKQYGKTANNLQNTNT

SEQ ID NO: 40425 - protein, 28 aa, Artificial Sequence
  Description of Artificial Sequence: Synthetic peptide
NEDEVAATNGVSTEMYGMVATNYENLTR

SEQ ID NO: 40426 - protein, 28 aa, Artificial Sequence
  Description of Artificial Sequence: Synthetic peptide
DEEELQTVNIVDTERFGRTANNAQSTNT

SEQ ID NO: 40427 - protein, 28 aa, Artificial Sequence
  Description of Artificial Sequence: Synthetic peptide
SEEEIRSTNIIGWKEYGYTVNNLQSSNT

SEQ ID NO: 40428 - protein, 28 aa, Artificial Sequence
  Description of Artificial Sequence: Synthetic peptide
QESEVASTNPVGTEGYGVMASTIQHGDI

SEQ ID NO: 40429 - protein, 28 aa, Artificial Sequence
  Description of Artificial Sequence: Synthetic peptide
NEEEIITTNPVDTLRWGTTHTNVPSSTT

SEQ ID NO: 40430 - protein, 28 aa, Artificial Sequence
  Description of Artificial Sequence: Synthetic peptide
DDSEIATTNVVATDIYGKVAVNMYNSST

SEQ ID NO: 40431 - protein, 31 aa, Artificial Sequence
  Description of Artificial Sequence: Synthetic polypeptide
QEEEIATTNPVATEQYGEAPAEVCQNHAEEK

SEQ ID NO: 40432 - protein, 33 aa, Artificial Sequence
  Description of Artificial Sequence: Synthetic polypeptide
SEVEIATTNPTATEQFGSVSEMNEQDQEGDTDF

SEQ ID NO: 40433 - protein, 28 aa, Artificial Sequence
  Description of Artificial Sequence: Synthetic peptide
DEEEVRAVNIVSSKIYGCTGDNLERATR

SEQ ID NO: 40434 - protein, 34 aa, Artificial Sequence
  Description of Artificial Sequence: Synthetic polypeptide
DEEEIRTTNPVATEQYGDVSCECCPVCCHAEEDL

SEQ ID NO: 40435 - protein, 28 aa, Artificial Sequence
  Description of Artificial Sequence: Synthetic peptide
STSEIAATNITAWEIYGKVVDNLQSQNT

SEQ ID NO: 40436 - protein, 32 aa, Artificial Sequence
  Description of Artificial Sequence: Synthetic polypeptide
QENEIVATNPVATECYGVVSTELEMGEGEEDD

SEQ ID NO: 40437 - protein, 28 aa, Artificial Sequence
  Description of Artificial Sequence: Synthetic peptide
QSEEILAVNIVATEMFGKVESNNQQANT

SEQ ID NO: 40438 - protein, 35 aa, Artificial Sequence
  Description of Artificial Sequence: Synthetic polypeptide
DENEIAQTNPVATEQYGVVSVTGGPVEDRKGDNDI

SEQ ID NO: 40439 - protein, 36 aa, Artificial Sequence
  Description of Artificial Sequence: Synthetic polypeptide
DENEIAQTNPVATEQYGSVSATTDGQVELVNGENDD

SEQ ID NO: 40440 - protein, 36 aa, Artificial Sequence
  Description of Artificial Sequence: Synthetic polypeptide
AEEEIRQTNPVATEQYGVVSVTPPNPVLENKGDEDF

SEQ ID NO: 40441 - protein, 28 aa, Artificial Sequence
  Description of Artificial Sequence: Synthetic peptide
DEDEIGTVNGVAQSVLSWVSTQLQTQAN

SEQ ID NO: 40442 - protein, 28 aa, Artificial Sequence
  Description of Artificial Sequence: Synthetic peptide
DTSETRTTNDVGILEYGHTNTNVDNGNT

SEQ ID NO: 40443 - protein, 32 aa, Artificial Sequence
  Description of Artificial Sequence: Synthetic polypeptide
DENEIRTTNPVATEQWGDHYSEIEMNQAELDA

SEQ ID NO: 40444 - protein, 34 aa, Artificial Sequence
  Description of Artificial Sequence: Synthetic polypeptide
DEEEIRTTNPICTEQYGVVYSNEDGVQAQNEVTD

SEQ ID NO: 40445 - protein, 33 aa, Artificial Sequence
  Description of Artificial Sequence: Synthetic polypeptide
QEAEIASTNPVATECYGVVSEMALQETNGEDDP

SEQ ID NO: 40446 - protein, 33 aa, Artificial Sequence
  Description of Artificial Sequence: Synthetic polypeptide
QENEINSTNPVATEIYGSVSAMELEDMNGEEDA

SEQ ID NO: 40447 - protein, 28 aa, Artificial Sequence
  Description of Artificial Sequence: Synthetic peptide
NEEEIITTNPIDTLRWGTTHTNVPGSGT

SEQ ID NO: 40448 - protein, 28 aa, Artificial Sequence
  Description of Artificial Sequence: Synthetic peptide
SVNEIVCTNPECTEFFGLVSEDEQQGLV

SEQ ID NO: 40449 - protein, 28 aa, Artificial Sequence
  Description of Artificial Sequence: Synthetic peptide
SEEEIATTNCYSAEIYGTTSNQQVYRTQ

SEQ ID NO: 40450 - protein, 28 aa, Artificial Sequence
  Description of Artificial Sequence: Synthetic peptide
DEQEVATTNGFAIEVYGETSDNTLNATT

SEQ ID NO: 40451 - protein, 34 aa, Artificial Sequence
  Description of Artificial Sequence: Synthetic polypeptide
DEEEIRCTNPTCTEHYGTVYSALDLQDIEGDTTG

SEQ ID NO: 40452 - protein, 36 aa, Artificial Sequence
  Description of Artificial Sequence: Synthetic polypeptide
DENEIAQTNPVATEQYGSVSATTGGQVELDNGEEDD

SEQ ID NO: 40453 - protein, 35 aa, Artificial Sequence
  Description of Artificial Sequence: Synthetic polypeptide
DEQEIAATNPFATEQYGQVSIELNPPQDMSKGNPS

SEQ ID NO: 40454 - protein, 28 aa, Artificial Sequence
  Description of Artificial Sequence: Synthetic peptide
NEDEVTAENIVDTEHYRRTSENLRGSNG

SEQ ID NO: 40455 - protein, 28 aa, Artificial Sequence
  Description of Artificial Sequence: Synthetic peptide
NEQEIITTNAVANLMGGTMHTNHTSKNT

SEQ ID NO: 40456 - protein, 32 aa, Artificial Sequence
  Description of Artificial Sequence: Synthetic polypeptide
VEDEIKTTNPVASEAYGCVGAMNLEDRNLTED

SEQ ID NO: 40457 - protein, 28 aa, Artificial Sequence
  Description of Artificial Sequence: Synthetic peptide
DEEEGNTTNPIDTRVLGGTRDNVQNSGT

SEQ ID NO: 40458 - protein, 28 aa, Artificial Sequence
  Description of Artificial Sequence: Synthetic peptide
DEEEIITGTIVDRKVFGNNSTNTQYTST

SEQ ID NO: 40459 - protein, 35 aa, Artificial Sequence
  Description of Artificial Sequence: Synthetic polypeptide
DENEIAQTNPVATEQYGVVSVTGGPVEDEKGDNDI

SEQ ID NO: 40460 - protein, 33 aa, Artificial Sequence
  Description of Artificial Sequence: Synthetic polypeptide
QENEIVATNPVATECYGVVCSTELEMGEGEEDD

SEQ ID NO: 40461 - protein, 37 aa, Artificial Sequence
  Description of Artificial Sequence: Synthetic polypeptide
DEEEIRCTNPDATEQYGNVCSVTLENGVIIQKGEELA

SEQ ID NO: 40462 - protein, 33 aa, Artificial Sequence
  Description of Artificial Sequence: Synthetic polypeptide
QEEEIRATNPVASEQWGVVGTTCDLQESDPMDN

SEQ ID NO: 40463 - protein, 28 aa, Artificial Sequence
  Description of Artificial Sequence: Synthetic peptide
DEDEINTTNPIDTRPLGGTRDNVQYSTT

SEQ ID NO: 40464 - protein, 28 aa, Artificial Sequence
  Description of Artificial Sequence: Synthetic peptide
SEEEGAITNNVATKVLGGTRDNTQYLNT

SEQ ID NO: 40465 - protein, 28 aa, Artificial Sequence
  Description of Artificial Sequence: Synthetic peptide
DEDEIRITRGTALDQYIHVSNREQSSTT

SEQ ID NO: 40466 - protein, 36 aa, Artificial Sequence
  Description of Artificial Sequence: Synthetic polypeptide
DENEIAQTNPVATEQYGVVSATTDGQVELVNGENDD

SEQ ID NO: 40467 - protein, 28 aa, Artificial Sequence
  Description of Artificial Sequence: Synthetic peptide
DEDEIATTNNIITRPLGGTRDNLQYSAT

SEQ ID NO: 40468 - protein, 28 aa, Artificial Sequence
  Description of Artificial Sequence: Synthetic peptide
GEEEVNAVNGISTKIYGELANNLQNGNQ

SEQ ID NO: 40469 - protein, 28 aa, Artificial Sequence
  Description of Artificial Sequence: Synthetic peptide
DEEKIITTNGIIDDVFGSRMTELLGANN

SEQ ID NO: 40470 - protein, 33 aa, Artificial Sequence
  Description of Artificial Sequence: Synthetic polypeptide
SEVEIAATNPTATELFGGVSTGNPQLREGDTTN

SEQ ID NO: 40471 - protein, 28 aa, Artificial Sequence
  Description of Artificial Sequence: Synthetic peptide
DWQNINFTLPVATDQVLSPSDPIGGGNG

SEQ ID NO: 40472 - protein, 32 aa, Artificial Sequence
  Description of Artificial Sequence: Synthetic polypeptide
DETEIRTTNPIATECWGATANAEDLQEPKGPI

SEQ ID NO: 40473 - protein, 28 aa, Artificial Sequence
  Description of Artificial Sequence: Synthetic peptide
DADHILTTNIITTAQYGRVAEEFQRQTT

SEQ ID NO: 40474 - protein, 35 aa, Artificial Sequence
  Description of Artificial Sequence: Synthetic polypeptide
DEEEIRTTNPVATEQYGDVSCECCPVCCHAEVEDL

SEQ ID NO: 40475 - protein, 28 aa, Artificial Sequence
  Description of Artificial Sequence: Synthetic peptide
DERETNGTNSIATTRYSTVTTNTQKQST

SEQ ID NO: 40476 - protein, 28 aa, Artificial Sequence
  Description of Artificial Sequence: Synthetic peptide
DEEQIRAENWIATRSYNGTIDNLDSKNN

SEQ ID NO: 40477 - protein, 36 aa, Artificial Sequence
  Description of Artificial Sequence: Synthetic polypeptide
DENEIAQTNPVATEQYGVVSATTDGQVELDNGENDD

SEQ ID NO: 40478 - protein, 34 aa, Artificial Sequence
  Description of Artificial Sequence: Synthetic polypeptide
DEQEIAATNPFATEQYGQVSIELNPPDMSKGNPS

SEQ ID NO: 40479 - protein, 36 aa, Artificial Sequence
  Description of Artificial Sequence: Synthetic polypeptide
DEEEIRCTNPVATECYGFVSSTTPAGPNMRNGMDPV

SEQ ID NO: 40480 - protein, 28 aa, Artificial Sequence
  Description of Artificial Sequence: Synthetic peptide
NEEEIITTNPIDTLRWGTTHTNVPGSTT

SEQ ID NO: 40481 - protein, 28 aa, Artificial Sequence
  Description of Artificial Sequence: Synthetic peptide
SEGEIAATNPISTENFGEVSVDWIQGPQ

SEQ ID NO: 40482 - protein, 28 aa, Artificial Sequence
  Description of Artificial Sequence: Synthetic peptide
DEEQGNQHNILNTEGYGKVSDNSKSAGN

SEQ ID NO: 40483 - protein, 37 aa, Artificial Sequence
  Description of Artificial Sequence: Synthetic polypeptide
DEEEIRTTNPVATEQYGSVVVFCEMDPDCCADGDNDC

SEQ ID NO: 40484 - protein, 28 aa, Artificial Sequence
  Description of Artificial Sequence: Synthetic peptide
DEEEGATTNNVAIEVLGGTRDQALYRAT

SEQ ID NO: 40485 - protein, 33 aa, Artificial Sequence
  Description of Artificial Sequence: Synthetic polypeptide
QEHEIATTNPCATEIYGWVSTENDEDFKGDDEP

SEQ ID NO: 40486 - protein, 28 aa, Artificial Sequence
  Description of Artificial Sequence: Synthetic peptide
DEQEIATVNNQETREYGAVSDQEQNACT

SEQ ID NO: 40487 - protein, 28 aa, Artificial Sequence
  Description of Artificial Sequence: Synthetic peptide
DEDNISTTNNYDIQAKGLVTTNLINKNL

SEQ ID NO: 40488 - protein, 28 aa, Artificial Sequence
  Description of Artificial Sequence: Synthetic peptide
DDEDIRTQNTVAWKEYDVVETHNQTSQN

SEQ ID NO: 40489 - protein, 31 aa, Artificial Sequence
  Description of Artificial Sequence: Synthetic polypeptide
AEEEIATTNPVATEGYGEAPAEVCQHAEPEK

SEQ ID NO: 40490 - protein, 28 aa, Artificial Sequence
  Description of Artificial Sequence: Synthetic peptide
DEEEIRIGNIYAREEYGLTADQLLYQAT

SEQ ID NO: 40491 - protein, 33 aa, Artificial Sequence
  Description of Artificial Sequence: Synthetic polypeptide
DEEEISTVNPCATEPYGDVSCSMEICYVDGENV

SEQ ID NO: 40492 - protein, 28 aa, Artificial Sequence
  Description of Artificial Sequence: Synthetic peptide
DEEEIATGNAIAWRVYGRTANNTQSTAT

SEQ ID NO: 40493 - protein, 35 aa, Artificial Sequence
  Description of Artificial Sequence: Synthetic polypeptide
DEEEIAATNPFATEQYGQVCDIELNPQDSKGTNPS

SEQ ID NO: 40494 - protein, 32 aa, Artificial Sequence
  Description of Artificial Sequence: Synthetic polypeptide
GDEEIACTNPVATEGYGEVAEDPLDESEGTDR

SEQ ID NO: 40495 - protein, 37 aa, Artificial Sequence
  Description of Artificial Sequence: Synthetic polypeptide
CEEEIRTTNPVATEQYGSVSSLTMEGIVETSEGETLQ

SEQ ID NO: 40496 - protein, 33 aa, Artificial Sequence
  Description of Artificial Sequence: Synthetic polypeptide
SEVEICTTNPTATEQFGEVISEANPQELGVDTH

SEQ ID NO: 40497 - protein, 29 aa, Artificial Sequence
  Description of Artificial Sequence: Synthetic peptide
DEAEIAQTNPVSTEMWGVTCCTIQSHGDY

SEQ ID NO: 40498 - protein, 37 aa, Artificial Sequence
  Description of Artificial Sequence: Synthetic polypeptide
DEEEIRTTNPVATEQYWSVEEDTPPPLVDIDDGDEPP

SEQ ID NO: 40499 - protein, 35 aa, Artificial Sequence
  Description of Artificial Sequence: Synthetic polypeptide
SENEIRCTNPVATEQFGEVISTMNDPQMIEGIDTA

SEQ ID NO: 40500 - protein, 28 aa, Artificial Sequence
  Description of Artificial Sequence: Synthetic peptide
DEDENRTTNNYGTEIYTGTVDNMLNTAT

SEQ ID NO: 40501 - protein, 28 aa, Artificial Sequence
  Description of Artificial Sequence: Synthetic peptide
DGEETKFNRGGANEQYLITSTNVQNGGT

SEQ ID NO: 40502 - protein, 34 aa, Artificial Sequence
  Description of Artificial Sequence: Synthetic polypeptide
DEVEIATTNPTATEQYGEVSEMLEPCCQSEDDTF

SEQ ID NO: 40503 - protein, 28 aa, Artificial Sequence
  Description of Artificial Sequence: Synthetic peptide
DNEHIATTNPIEFEIYGWVEMPAHPYNA

SEQ ID NO: 40504 - protein, 33 aa, Artificial Sequence
  Description of Artificial Sequence: Synthetic polypeptide
QEHEICTTNPCATECYGVVSDTDLEETNGDEDM

SEQ ID NO: 40505 - protein, 28 aa, Artificial Sequence
  Description of Artificial Sequence: Synthetic peptide
DIENISSSNIVDGKQIGSTASNLQNTNT

SEQ ID NO: 40506 - protein, 28 aa, Artificial Sequence
  Description of Artificial Sequence: Synthetic peptide
DIDEIKTTNGVQDEQVQTLRYNLLGNAN

SEQ ID NO: 40507 - protein, 36 aa, Artificial Sequence
  Description of Artificial Sequence: Synthetic polypeptide
DENEIAQTNPVATEQYGSVSVTPGGPVEDEKGDNDI

SEQ ID NO: 40508 - protein, 28 aa, Artificial Sequence
  Description of Artificial Sequence: Synthetic peptide
DESMIRANNIVDTQQYNIVSDNQTNWSS

SEQ ID NO: 40509 - protein, 28 aa, Artificial Sequence
  Description of Artificial Sequence: Synthetic peptide
NEGEWATANIVATIMYGGVRDGMLQSNT

SEQ ID NO: 40510 - protein, 32 aa, Artificial Sequence
  Description of Artificial Sequence: Synthetic polypeptide
QEAEIASTNPCATECYGVVSEMALQETGEDDP

SEQ ID NO: 40511 - protein, 32 aa, Artificial Sequence
  Description of Artificial Sequence: Synthetic polypeptide
AEDEVKTTNPVATEPYGQCSADLLQNIAGPQY

SEQ ID NO: 40512 - protein, 28 aa, Artificial Sequence
  Description of Artificial Sequence: Synthetic peptide
DEQEITTGNIVDTDRAGYVNDNEQQASS

SEQ ID NO: 40513 - protein, 28 aa, Artificial Sequence
  Description of Artificial Sequence: Synthetic peptide
DEQGIKTTNGVGWKQYGGTADNEQAATT

SEQ ID NO: 40514 - protein, 28 aa, Artificial Sequence
  Description of Artificial Sequence: Synthetic peptide
EISEWRNTNDVATEIGGLTDTGLTNGGI

SEQ ID NO: 40515 - protein, 28 aa, Artificial Sequence
  Description of Artificial Sequence: Synthetic peptide
DEEETNTTNPIDLLNIGTVSDPVGGKNT

SEQ ID NO: 40516 - protein, 33 aa, Artificial Sequence
  Description of Artificial Sequence: Synthetic polypeptide
SEVEIAATNPTATEQFGGVSEGNPQLQEGDTTN

SEQ ID NO: 40517 - protein, 28 aa, Artificial Sequence
  Description of Artificial Sequence: Synthetic peptide
DERHTRITEIMGTEQYGSTHNGLGNANT

SEQ ID NO: 40518 - protein, 28 aa, Artificial Sequence
  Description of Artificial Sequence: Synthetic peptide
DEEETAITNIVGWEVQTGVRTNNTHRAV

SEQ ID NO: 40519 - protein, 28 aa, Artificial Sequence
  Description of Artificial Sequence: Synthetic peptide
SEDEIHTTNIVAYEQYQKTADNALWNDQ

SEQ ID NO: 40520 - protein, 36 aa, Artificial Sequence
  Description of Artificial Sequence: Synthetic polypeptide
DEVEIGTTNPVATEAYGNVPSLTNNGVDLDDGVEEW

SEQ ID NO: 40521 - protein, 34 aa, Artificial Sequence
  Description of Artificial Sequence: Synthetic polypeptide
DESEIQCTNPVATECWGGVSCINEPQDHEGENTG

SEQ ID NO: 40522 - protein, 34 aa, Artificial Sequence
  Description of Artificial Sequence: Synthetic polypeptide
QENEIVATNPVATECYGVVCSATELEMGEGEEDD

SEQ ID NO: 40523 - protein, 28 aa, Artificial Sequence
  Description of Artificial Sequence: Synthetic peptide
DEEEIISVNWNDTVVEGNVSAQSGSNAT

SEQ ID NO: 40524 - protein, 28 aa, Artificial Sequence
  Description of Artificial Sequence: Synthetic peptide
DTEEGANVNAVGTKQFGTTATSLRSTNS

SEQ ID NO: 40525 - protein, 28 aa, Artificial Sequence
  Description of Artificial Sequence: Synthetic peptide
DEDETKTINIVGAKTYGRHASNLQNSTT

SEQ ID NO: 40526 - protein, 36 aa, Artificial Sequence
  Description of Artificial Sequence: Synthetic polypeptide
SEEEIRPTNPCATEQYGSVCATTQGGLVLCEAGDLD

SEQ ID NO: 40527 - protein, 28 aa, Artificial Sequence
  Description of Artificial Sequence: Synthetic peptide
DDQEVASVNGVSTKNYGTTATTLERANT

SEQ ID NO: 40528 - protein, 37 aa, Artificial Sequence
  Description of Artificial Sequence: Synthetic polypeptide
YEEEIRTTNPVATEQYGSYVIDATEPPPDAINDTHDG

SEQ ID NO: 40529 - protein, 28 aa, Artificial Sequence
  Description of Artificial Sequence: Synthetic peptide
NEEETPTTNPIDTLHWGTTHTNVPGSGT

SEQ ID NO: 40530 - protein, 28 aa, Artificial Sequence
  Description of Artificial Sequence: Synthetic peptide
DEEEGNTTNNIDTRVLGGTRDNVQNSGT

SEQ ID NO: 40531 - protein, 36 aa, Artificial Sequence
  Description of Artificial Sequence: Synthetic polypeptide
DENEIAQTNPVATEQYGVVSATTDGQVELVNGEEDD

SEQ ID NO: 40532 - protein, 36 aa, Artificial Sequence
  Description of Artificial Sequence: Synthetic polypeptide
AENEIAQTNPVATEQYGSVSATTGGQVELDNGEEDD

SEQ ID NO: 40533 - protein, 28 aa, Artificial Sequence
  Description of Artificial Sequence: Synthetic peptide
NDNEIRTVNIVDTDRIGTTANVLQNTNI

SEQ ID NO: 40534 - protein, 28 aa, Artificial Sequence
  Description of Artificial Sequence: Synthetic peptide
DEEGVATTNIEAIEEIGKTRTREQWTTN

SEQ ID NO: 40535 - protein, 34 aa, Artificial Sequence
  Description of Artificial Sequence: Synthetic polypeptide
DEFEICTTNPVATEHFGDVSEADGWQLHKGAPDI

SEQ ID NO: 40536 - protein, 28 aa, Artificial Sequence
  Description of Artificial Sequence: Synthetic peptide
DEEEVSFTNRVIEGIGDMTSDNIGNKNL

SEQ ID NO: 40537 - protein, 28 aa, Artificial Sequence
  Description of Artificial Sequence: Synthetic peptide
DINEIKTRNIQELENYLTVSDNNYQSNG

SEQ ID NO: 40538 - protein, 35 aa, Artificial Sequence
  Description of Artificial Sequence: Synthetic polypeptide
AEQEIVTTNPDATEQYGEVSITGAPGTESINGVNQ

SEQ ID NO: 40539 - protein, 28 aa, Artificial Sequence
  Description of Artificial Sequence: Synthetic peptide
DGTEINESAIVATDQLGGTSDYIQGANT

SEQ ID NO: 40540 - protein, 33 aa, Artificial Sequence
  Description of Artificial Sequence: Synthetic polypeptide
DEEEISSVNPCATEPYGDVACSMEICYVDGENV

SEQ ID NO: 40541 - protein, 28 aa, Artificial Sequence
  Description of Artificial Sequence: Synthetic peptide
SEEETQITNDIATEMVNTGHSNVQDGRS

SEQ ID NO: 40542 - protein, 28 aa, Artificial Sequence
  Description of Artificial Sequence: Synthetic peptide
DEQENRTVVWITTDQLTGTSDNNLSAGR

SEQ ID NO: 40543 - protein, 28 aa, Artificial Sequence
  Description of Artificial Sequence: Synthetic peptide
DEDEIITTVGTATSTLTTIVTQLTNRNQ

SEQ ID NO: 40544 - protein, 32 aa, Artificial Sequence
  Description of Artificial Sequence: Synthetic polypeptide
AEEEIATTNPVATEGYGEAPAEVCQSHAEPEK

SEQ ID NO: 40545 - protein, 28 aa, Artificial Sequence
  Description of Artificial Sequence: Synthetic peptide
DGIEDVRLNGSDTSQYLLVSTNTQSATN

SEQ ID NO: 40546 - protein, 28 aa, Artificial Sequence
  Description of Artificial Sequence: Synthetic peptide
DEEEITGDNGVAWKDRGKVVDNAYHLVT

SEQ ID NO: 40547 - protein, 38 aa, Artificial Sequence
  Description of Artificial Sequence: Synthetic polypeptide
DEEEIRTTNPVATEQYGSVVVFCEMDPDVCCADGDNDC

SEQ ID NO: 40548 - protein, 28 aa, Artificial Sequence
  Description of Artificial Sequence: Synthetic peptide
DEQGVRTVSGVISENLGTVATNAQYQVT

SEQ ID NO: 40549 - protein, 34 aa, Artificial Sequence
  Description of Artificial Sequence: Synthetic polypeptide
DESEIQCTNPVATECWGGVSCINEPQDHEEENTG

SEQ ID NO: 40550 - protein, 28 aa, Artificial Sequence
  Description of Artificial Sequence: Synthetic peptide
DEQETISVNIIDREIYGELDNQLQGGGR

SEQ ID NO: 40551 - protein, 28 aa, Artificial Sequence
  Description of Artificial Sequence: Synthetic peptide
DWENINTNNPVTNDQVLLVSDPIGGKNG

SEQ ID NO: 40552 - protein, 28 aa, Artificial Sequence
  Description of Artificial Sequence: Synthetic peptide
NEEEVITTNPIDTLRWGTTHTNVPGSGT

SEQ ID NO: 40553 - protein, 28 aa, Artificial Sequence
  Description of Artificial Sequence: Synthetic peptide
SEDEIKISNIVGTGQTGKVVDQVYNGNT

SEQ ID NO: 40554 - protein, 33 aa, Artificial Sequence
  Description of Artificial Sequence: Synthetic polypeptide
QEAEIASTNPCATECYGVVSEMALQETNGEDDP

SEQ ID NO: 40555 - protein, 28 aa, Artificial Sequence
  Description of Artificial Sequence: Synthetic peptide
DEQEIATTNIVGHKVSGDTVDNELNANT

SEQ ID NO: 40556 - protein, 36 aa, Artificial Sequence
  Description of Artificial Sequence: Synthetic polypeptide
SEEEIAATNPTATEQFGSVISEMNGEPQDQEGDNTF

SEQ ID NO: 40557 - protein, 28 aa, Artificial Sequence
  Description of Artificial Sequence: Synthetic peptide
DEEGIATLNLVDTNELSLISDSIQQGKA

SEQ ID NO: 40558 - protein, 28 aa, Artificial Sequence
  Description of Artificial Sequence: Synthetic peptide
NEQETSTNNIVIMEREENVWDSLQRSNN

SEQ ID NO: 40559 - protein, 28 aa, Artificial Sequence
  Description of Artificial Sequence: Synthetic peptide
NEEEVPTTNPIDTLHWGTTHTNVPGSGT

SEQ ID NO: 40560 - protein, 36 aa, Artificial Sequence
  Description of Artificial Sequence: Synthetic polypeptide
MEVEIGTTNPVATEAYGNVPSLTNPGVDLDDGVEEW

SEQ ID NO: 40561 - protein, 28 aa, Artificial Sequence
  Description of Artificial Sequence: Synthetic peptide
QEGELATTNGIAHRIYGGVVNQLQSQTT

SEQ ID NO: 40562 - protein, 36 aa, Artificial Sequence
  Description of Artificial Sequence: Synthetic polypeptide
MEVEIGTTNPVATEAYGNVPSLTNNGVDLDDGVEEW

SEQ ID NO: 40563 - protein, 32 aa, Artificial Sequence
  Description of Artificial Sequence: Synthetic polypeptide
DETEIRTTNPIATECWGATANAEDWQEPKGPI

SEQ ID NO: 40564 - protein, 28 aa, Artificial Sequence
  Description of Artificial Sequence: Synthetic peptide
DEGEVATTNMVSIETYGGTADQELCRTT

SEQ ID NO: 40565 - protein, 36 aa, Artificial Sequence
  Description of Artificial Sequence: Synthetic polypeptide
DEEEIAQTNPVATEQYGDAPTENCNPVQEHAGVEDL

SEQ ID NO: 40566 - protein, 28 aa, Artificial Sequence
  Description of Artificial Sequence: Synthetic peptide
DESSTRTQNIVATAHLGSTLVGSQGAAS

SEQ ID NO: 40567 - protein, 36 aa, Artificial Sequence
  Description of Artificial Sequence: Synthetic polypeptide
DENEIAQTNPVATEQYGVVSVTPGGPVEDEKGDNDI

SEQ ID NO: 40568 - protein, 38 aa, Artificial Sequence
  Description of Artificial Sequence: Synthetic polypeptide
DEEEIRTTNPDATEQYGDSVVEGDTCDNQDMCNEFEPF

SEQ ID NO: 40569 - protein, 28 aa, Artificial Sequence
  Description of Artificial Sequence: Synthetic peptide
DEEETNTTNPIDLLRWGTVHDNVPGSGT

SEQ ID NO: 40570 - protein, 28 aa, Artificial Sequence
  Description of Artificial Sequence: Synthetic peptide
DEQEGAITNIYATKIYGASRDNMEAHTR

SEQ ID NO: 40571 - protein, 37 aa, Artificial Sequence
  Description of Artificial Sequence: Synthetic polypeptide
DEEEIRTTNPDATEQYGSVFFCEPPPPTDCNEGIEDN

SEQ ID NO: 40572 - protein, 33 aa, Artificial Sequence
  Description of Artificial Sequence: Synthetic polypeptide
QEHEIATTNPCATEIYGWVGTENDEDFKGDDEP

SEQ ID NO: 40573 - protein, 28 aa, Artificial Sequence
  Description of Artificial Sequence: Synthetic peptide
DEGETNTSNDVTNEVVGGTRTNELGGAN

SEQ ID NO: 40574 - protein, 28 aa, Artificial Sequence
  Description of Artificial Sequence: Synthetic peptide
DEEETNTTNNIDTRVLGGTRDNVQNSGT

SEQ ID NO: 40575 - protein, 32 aa, Artificial Sequence
  Description of Artificial Sequence: Synthetic polypeptide
GDEEIACTNPVATEGYGEVAEDPLDESEDTDR

SEQ ID NO: 40576 - protein, 28 aa, Artificial Sequence
  Description of Artificial Sequence: Synthetic peptide
DEAEGAAGNGISTEIWSGLRTNLEVANR

SEQ ID NO: 40577 - protein, 28 aa, Artificial Sequence
  Description of Artificial Sequence: Synthetic peptide
DESKIETTNISALVMYGETRNDNQNAGN

SEQ ID NO: 40578 - protein, 28 aa, Artificial Sequence
  Description of Artificial Sequence: Synthetic peptide
DEEETNTTNPIDTLRLGTTHDNVPGSGT

SEQ ID NO: 40579 - protein, 34 aa, Artificial Sequence
  Description of Artificial Sequence: Synthetic polypeptide
DETEIRTTNPIATEQYGATTWSNAEDWAEPGPYI

SEQ ID NO: 40580 - protein, 37 aa, Artificial Sequence
  Description of Artificial Sequence: Synthetic polypeptide
CEEEIRTTNPVATEVYGSVSSLTMEGIVETSEGETLQ

SEQ ID NO: 40581 - protein, 28 aa, Artificial Sequence
  Description of Artificial Sequence: Synthetic peptide
RENAISATNDVATDQYSVIRNGIINADN

SEQ ID NO: 40582 - protein, 28 aa, Artificial Sequence
  Description of Artificial Sequence: Synthetic peptide
SEDEITTTNGMRIRVYGQTATNNQNQTT

SEQ ID NO: 40583 - protein, 28 aa, Artificial Sequence
  Description of Artificial Sequence: Synthetic peptide
NEEEVPTTNPIDTDRWGTTHTNVPGSGT

SEQ ID NO: 40584 - protein, 28 aa, Artificial Sequence
  Description of Artificial Sequence: Synthetic peptide
DDQEINIGNIVDTRQLDSANAKVQRAGN

SEQ ID NO: 40585 - protein, 28 aa, Artificial Sequence
  Description of Artificial Sequence: Synthetic peptide
DEAEGQDTNQFAWEILGQVSDNALNQAT

SEQ ID NO: 40586 - protein, 30 aa, Artificial Sequence
  Description of Artificial Sequence: Synthetic polypeptide
DEAEIAQTNPVSTEMWGVTCACTIQSHGDY

SEQ ID NO: 40587 - protein, 28 aa, Artificial Sequence
  Description of Artificial Sequence: Synthetic peptide
SEETILTTNGVDWSVYGTTADNEQNTTT

SEQ ID NO: 40588 - protein, 28 aa, Artificial Sequence
  Description of Artificial Sequence: Synthetic peptide
REENINTNLNVDTDNKGQITQNLQGQNS

SEQ ID NO: 40589 - protein, 36 aa, Artificial Sequence
  Description of Artificial Sequence: Synthetic polypeptide
DEEEIAATNPFATEQYGQVCDIELNPPQDSKGTNPS

SEQ ID NO: 40590 - protein, 38 aa, Artificial Sequence
  Description of Artificial Sequence: Synthetic polypeptide
DEEEIRTTNPEACEQYGNYVSSITQGPVNQVYDGDNPN

SEQ ID NO: 40591 - protein, 28 aa, Artificial Sequence
  Description of Artificial Sequence: Synthetic peptide
REEEIIASSIVATDRVDTVSTYLGQAAT

SEQ ID NO: 40592 - protein, 28 aa, Artificial Sequence
  Description of Artificial Sequence: Synthetic peptide
SEEEVATTNIRGFQTYGVVADQLQYAAT

SEQ ID NO: 40593 - protein, 28 aa, Artificial Sequence
  Description of Artificial Sequence: Synthetic peptide
DEEEVNATNIVSTKMYGGTGNQWERTST

SEQ ID NO: 40594 - protein, 28 aa, Artificial Sequence
  Description of Artificial Sequence: Synthetic peptide
DSRNIGTTQDIANAIYQGVSDDIQSGNT

SEQ ID NO: 40595 - protein, 28 aa, Artificial Sequence
  Description of Artificial Sequence: Synthetic peptide
DWQNINFTNPVTNDNYLLPSDPLGGGNG

SEQ ID NO: 40596 - protein, 28 aa, Artificial Sequence
  Description of Artificial Sequence: Synthetic peptide
DTSEIRINNIVDNNRWGVVWTGEQDTNT

SEQ ID NO: 40597 - protein, 33 aa, Artificial Sequence
  Description of Artificial Sequence: Synthetic polypeptide
QEHEICTTNPCATECYGVVADTDLEETNGDEDM

SEQ ID NO: 40598 - protein, 28 aa, Artificial Sequence
  Description of Artificial Sequence: Synthetic peptide
DEEMVKTTNIGTDLSELTNSDVLQGKNT

SEQ ID NO: 40599 - protein, 28 aa, Artificial Sequence
  Description of Artificial Sequence: Synthetic peptide
GEKGIDTALNVGTNNYGGLHQNIGGGNS

SEQ ID NO: 40600 - protein, 37 aa, Artificial Sequence
  Description of Artificial Sequence: Synthetic polypeptide
CEEEIRTTNPVATEVYGAVSGLTMEGIVETSEGETLQ

SEQ ID NO: 40601 - protein, 28 aa, Artificial Sequence
  Description of Artificial Sequence: Synthetic peptide
DAEGINQTNDGTTEILLSLDDNLSGAAT

SEQ ID NO: 40602 - protein, 34 aa, Artificial Sequence
  Description of Artificial Sequence: Synthetic polypeptide
DESEIQCTNPTATECWGGVSCINEPQDHEEENTG

SEQ ID NO: 40603 - protein, 36 aa, Artificial Sequence
  Description of Artificial Sequence: Synthetic polypeptide
AENEIAQTNPVATEQYGVVSATTDGQVELVNGEEDD

SEQ ID NO: 40604 - protein, 28 aa, Artificial Sequence
  Description of Artificial Sequence: Synthetic peptide
DEQELRCTNIVGSKVYGTIADQLESATT

SEQ ID NO: 40605 - protein, 28 aa, Artificial Sequence
  Description of Artificial Sequence: Synthetic peptide
DEECLDNNNIVGIDELGQVWDNNQNKNN

SEQ ID NO: 40606 - protein, 28 aa, Artificial Sequence
  Description of Artificial Sequence: Synthetic peptide
DWQNINFTNPVTNDNVLLPSDPLGGGNG

SEQ ID NO: 40607 - protein, 28 aa, Artificial Sequence
  Description of Artificial Sequence: Synthetic peptide
GLEEIIDINQQDDDRYGELNTNLQNSTG

SEQ ID NO: 40608 - protein, 36 aa, Artificial Sequence
  Description of Artificial Sequence: Synthetic polypeptide
SEVEIAATNPTATEQFGSVISEMNGEPQDQEGDNTF

SEQ ID NO: 40609 - protein, 28 aa, Artificial Sequence
  Description of Artificial Sequence: Synthetic peptide
EEDETNTTNITITREQTMLRTNELNQGT

SEQ ID NO: 40610 - protein, 28 aa, Artificial Sequence
  Description of Artificial Sequence: Synthetic peptide
DEEETNTTNNIDTRRLGGTHDNVPGSGT

SEQ ID NO: 40611 - protein, 28 aa, Artificial Sequence
  Description of Artificial Sequence: Synthetic peptide
DEQEGITGSGIALNQYGLTTEYQFTRGT

SEQ ID NO: 40612 - protein, 28 aa, Artificial Sequence
  Description of Artificial Sequence: Synthetic peptide
DEEDVKITNISDCDVYGTVVTYVQSSGT

SEQ ID NO: 40613 - protein, 28 aa, Artificial Sequence
  Description of Artificial Sequence: Synthetic peptide
DWYNINFTNDVTLDNILSISDNIGRGTG

SEQ ID NO: 40614 - protein, 28 aa, Artificial Sequence
  Description of Artificial Sequence: Synthetic peptide
DEEETNTTNPIDLLRLGTTHDNVPGSGT

SEQ ID NO: 40615 - protein, 37 aa, Artificial Sequence
  Description of Artificial Sequence: Synthetic polypeptide
DETEITTTNPVATEQYGVVSSLELDGPVEPLNGIDLS

SEQ ID NO: 40616 - protein, 34 aa, Artificial Sequence
  Description of Artificial Sequence: Synthetic polypeptide
DETEIRTTNPIATECWGATTANAEDWQEPKGPYI

SEQ ID NO: 40617 - protein, 28 aa, Artificial Sequence
  Description of Artificial Sequence: Synthetic peptide
EEQEIINTRGIATLNGSETTQQLQSKTT

SEQ ID NO: 40618 - protein, 28 aa, Artificial Sequence
  Description of Artificial Sequence: Synthetic peptide
DENSISTQNNVITLNWGGVERNVGNKAD

SEQ ID NO: 40619 - protein, 28 aa, Artificial Sequence
  Description of Artificial Sequence: Synthetic peptide
NEEEVPTTNPIDLDHWGTTHTNVPGKGT

SEQ ID NO: 40620 - protein, 37 aa, Artificial Sequence
  Description of Artificial Sequence: Synthetic polypeptide
DEEEIAATNPFATEQYGQVCDIELNPPQDMSKGTNPS

SEQ ID NO: 40621 - protein, 28 aa, Artificial Sequence
  Description of Artificial Sequence: Synthetic peptide
DEGEINNTNGFAREVFTKTADNKQSSAT

SEQ ID NO: 40622 - protein, 28 aa, Artificial Sequence
  Description of Artificial Sequence: Synthetic peptide
EEQEGACVNGVASENYGVTRNNAERTGT

SEQ ID NO: 40623 - protein, 34 aa, Artificial Sequence
  Description of Artificial Sequence: Synthetic polypeptide
DEHEIATTNPVATEQYGDAFCEMDEQCCHAEDDQ

SEQ ID NO: 40624 - protein, 28 aa, Artificial Sequence
  Description of Artificial Sequence: Synthetic peptide
DESEVATHNIVGWSTYGGTVDNTQNQTT

SEQ ID NO: 40625 - protein, 28 aa, Artificial Sequence
  Description of Artificial Sequence: Synthetic peptide
DEQDINGNNIIATSHETLLRNNNEGGNR

SEQ ID NO: 40626 - protein, 28 aa, Artificial Sequence
  Description of Artificial Sequence: Synthetic peptide
EQQEITFINNIATVQEGHVNDSLEQKNG

SEQ ID NO: 40627 - protein, 28 aa, Artificial Sequence
  Description of Artificial Sequence: Synthetic peptide
DEGEEQTTNNFGQKIYGQTVDNNLYTAS

SEQ ID NO: 40628 - protein, 28 aa, Artificial Sequence
  Description of Artificial Sequence: Synthetic peptide
EEENGRTTNNLFADQVYEVSDNIAGKGG

SEQ ID NO: 40629 - protein, 35 aa, Artificial Sequence
  Description of Artificial Sequence: Synthetic polypeptide
SEVEIATTNPTATEQYGEVISEMLEPCCQHEDDTF

SEQ ID NO: 40630 - protein, 28 aa, Artificial Sequence
  Description of Artificial Sequence: Synthetic peptide
NEEETPTTNPIDLLHWGTTHTNVPGSGT

SEQ ID NO: 40631 - protein, 28 aa, Artificial Sequence
  Description of Artificial Sequence: Synthetic peptide
GDSEIHMCNVCATWFYGVVASNFENLLR

SEQ ID NO: 40632 - protein, 28 aa, Artificial Sequence
  Description of Artificial Sequence: Synthetic peptide
SEGEGATTNIVFTECLTGVADQQQYLTD

SEQ ID NO: 40633 - protein, 28 aa, Artificial Sequence
  Description of Artificial Sequence: Synthetic peptide
DGQEIAATNITANRIYGVTVDNAQYSAT

SEQ ID NO: 40634 - protein, 33 aa, Artificial Sequence
  Description of Artificial Sequence: Synthetic polypeptide
DETEIRTTNPIATECWGATANAEDWQEPKGPYI

SEQ ID NO: 40635 - protein, 36 aa, Artificial Sequence
  Description of Artificial Sequence: Synthetic polypeptide
MEVEIGTTNPCATEAYGNVPSLTNPGVDLDDGVEEW

SEQ ID NO: 40636 - protein, 28 aa, Artificial Sequence
  Description of Artificial Sequence: Synthetic peptide
SEDETQTTNNIIERRWGSVANNLLSSTL

SEQ ID NO: 40637 - protein, 28 aa, Artificial Sequence
  Description of Artificial Sequence: Synthetic peptide
DEQEIKTAINVDYRQYGLVDDSAGYSSN

SEQ ID NO: 40638 - protein, 28 aa, Artificial Sequence
  Description of Artificial Sequence: Synthetic peptide
DESNVNTTNNFDLDQYGLHSDTKGYRAG

SEQ ID NO: 40639 - protein, 28 aa, Artificial Sequence
  Description of Artificial Sequence: Synthetic peptide
DEDGGSTINRVGNQVYGTTETNLLGLTG

SEQ ID NO: 40640 - protein, 28 aa, Artificial Sequence
  Description of Artificial Sequence: Synthetic peptide
SEDIINNTNRIGQEGYGTSADTLYGGTG

SEQ ID NO: 40641 - protein, 28 aa, Artificial Sequence
  Description of Artificial Sequence: Synthetic peptide
DENNISATNRTDQEGLGEATDDLQAGTG

SEQ ID NO: 40642 - protein, 28 aa, Artificial Sequence
  Description of Artificial Sequence: Synthetic peptide
DEEETNTTNPIDLLRWGTVHDPVPGSGT

SEQ ID NO: 40643 - protein, 28 aa, Artificial Sequence
  Description of Artificial Sequence: Synthetic peptide
DEEGIDNALIVQLNREGNTETNILNRGI

SEQ ID NO: 40644 - protein, 28 aa, Artificial Sequence
  Description of Artificial Sequence: Synthetic peptide
DEGEVNNGNNVIWENLGSTRTNELNQST

SEQ ID NO: 40645 - protein, 28 aa, Artificial Sequence
  Description of Artificial Sequence: Synthetic peptide
GERAITGENIVINENYGLVAGQLGNSNT

SEQ ID NO: 40646 - protein, 28 aa, Artificial Sequence
  Description of Artificial Sequence: Synthetic peptide
NEEEVPTTNPIDLLHWGTTHTNVPGSGT

SEQ ID NO: 40647 - protein, 34 aa, Artificial Sequence
  Description of Artificial Sequence: Synthetic polypeptide
QENEIVATNPVATECYGVVCGATELEMGEGEEDD

SEQ ID NO: 40648 - protein, 34 aa, Artificial Sequence
  Description of Artificial Sequence: Synthetic polypeptide
DESEISACNPCSTEHYGEVSTAIDENQLQGADDF

SEQ ID NO: 40649 - protein, 28 aa, Artificial Sequence
  Description of Artificial Sequence: Synthetic peptide
DEEETNTTNNIDTLRLGTTHDNVPGSGT

SEQ ID NO: 40650 - protein, 35 aa, Artificial Sequence
  Description of Artificial Sequence: Synthetic polypeptide
SEVEIATTNPTATEQYGEVISEMLEPCCQSEDDTF

SEQ ID NO: 40651 - protein, 34 aa, Artificial Sequence
  Description of Artificial Sequence: Synthetic polypeptide
DETEIRTTNPIATEQWGATTWSNAEDWAEPGPYI

SEQ ID NO: 40652 - protein, 34 aa, Artificial Sequence
  Description of Artificial Sequence: Synthetic polypeptide
DEHEIATTNPVATEQYGDAFCEMDEQCCHAEDDA

SEQ ID NO: 40653 - protein, 35 aa, Artificial Sequence
  Description of Artificial Sequence: Synthetic polypeptide
SEEEIRTTNPVATEVSFGLVDANINGANSNEDNSM

SEQ ID NO: 40654 - protein, 28 aa, Artificial Sequence
  Description of Artificial Sequence: Synthetic peptide
DGNEWTTTNGVFEDIGTRINTNFDGGTN

SEQ ID NO: 40655 - protein, 28 aa, Artificial Sequence
  Description of Artificial Sequence: Synthetic peptide
SDEQLSYNNRVDIEEIGSRSDNIQRETG

SEQ ID NO: 40656 - protein, 28 aa, Artificial Sequence
  Description of Artificial Sequence: Synthetic peptide
DEENLNSTNGSHLSNTGTTSFNLRRSSS

SEQ ID NO: 40657 - protein, 36 aa, Artificial Sequence
  Description of Artificial Sequence: Synthetic polypeptide
AENEIAQTNPVATEQYGVVSATTDGQVELDNGEEDD

SEQ ID NO: 40658 - protein, 28 aa, Artificial Sequence
  Description of Artificial Sequence: Synthetic peptide
DDQGLMNASIADTDHYGSVSTTQRTKNG

SEQ ID NO: 40659 - protein, 28 aa, Artificial Sequence
  Description of Artificial Sequence: Synthetic peptide
DEEEVQNVEDVLTRQRRLVTNEIQYLSG

SEQ ID NO: 40660 - protein, 28 aa, Artificial Sequence
  Description of Artificial Sequence: Synthetic peptide
DEEHNTTTNIIDRLQYSLTSNNFTENSD

SEQ ID NO: 40661 - protein, 28 aa, Artificial Sequence
  Description of Artificial Sequence: Synthetic peptide
SEEEEQNTNDSILDQLQRVATNIHWTNG

SEQ ID NO: 40662 - protein, 37 aa, Artificial Sequence
  Description of Artificial Sequence: Synthetic polypeptide
CEEEIRTTNPVATEVYGAVSSLTMEGIVETSEGETLQ

SEQ ID NO: 40663 - protein, 28 aa, Artificial Sequence
  Description of Artificial Sequence: Synthetic peptide
IEEEGGTNNIVAQDHVSGNSTYHSSANG

SEQ ID NO: 40664 - protein, 28 aa, Artificial Sequence
  Description of Artificial Sequence: Synthetic peptide
ESEEEATGNRVHNEILGRVADQIQNLNT

SEQ ID NO: 40665 - protein, 28 aa, Artificial Sequence
  Description of Artificial Sequence: Synthetic peptide
DEQEVSTQNWVDESRYSENVTNMGGANS

SEQ ID NO: 40666 - protein, 28 aa, Artificial Sequence
  Description of Artificial Sequence: Synthetic peptide
DIEGVSTNNGYTWLNWGSVNDNGQGGVT

SEQ ID NO: 40667 - protein, 28 aa, Artificial Sequence
  Description of Artificial Sequence: Synthetic peptide
DESGIIETTIARTEEYNTVVSQLGGNTN

SEQ ID NO: 40668 - protein, 28 aa, Artificial Sequence
  Description of Artificial Sequence: Synthetic peptide
DDETFHITNIAGWRNYGGVSDNEQNTTT

SEQ ID NO: 40669 - protein, 28 aa, Artificial Sequence
  Description of Artificial Sequence: Synthetic peptide
NEEETPTTNPIDLLHWGNTHTNVPGSGT

SEQ ID NO: 40670 - protein, 31 aa, Artificial Sequence
  Description of Artificial Sequence: Synthetic polypeptide
DEAEIAQTNPVSTEMWGVTCACTIQSHVGDY

SEQ ID NO: 40671 - protein, 28 aa, Artificial Sequence
  Description of Artificial Sequence: Synthetic peptide
DNLEGETNNEVGTDVQGTTATNIYGKNT

SEQ ID NO: 40672 - protein, 28 aa, Artificial Sequence
  Description of Artificial Sequence: Synthetic peptide
DEQAGANNNVVATRSYGGTADNSQFTGT

SEQ ID NO: 40673 - protein, 28 aa, Artificial Sequence
  Description of Artificial Sequence: Synthetic peptide
DEIEVQTNNIFGFEIYGKTVDQQQHRDN

SEQ ID NO: 40674 - protein, 28 aa, Artificial Sequence
  Description of Artificial Sequence: Synthetic peptide
DQEEGKTTNGIFIERCGGVADDKQYRTT

SEQ ID NO: 40675 - protein, 28 aa, Artificial Sequence
  Description of Artificial Sequence: Synthetic peptide
DEDEGGTTNGVGWQRWNATNTNFGAGTN

SEQ ID NO: 40676 - protein, 28 aa, Artificial Sequence
  Description of Artificial Sequence: Synthetic peptide
SSDNINQTLNASTQEYDGTGTNVQNGNG

SEQ ID NO: 40677 - protein, 28 aa, Artificial Sequence
  Description of Artificial Sequence: Synthetic peptide
EVEEIIYTNITDIEQIDGVTERAWSANG

SEQ ID NO: 40678 - protein, 28 aa, Artificial Sequence
  Description of Artificial Sequence: Synthetic peptide
DEIATNTNNIVFTDNVDILTNNLQHVRG

SEQ ID NO: 40679 - protein, 28 aa, Artificial Sequence
  Description of Artificial Sequence: Synthetic peptide
DEGHIIATNWIDNEHQTVRHTNVGAANG

SEQ ID NO: 40680 - protein, 28 aa, Artificial Sequence
  Description of Artificial Sequence: Synthetic peptide
DERNTNTTNPIDLLNVGTVSDPIGGKTG

SEQ ID NO: 40681 - protein, 34 aa, Artificial Sequence
  Description of Artificial Sequence: Synthetic polypeptide
DETEIRTTNPIATECWGATTWANAEDWAEPGPYI

SEQ ID NO: 40682 - protein, 38 aa, Artificial Sequence
  Description of Artificial Sequence: Synthetic polypeptide
DEEEIRTTNPFATEQYWSYVTHITPGPDVFPPNGLEPD

SEQ ID NO: 40683 - protein, 28 aa, Artificial Sequence
  Description of Artificial Sequence: Synthetic peptide
DEREFATTNEVDNENHTLINDYIGHANG

SEQ ID NO: 40684 - protein, 28 aa, Artificial Sequence
  Description of Artificial Sequence: Synthetic peptide
DEQEIANTNKVDFRIWGLMAYQKDGKNG

SEQ ID NO: 40685 - protein, 34 aa, Artificial Sequence
  Description of Artificial Sequence: Synthetic polypeptide
DEEEIRTTNPVSYEALWGHSYSEHDMMIVEDLDS

SEQ ID NO: 40686 - protein, 28 aa, Artificial Sequence
  Description of Artificial Sequence: Synthetic peptide
EEVEVITQNQVAQRVGTLRSDNMQNASG

SEQ ID NO: 40687 - protein, 28 aa, Artificial Sequence
  Description of Artificial Sequence: Synthetic peptide
DWQEINYTNLGTTLNTLLVDDAIQIGTT

SEQ ID NO: 40688 - protein, 28 aa, Artificial Sequence
  Description of Artificial Sequence: Synthetic peptide
DEGGWATQNNMGREVYGGTVDQTENRSN

SEQ ID NO: 40689 - protein, 28 aa, Artificial Sequence
  Description of Artificial Sequence: Synthetic peptide
SEQEIQTNRRTALDEYGTIGNNVTGTNT

SEQ ID NO: 40690 - protein, 28 aa, Artificial Sequence
  Description of Artificial Sequence: Synthetic peptide
DEQERNTNNIMSNNVYGVVADGIQGKGD

SEQ ID NO: 40691 - protein, 28 aa, Artificial Sequence
  Description of Artificial Sequence: Synthetic peptide
EEEETPTTNPTDFLHQLNTHTNVPGKGD

SEQ ID NO: 40692 - protein, 28 aa, Artificial Sequence
  Description of Artificial Sequence: Synthetic peptide
DEGGGATTNITHIDVYGATVDQMLWSNN

SEQ ID NO: 40693 - protein, 34 aa, Artificial Sequence
  Description of Artificial Sequence: Synthetic polypeptide
SEVEIACTNPTATELFGEVISEMGGEQREGDTDF

SEQ ID NO: 40694 - protein, 28 aa, Artificial Sequence
  Description of Artificial Sequence: Synthetic peptide
DGDEINTTNNIITRPLGGTRDQLLYSAT

SEQ ID NO: 40695 - protein, 28 aa, Artificial Sequence
  Description of Artificial Sequence: Synthetic peptide
DEEETNTTNNIDLLRLGTTHDNVPGSGT

SEQ ID NO: 40696 - protein, 28 aa, Artificial Sequence
  Description of Artificial Sequence: Synthetic peptide
ADSETAITNIVGWEEYGVTEENEYSTNT

SEQ ID NO: 40697 - protein, 28 aa, Artificial Sequence
  Description of Artificial Sequence: Synthetic peptide
DIEMSLTGNTVAGDGYLVTRDQVQRAGT

SEQ ID NO: 40698 - protein, 28 aa, Artificial Sequence
  Description of Artificial Sequence: Synthetic peptide
DGDGIITTQTAFLESLTADTTQFQSGNT

SEQ ID NO: 40699 - protein, 28 aa, Artificial Sequence
  Description of Artificial Sequence: Synthetic peptide
EEISTNTNDIVSLNRFGEVTDNIENGGT

SEQ ID NO: 40700 - protein, 28 aa, Artificial Sequence
  Description of Artificial Sequence: Synthetic peptide
DEGGLTFTDIYTTEEYLNTSDNATGGVT

SEQ ID NO: 40701 - protein, 28 aa, Artificial Sequence
  Description of Artificial Sequence: Synthetic peptide
EEENGNRTLIDADRQVLSLSDNSQGKTT

SEQ ID NO: 40702 - protein, 28 aa, Artificial Sequence
  Description of Artificial Sequence: Synthetic peptide
AGDDIINNNDYKIEQYTSVADTLYYGTV

SEQ ID NO: 40703 - protein, 28 aa, Artificial Sequence
  Description of Artificial Sequence: Synthetic peptide
DGLETNNTNNQGAEQYIETKDYLQYQRG

SEQ ID NO: 40704 - protein, 28 aa, Artificial Sequence
  Description of Artificial Sequence: Synthetic peptide
DEIEIANNNNLVWNIYGHNSDAVQGVAA

SEQ ID NO: 40705 - protein, 28 aa, Artificial Sequence
  Description of Artificial Sequence: Synthetic peptide
EEEHNISENDVDLERYGRTHSNFQNSGT

SEQ ID NO: 40706 - protein, 28 aa, Artificial Sequence
  Description of Artificial Sequence: Synthetic peptide
DVDEISTEDHIANRNILNTSDNIQYANS

SEQ ID NO: 40707 - protein, 36 aa, Artificial Sequence
  Description of Artificial Sequence: Synthetic polypeptide
MEVEIGTTNPCATEAYGNVPALTNPGVDLDDGVEEW

SEQ ID NO: 40708 - protein, 28 aa, Artificial Sequence
  Description of Artificial Sequence: Synthetic peptide
DSENNKFNQNADTDNLGRVSDNSGSTNS

SEQ ID NO: 40709 - protein, 28 aa, Artificial Sequence
  Description of Artificial Sequence: Synthetic peptide
NEEETPTTNPTDLLHWLNTHTNVPGSGT

SEQ ID NO: 40710 - protein, 28 aa, Artificial Sequence
  Description of Artificial Sequence: Synthetic peptide
DEEETNTTNNIDLRRLGGTHDNVPGSGT

SEQ ID NO: 40711 - protein, 28 aa, Artificial Sequence
  Description of Artificial Sequence: Synthetic peptide
DEQNINTTNPIDLDNVGTTHTPIGGKTG

SEQ ID NO: 40712 - protein, 28 aa, Artificial Sequence
  Description of Artificial Sequence: Synthetic peptide
DEQAIKTTNDDILCIQHLVDDNIYYSGN

SEQ ID NO: 40713 - protein, 28 aa, Artificial Sequence
  Description of Artificial Sequence: Synthetic peptide
NEEETPTTNPIDLLHWLNTHTNVPGSGD

SEQ ID NO: 40714 - protein, 28 aa, Artificial Sequence
  Description of Artificial Sequence: Synthetic peptide
DEQGINNINWVTMCDWSQNRDNLQQQGT

SEQ ID NO: 40715 - protein, 35 aa, Artificial Sequence
  Description of Artificial Sequence: Synthetic polypeptide
DEHEIATTNPVATEQYGDAFCEMDEQCCHAEFDDQ

SEQ ID NO: 40716 - protein, 28 aa, Artificial Sequence
  Description of Artificial Sequence: Synthetic peptide
DEQNINTNNPVTNDNVLLTTDPIGGKTG

SEQ ID NO: 40717 - protein, 28 aa, Artificial Sequence
  Description of Artificial Sequence: Synthetic peptide
NEEEVPTTNPIDLLHWLTTHTNVPGSGT

SEQ ID NO: 40718 - protein, 28 aa, Artificial Sequence
  Description of Artificial Sequence: Synthetic peptide
EEEETPTTNPTDLLHQLNTHTNVPGSGT

SEQ ID NO: 40719 - protein, 28 aa, Artificial Sequence
  Description of Artificial Sequence: Synthetic peptide
DENSIGTTLGRATEVWQLLEDQKQGTAE

SEQ ID NO: 40720 - protein, 28 aa, Artificial Sequence
  Description of Artificial Sequence: Synthetic peptide
EEEETPTTNPTDLLHWLNTHTNVPGSGT

SEQ ID NO: 40721 - protein, 28 aa, Artificial Sequence
  Description of Artificial Sequence: Synthetic peptide
VDETIINTMNVTQENVGLVTTQQYTKAG

SEQ ID NO: 40722 - protein, 28 aa, Artificial Sequence
  Description of Artificial Sequence: Synthetic peptide
DWENTGNINIVDARVIGEKRTQMQRSNS

SEQ ID NO: 40723 - protein, 28 aa, Artificial Sequence
  Description of Artificial Sequence: Synthetic peptide
DERETNTTNPIDLLRWGTVHDPVPGSGT

SEQ ID NO: 40724 - protein, 28 aa, Artificial Sequence
  Description of Artificial Sequence: Synthetic peptide
DELQINTTGMVDTLHQGLTRDRTLGVGG

SEQ ID NO: 40725 - protein, 28 aa, Artificial Sequence
  Description of Artificial Sequence: Synthetic peptide
SEQGLISVSNVRAETYGSTSDNSENQAS

SEQ ID NO: 40726 - protein, 28 aa, Artificial Sequence
  Description of Artificial Sequence: Synthetic peptide
DSEMTISTNNFIFEAWDHTSNELQGGTT

SEQ ID NO: 40727 - protein, 28 aa, Artificial Sequence
  Description of Artificial Sequence: Synthetic peptide
DKQDALGNSATGQEVYGLVSDQLYNGSA

SEQ ID NO: 40728 - protein, 28 aa, Artificial Sequence
  Description of Artificial Sequence: Synthetic peptide
DEVNGNFTLDLGTENWISVTDNIQGATE

SEQ ID NO: 40729 - protein, 28 aa, Artificial Sequence
  Description of Artificial Sequence: Synthetic peptide
DLRDDQTTLQAALEQWGSIADNVDGTTT

SEQ ID NO: 40730 - protein, 28 aa, Artificial Sequence
  Description of Artificial Sequence: Synthetic peptide
EEEETPTTNPTDFLHQLNTHTNVPGSGT

SEQ ID NO: 40731 - protein, 28 aa, Artificial Sequence
  Description of Artificial Sequence: Synthetic peptide
RIEGITNNRNIGADETGLISDNFQSGDT

SEQ ID NO: 40732 - protein, 28 aa, Artificial Sequence
  Description of Artificial Sequence: Synthetic peptide
DEEEVNTTNPIDLLRLGTTHDPVPGSGT

SEQ ID NO: 40733 - protein, 28 aa, Artificial Sequence
  Description of Artificial Sequence: Synthetic peptide
EEDEIRTNSIIDNDHRLVVNQNLQGQTD

SEQ ID NO: 40734 - protein, 28 aa, Artificial Sequence
  Description of Artificial Sequence: Synthetic peptide
DWQNINFTNPVTNDNVLLPSDPIGGGNG

SEQ ID NO: 40735 - protein, 34 aa, Artificial Sequence
  Description of Artificial Sequence: Synthetic polypeptide
DESEIQCTNPTATECWGGVSCIMEPQDHEEENTG

SEQ ID NO: 40736 - protein, 28 aa, Artificial Sequence
  Description of Artificial Sequence: Synthetic peptide
IEDEWISTNGVHNRMYGILGSQLQSSGS

SEQ ID NO: 40737 - protein, 28 aa, Artificial Sequence
  Description of Artificial Sequence: Synthetic peptide
DEQNIGFNNRIANEHLGNTTTAEGGTNN

SEQ ID NO: 40738 - protein, 28 aa, Artificial Sequence
  Description of Artificial Sequence: Synthetic peptide
DESEILTSNNGTTRRETQIQSNDQTSAD

SEQ ID NO: 40739 - protein, 28 aa, Artificial Sequence
  Description of Artificial Sequence: Synthetic peptide
DGEVNEFTNIIATDNVGGVDRVHDQKNT

SEQ ID NO: 40740 - protein, 28 aa, Artificial Sequence
  Description of Artificial Sequence: Synthetic peptide
DEQMTNNNHNVDTSQIGHTSDTILYSNE

SEQ ID NO: 40741 - protein, 28 aa, Artificial Sequence
  Description of Artificial Sequence: Synthetic peptide
DGEEVRNIEDVATRRVDMLGTQNQWTTE

SEQ ID NO: 40742 - protein, 28 aa, Artificial Sequence
  Description of Artificial Sequence: Synthetic peptide
DEDGVAITNGVAWRELGGTADQKLNRTT

SEQ ID NO: 40743 - protein, 28 aa, Artificial Sequence
  Description of Artificial Sequence: Synthetic peptide
DEGEVQGTQNVITRVYTMTSDRAQSAAT

SEQ ID NO: 40744 - protein, 28 aa, Artificial Sequence
  Description of Artificial Sequence: Synthetic peptide
DGSEINNTNGGTLRIVTGTDDTLLNQGN

SEQ ID NO: 40745 - protein, 28 aa, Artificial Sequence
  Description of Artificial Sequence: Synthetic peptide
DENSWRTGNAYTDDNELVISTNVYATTT

SEQ ID NO: 40746 - protein, 28 aa, Artificial Sequence
  Description of Artificial Sequence: Synthetic peptide
SEREISINNIVTDNNVGTVQSNQGNKQA

SEQ ID NO: 40747 - protein, 28 aa, Artificial Sequence
  Description of Artificial Sequence: Synthetic peptide
DEQNINTTNPVDNDNVLTTTDPIGGKTG

SEQ ID NO: 40748 - protein, 28 aa, Artificial Sequence
  Description of Artificial Sequence: Synthetic peptide
DERTTQFVNDLTQRVYQYTGTNTLQAAN

SEQ ID NO: 40749 - protein, 28 aa, Artificial Sequence
  Description of Artificial Sequence: Synthetic peptide
DETEANTVSGVIIEQQDGTADNTQSQGG

SEQ ID NO: 40750 - protein, 28 aa, Artificial Sequence
  Description of Artificial Sequence: Synthetic peptide
DGVEIQTGKIVTNREYGNLSTQEIGAGG

SEQ ID NO: 40751 - protein, 28 aa, Artificial Sequence
  Description of Artificial Sequence: Synthetic peptide
EEIEIAQVNGTISESYGGTVDNKQYNSS

SEQ ID NO: 40752 - protein, 28 aa, Artificial Sequence
  Description of Artificial Sequence: Synthetic peptide
NEDETAGENIVAISILGRVATNEYAQRT

SEQ ID NO: 40753 - protein, 28 aa, Artificial Sequence
  Description of Artificial Sequence: Synthetic peptide
NEIGIATTNIIDTAQLGRIVDGIQYSTT

SEQ ID NO: 40754 - protein, 28 aa, Artificial Sequence
  Description of Artificial Sequence: Synthetic peptide
DEQNINTTNPIDNDNVGTTSDPIGGKTG

SEQ ID NO: 40755 - protein, 34 aa, Artificial Sequence
  Description of Artificial Sequence: Synthetic polypeptide
DETEIRTTNPIATECWGATTWSNAEDWAEPGPYI

SEQ ID NO: 40756 - protein, 28 aa, Artificial Sequence
  Description of Artificial Sequence: Synthetic peptide
GGEEGQITNGNATDVYNYTATDNQQATT

SEQ ID NO: 40757 - protein, 28 aa, Artificial Sequence
  Description of Artificial Sequence: Synthetic peptide
EEEETPTTNPIDFLHWLNTHTNVPGSGD

SEQ ID NO: 40758 - protein, 28 aa, Artificial Sequence
  Description of Artificial Sequence: Synthetic peptide
NEEGITAVNNYGTRVYLGTRGNLDNGAT

SEQ ID NO: 40759 - protein, 28 aa, Artificial Sequence
  Description of Artificial Sequence: Synthetic peptide
NEIATDINVWVATRNLGGRSDSLQGSAG

SEQ ID NO: 40760 - protein, 28 aa, Artificial Sequence
  Description of Artificial Sequence: Synthetic peptide
DSDEGETNNIVGTEISGNHHDTFDTGTT

SEQ ID NO: 40761 - protein, 35 aa, Artificial Sequence
  Description of Artificial Sequence: Synthetic polypeptide
DEHEIATTNPVATEQYGDAFCEMDEQCCHAEFDDA

SEQ ID NO: 40762 - protein, 28 aa, Artificial Sequence
  Description of Artificial Sequence: Synthetic peptide
AEENISTNQGMETEEQGNTRTYTGRLTT

SEQ ID NO: 40763 - protein, 28 aa, Artificial Sequence
  Description of Artificial Sequence: Synthetic peptide
DEEGGATANGFRIEVLGLVADQELYSDN

SEQ ID NO: 40764 - protein, 28 aa, Artificial Sequence
  Description of Artificial Sequence: Synthetic peptide
DGQEGRCVNGIGTEGQGVTGSQLERTGT

SEQ ID NO: 40765 - protein, 28 aa, Artificial Sequence
  Description of Artificial Sequence: Synthetic peptide
EEQGIITGSIVTQEQQSAIGSQEDQGNT

SEQ ID NO: 40766 - protein, 28 aa, Artificial Sequence
  Description of Artificial Sequence: Synthetic peptide
QEENDNSGMLIATSQVGNTRDNQQNSNT

SEQ ID NO: 40767 - protein, 28 aa, Artificial Sequence
  Description of Artificial Sequence: Synthetic peptide
DGEFIRTVNQSTFEIVSELGDEIGTRSN

SEQ ID NO: 40768 - protein, 28 aa, Artificial Sequence
  Description of Artificial Sequence: Synthetic peptide
DEEGNNNGNLTIFKTLQGTRDNNLWQAN

SEQ ID NO: 40769 - protein, 28 aa, Artificial Sequence
  Description of Artificial Sequence: Synthetic peptide
DEGAINNNNGIRQCVLGATRQNSQIRDN

SEQ ID NO: 40770 - protein, 28 aa, Artificial Sequence
  Description of Artificial Sequence: Synthetic peptide
SEQRLVTTNNATQEVVDLIHTQHQSNGT

SEQ ID NO: 40771 - protein, 28 aa, Artificial Sequence
  Description of Artificial Sequence: Synthetic peptide
DDEDSTTNNQVANNVESLTEGNIQSKSG

SEQ ID NO: 40772 - protein, 28 aa, Artificial Sequence
  Description of Artificial Sequence: Synthetic peptide
DEEGIIATEITINDREVHVWDEAQSKNA

SEQ ID NO: 40773 - protein, 28 aa, Artificial Sequence
  Description of Artificial Sequence: Synthetic peptide
DGEDAVTTHIIGNRNHGKTATNALYTNS

SEQ ID NO: 40774 - protein, 28 aa, Artificial Sequence
  Description of Artificial Sequence: Synthetic peptide
DERNWLDTNQRTQTQIGTGDDTIQYGTT

SEQ ID NO: 40775 - protein, 28 aa, Artificial Sequence
  Description of Artificial Sequence: Synthetic peptide
AEEQTEATNNIQTDNWSETTDRVLIGNG

SEQ ID NO: 40776 - protein, 28 aa, Artificial Sequence
  Description of Artificial Sequence: Synthetic peptide
RLQEGIFNNGDDYDQQGLTQTGLQVKNT

SEQ ID NO: 40777 - protein, 28 aa, Artificial Sequence
  Description of Artificial Sequence: Synthetic peptide
SEEETIFNRRRRNDNQDGRNNNLQTAST

SEQ ID NO: 40778 - protein, 28 aa, Artificial Sequence
  Description of Artificial Sequence: Synthetic peptide
EEGNRRTTLGYTINQGNGTAENLQQEST

SEQ ID NO: 40779 - protein, 28 aa, Artificial Sequence
  Description of Artificial Sequence: Synthetic peptide
NEGNALTANDRITSQGSENHDNVLGAGG

SEQ ID NO: 40780 - protein, 28 aa, Artificial Sequence
  Description of Artificial Sequence: Synthetic peptide
NEQEFRNTRNVMTIVQGATNDNAEGAAT

SEQ ID NO: 40781 - protein, 28 aa, Artificial Sequence
  Description of Artificial Sequence: Synthetic peptide
DGLETNATSQFIREEWDNANTNLQGKTT

SEQ ID NO: 40782 - protein, 28 aa, Artificial Sequence
  Description of Artificial Sequence: Synthetic peptide
DEEEGQTNNHFTNRILIQTRTNALATAE

SEQ ID NO: 40783 - protein, 28 aa, Artificial Sequence
  Description of Artificial Sequence: Synthetic peptide
DEEMGSDENDQVQRHVGSTNTRILGTTN

SEQ ID NO: 40784 - protein, 28 aa, Artificial Sequence
  Description of Artificial Sequence: Synthetic peptide
DEPEGATTNNVGIRVLGGTRDQALYQAT

SEQ ID NO: 40785 - protein, 28 aa, Artificial Sequence
  Description of Artificial Sequence: Synthetic peptide
DIEENINGSEVDLDVYLGVRDMLQGQTT

SEQ ID NO: 40786 - protein, 28 aa, Artificial Sequence
  Description of Artificial Sequence: Synthetic peptide
DEQETNGNNAIAMETGTTNRNYIQASTS

SEQ ID NO: 40787 - protein, 28 aa, Artificial Sequence
  Description of Artificial Sequence: Synthetic peptide
NEEEASAAIRVDFDQIGMTRDGLGSGTS

SEQ ID NO: 40788 - protein, 28 aa, Artificial Sequence
  Description of Artificial Sequence: Synthetic peptide
DKQETLATNNLTAEQYDTTTTRITGQGT

SEQ ID NO: 40789 - protein, 28 aa, Artificial Sequence
  Description of Artificial Sequence: Synthetic peptide
NEEETPTTNPIDLLHILNTHTPVPGKGD

SEQ ID NO: 40790 - protein, 28 aa, Artificial Sequence
  Description of Artificial Sequence: Synthetic peptide
DEQGIQANNIIGWEEINTRHNNEQNANT

SEQ ID NO: 40791 - protein, 28 aa, Artificial Sequence
  Description of Artificial Sequence: Synthetic peptide
DEQNINTTSPVDNDNILTVHDPIGGKTG

SEQ ID NO: 40792 - protein, 28 aa, Artificial Sequence
  Description of Artificial Sequence: Synthetic peptide
DSQEVITTEDVSTKSLGTNDNNAEYQGG

SEQ ID NO: 40793 - protein, 28 aa, Artificial Sequence
  Description of Artificial Sequence: Synthetic peptide
EGEAIDGNNNIDLTVQLGIWNTNLTQAT

SEQ ID NO: 40794 - protein, 28 aa, Artificial Sequence
  Description of Artificial Sequence: Synthetic peptide
DGQNIENGNITINENETEVRSNIDRLNG

SEQ ID NO: 40795 - protein, 28 aa, Artificial Sequence
  Description of Artificial Sequence: Synthetic peptide
AADGINNTNTYANDNYGLTAQNLTNQSE

SEQ ID NO: 40796 - protein, 28 aa, Artificial Sequence
  Description of Artificial Sequence: Synthetic peptide
DEEGMINTNNYAQDQTLNDGNNVYNDTS

SEQ ID NO: 40797 - protein, 28 aa, Artificial Sequence
  Description of Artificial Sequence: Synthetic peptide
NEQGLHNNNDIATERIGAIVTEMGRHTG

SEQ ID NO: 40798 - protein, 28 aa, Artificial Sequence
  Description of Artificial Sequence: Synthetic peptide
NEEEVPTTNPIDLDHILNTHTPVPGKGD

SEQ ID NO: 40799 - protein, 28 aa, Artificial Sequence
  Description of Artificial Sequence: Synthetic peptide
IGDEVRTTNITDNDNEGDTSNYLAYTTT

SEQ ID NO: 40800 - protein, 28 aa, Artificial Sequence
  Description of Artificial Sequence: Synthetic peptide
DEQQITTNDIIDFSNAGQVADYILYTGS

SEQ ID NO: 40801 - protein, 28 aa, Artificial Sequence
  Description of Artificial Sequence: Synthetic peptide
IEEDIDTTNQVINNRVTLLKNENSGGDG

SEQ ID NO: 40802 - protein, 35 aa, Artificial Sequence
  Description of Artificial Sequence: Synthetic polypeptide
DETEIRTTNPIATECWGATTWANAEDWAEPKGPYI

SEQ ID NO: 40803 - protein, 28 aa, Artificial Sequence
  Description of Artificial Sequence: Synthetic peptide
DFEELNDTNALAILNYDNTHANTGGLTQ

SEQ ID NO: 40804 - protein, 28 aa, Artificial Sequence
  Description of Artificial Sequence: Synthetic peptide
DEVGLNFNHIGAEEQFGNVHDEQQSKTT

SEQ ID NO: 40805 - protein, 28 aa, Artificial Sequence
  Description of Artificial Sequence: Synthetic peptide
NEEETPTTNPIDLLHWLNTHTPVPGKGD

SEQ ID NO: 40806 - protein, 28 aa, Artificial Sequence
  Description of Artificial Sequence: Synthetic peptide
DEIGVATGNIVRREKEGQTRDIAQISTT

SEQ ID NO: 40807 - protein, 28 aa, Artificial Sequence
  Description of Artificial Sequence: Synthetic peptide
DEIEVATTRNFAQRVLSQTRDIEQASGN

SEQ ID NO: 40808 - protein, 28 aa, Artificial Sequence
  Description of Artificial Sequence: Synthetic peptide
DEGGTQTVNGYGISTQTGTVDNEQYQTN

SEQ ID NO: 40809 - protein, 28 aa, Artificial Sequence
  Description of Artificial Sequence: Synthetic peptide
DEQNINTNNPVDNDNVLTTTDPIGGKTG

SEQ ID NO: 40810 - protein, 28 aa, Artificial Sequence
  Description of Artificial Sequence: Synthetic peptide
DGQEVLTGNDFFLTNQGGTRDAVGTGNH

SEQ ID NO: 40811 - protein, 28 aa, Artificial Sequence
  Description of Artificial Sequence: Synthetic peptide
IEEGINLTDGIADLNLYTVTTNIDGKAN

SEQ ID NO: 40812 - protein, 28 aa, Artificial Sequence
  Description of Artificial Sequence: Synthetic peptide
DEINIRNANITAQENLSGTRDVITGGAN

SEQ ID NO: 40813 - protein, 28 aa, Artificial Sequence
  Description of Artificial Sequence: Synthetic peptide
DETITEQASHIHWLQILMTSDNLLNGNG

SEQ ID NO: 40814 - protein, 34 aa, Artificial Sequence
  Description of Artificial Sequence: Synthetic polypeptide
DESEIQCTNPTATECWGGVSCIMEPQDHEEEPTG

SEQ ID NO: 40815 - protein, 28 aa, Artificial Sequence
  Description of Artificial Sequence: Synthetic peptide
EEEETPTTNPTDFLHQLNTHTPVPGKGD

SEQ ID NO: 40816 - protein, 28 aa, Artificial Sequence
  Description of Artificial Sequence: Synthetic peptide
EEEETPTTNPIDFLHILNTHTPVPGKGD

SEQ ID NO: 40817 - protein, 28 aa, Artificial Sequence
  Description of Artificial Sequence: Synthetic peptide
DEREWVFENNVTQDHIGTVVQNKISKTS

SEQ ID NO: 40818 - protein, 28 aa, Artificial Sequence
  Description of Artificial Sequence: Synthetic peptide
DDIEVITNQGYTMRVTGTLSDNKGQSNN

SEQ ID NO: 40819 - protein, 28 aa, Artificial Sequence
  Description of Artificial Sequence: Synthetic peptide
DGQTWQTTNCVNADRQGLIKDDILRLTG

SEQ ID NO: 40820 - protein, 28 aa, Artificial Sequence
  Description of Artificial Sequence: Synthetic peptide
DEQEVNNGNIMTIDRVGEVHNQNLSYGS

SEQ ID NO: 40821 - protein, 28 aa, Artificial Sequence
  Description of Artificial Sequence: Synthetic peptide
DEGNIQIGNWYRTEILSGVADQYGQTND

SEQ ID NO: 40822 - protein, 28 aa, Artificial Sequence
  Description of Artificial Sequence: Synthetic peptide
DWEFLITVNGVANDVGLGTDTRIEGKND

SEQ ID NO: 40823 - protein, 28 aa, Artificial Sequence
  Description of Artificial Sequence: Synthetic peptide
DWQNINFNNPVTLDNVLLPTDPIGGKNG

SEQ ID NO: 40824 - protein, 28 aa, Artificial Sequence
  Description of Artificial Sequence: Synthetic peptide
DGEEVIAANNTDTDIVHLIHYNFQGKNN

SEQ ID NO: 40825 - protein, 28 aa, Artificial Sequence
  Description of Artificial Sequence: Synthetic peptide
DGQNFNTDNAITTLQLGGVTDESIGVQT

SEQ ID NO: 40826 - protein, 28 aa, Artificial Sequence
  Description of Artificial Sequence: Synthetic peptide
DDIGIGNNNIVDLAKYLLMEDNLLRASG

SEQ ID NO: 40827 - protein, 28 aa, Artificial Sequence
  Description of Artificial Sequence: Synthetic peptide
AEITLDNTNGAATSQWDVTNDEIYGTTG

SEQ ID NO: 40828 - protein, 28 aa, Artificial Sequence
  Description of Artificial Sequence: Synthetic peptide
EEEVTNTQSIIDWNMVGTVTDNNQIKNE

SEQ ID NO: 40829 - protein, 28 aa, Artificial Sequence
  Description of Artificial Sequence: Synthetic peptide
ADQGTNITNGVDRFQYGIIDDQLQFQGG

SEQ ID NO: 40830 - protein, 28 aa, Artificial Sequence
  Description of Artificial Sequence: Synthetic peptide
DERGGDDQNIITTDVYSGARVYNQSGGN

SEQ ID NO: 40831 - protein, 28 aa, Artificial Sequence
  Description of Artificial Sequence: Synthetic peptide
DGEGIQTNTVYENDIESGTEDQALSRTT

SEQ ID NO: 40832 - protein, 28 aa, Artificial Sequence
  Description of Artificial Sequence: Synthetic peptide
DEEEVNTTNNIDLLRLGTTHDPVPGSGT

SEQ ID NO: 40833 - protein, 28 aa, Artificial Sequence
  Description of Artificial Sequence: Synthetic peptide
EQESLAITNEVRKENQGGITDNLEYAAT

SEQ ID NO: 40834 - protein, 28 aa, Artificial Sequence
  Description of Artificial Sequence: Synthetic peptide
DEQGTNYTNDVQTLNVLLLEDKLGQGAT

SEQ ID NO: 40835 - protein, 28 aa, Artificial Sequence
  Description of Artificial Sequence: Synthetic peptide
NEEESTFTSNVSTDGILNVAENATGAST

SEQ ID NO: 40836 - protein, 28 aa, Artificial Sequence
  Description of Artificial Sequence: Synthetic peptide
DWQNINFTNPVTLDNVLLPSDPIGGKNG

SEQ ID NO: 40837 - protein, 28 aa, Artificial Sequence
  Description of Artificial Sequence: Synthetic peptide
DEEEVAFSNVFDLSRYGTTNNRVYNNTT

SEQ ID NO: 40838 - protein, 28 aa, Artificial Sequence
  Description of Artificial Sequence: Synthetic peptide
DWSEGSSGNGMNTERYGELADKQGAGTG

SEQ ID NO: 40839 - protein, 28 aa, Artificial Sequence
  Description of Artificial Sequence: Synthetic peptide
DEENINNNNSVGSRTWNRHTENILQADT

SEQ ID NO: 40840 - protein, 28 aa, Artificial Sequence
  Description of Artificial Sequence: Synthetic peptide
DWQNINFNNPVTNDNVLLPTDPIGGKNG

SEQ ID NO: 40841 - protein, 28 aa, Artificial Sequence
  Description of Artificial Sequence: Synthetic peptide
DEDGILNTNNGREDVLGRIDTQCTYRAN

SEQ ID NO: 40842 - protein, 28 aa, Artificial Sequence
  Description of Artificial Sequence: Synthetic peptide
DGEGQNTTNIIATDHVGQRNDGVDGKTG

SEQ ID NO: 40843 - protein, 28 aa, Artificial Sequence
  Description of Artificial Sequence: Synthetic peptide
DDEGVATANIYFSEIYGKLANQLESQTN

SEQ ID NO: 40844 - protein, 28 aa, Artificial Sequence
  Description of Artificial Sequence: Synthetic peptide
VEEEIIANNNTDFINQTGTNSQIQYVTN

SEQ ID NO: 40845 - protein, 28 aa, Artificial Sequence
  Description of Artificial Sequence: Synthetic peptide
AEQEIETNHNVTGLQFTIIRTNNGGKSG

SEQ ID NO: 40846 - protein, 28 aa, Artificial Sequence
  Description of Artificial Sequence: Synthetic peptide
NEEEVPTTNPIDLDHILTTHTPIGGKTG

SEQ ID NO: 40847 - protein, 28 aa, Artificial Sequence
  Description of Artificial Sequence: Synthetic peptide
DERGGESVNNVDGAHLGTLHDNLLNMNT

SEQ ID NO: 40848 - protein, 28 aa, Artificial Sequence
  Description of Artificial Sequence: Synthetic peptide
EWEEIRNNVIVTNDHYSMTSDQLISLAG

SEQ ID NO: 40849 - protein, 28 aa, Artificial Sequence
  Description of Artificial Sequence: Synthetic peptide
QEENIIDVNNIDQEMVLGREDNLQAKGT

SEQ ID NO: 40850 - protein, 28 aa, Artificial Sequence
  Description of Artificial Sequence: Synthetic peptide
DERNTNTTNPIDLLNIGTVHDPVPGKTT

SEQ ID NO: 40851 - protein, 28 aa, Artificial Sequence
  Description of Artificial Sequence: Synthetic peptide
SWQEIDYGNWVAQSKVGGTATNVEGSTL

SEQ ID NO: 40852 - protein, 28 aa, Artificial Sequence
  Description of Artificial Sequence: Synthetic peptide
DEGHQASTNGIGTRELTTVRDQSTYQGR

SEQ ID NO: 40853 - protein, 28 aa, Artificial Sequence
  Description of Artificial Sequence: Synthetic peptide
DEEGTNTTNNIDQRVLGGTRDQVQNSGT

SEQ ID NO: 40854 - protein, 28 aa, Artificial Sequence
  Description of Artificial Sequence: Synthetic peptide
DGSELEFTVIAKNDQYLHVTTDGQWQTT

SEQ ID NO: 40855 - protein, 28 aa, Artificial Sequence
  Description of Artificial Sequence: Synthetic peptide
DEQEIGSNNNTVQRQWDTTANSILNGSG

SEQ ID NO: 40856 - protein, 28 aa, Artificial Sequence
  Description of Artificial Sequence: Synthetic peptide
DGENTNNTNPIDLLNIGTVSDPIGGKTG

SEQ ID NO: 40857 - protein, 28 aa, Artificial Sequence
  Description of Artificial Sequence: Synthetic peptide
DEIEGNATNISAIEILSRTRNQMLWQAD

SEQ ID NO: 40858 - protein, 28 aa, Artificial Sequence
  Description of Artificial Sequence: Synthetic peptide
DEEETNTNNNIDLRRLGGTHDNVPGSGT

SEQ ID NO: 40859 - protein, 28 aa, Artificial Sequence
  Description of Artificial Sequence: Synthetic peptide
TGDEERITNIYSQEILGGTATQQQSTSN

SEQ ID NO: 40860 - protein, 28 aa, Artificial Sequence
  Description of Artificial Sequence: Synthetic peptide
QEEEVNFNNRYTTKNTGTTMTQAQTVST

SEQ ID NO: 40861 - protein, 28 aa, Artificial Sequence
  Description of Artificial Sequence: Synthetic peptide
EDEETAQVNGVSIDGYTVVRDQLQNLGT

SEQ ID NO: 40862 - protein, 28 aa, Artificial Sequence
  Description of Artificial Sequence: Synthetic peptide
DWSFGNTTNITDQRQTGGDHHNQQSNTN

SEQ ID NO: 40863 - protein, 28 aa, Artificial Sequence
  Description of Artificial Sequence: Synthetic peptide
DEQNINTTNPVDNDNVLTTHDPIGGKTG

SEQ ID NO: 40864 - protein, 28 aa, Artificial Sequence
  Description of Artificial Sequence: Synthetic peptide
DEGSVDTTSIGALDNLGLTIENIYGANT

SEQ ID NO: 40865 - protein, 28 aa, Artificial Sequence
  Description of Artificial Sequence: Synthetic peptide
KEAGVNFNNGSATAQVGETDSQLGGANG

SEQ ID NO: 40866 - protein, 28 aa, Artificial Sequence
  Description of Artificial Sequence: Synthetic peptide
NEEIVIANSHVHQDNYTTVGSNSRNNTT

SEQ ID NO: 40867 - protein, 28 aa, Artificial Sequence
  Description of Artificial Sequence: Synthetic peptide
DESNNSITNGTAADRGLTLATYLQVASE

SEQ ID NO: 40868 - protein, 28 aa, Artificial Sequence
  Description of Artificial Sequence: Synthetic peptide
GEEGIITTRNIDNNGYTTGEDQIRGTNT

SEQ ID NO: 40869 - protein, 28 aa, Artificial Sequence
  Description of Artificial Sequence: Synthetic peptide
DEGETIDTNNGRTRQVTLINNNIIGSTD

SEQ ID NO: 40870 - protein, 28 aa, Artificial Sequence
  Description of Artificial Sequence: Synthetic peptide
DEREVNTTNPIDLLRWGTTHDPVPGSGT

SEQ ID NO: 40871 - protein, 28 aa, Artificial Sequence
  Description of Artificial Sequence: Synthetic peptide
EKAETITTNGVTWLQYGLLRDQVGGTDT

SEQ ID NO: 40872 - protein, 28 aa, Artificial Sequence
  Description of Artificial Sequence: Synthetic peptide
SDIENNITNNVDNDRYGTVADRGGRRTE

SEQ ID NO: 40873 - protein, 28 aa, Artificial Sequence
  Description of Artificial Sequence: Synthetic peptide
DNLGVDATSGVNLDQYGTMTTRQGGAGT

SEQ ID NO: 40874 - protein, 28 aa, Artificial Sequence
  Description of Artificial Sequence: Synthetic peptide
DGETVKTDNNTMQLVWLYTDDQLQSKNS

SEQ ID NO: 40875 - protein, 28 aa, Artificial Sequence
  Description of Artificial Sequence: Synthetic peptide
DEDNSEQSNIVHIKQWGTLSEGVTTTNT

SEQ ID NO: 40876 - protein, 28 aa, Artificial Sequence
  Description of Artificial Sequence: Synthetic peptide
DWQEINFNLPVTEDNVLSPEDPDYGGTG

SEQ ID NO: 40877 - protein, 28 aa, Artificial Sequence
  Description of Artificial Sequence: Synthetic peptide
DETGINQTNIFDNKQLGTVIDRKTGTTT

SEQ ID NO: 40878 - protein, 28 aa, Artificial Sequence
  Description of Artificial Sequence: Synthetic peptide
DEQDTIFTNNVKNRQFTLDGTQIQHTSN

SEQ ID NO: 40879 - protein, 28 aa, Artificial Sequence
  Description of Artificial Sequence: Synthetic peptide
DEINITNNNNVFEENVGATATETSLWGT

SEQ ID NO: 40880 - protein, 28 aa, Artificial Sequence
  Description of Artificial Sequence: Synthetic peptide
DDQNTTDNNGFAQINVGAVAQRVLQGNG

SEQ ID NO: 40881 - protein, 28 aa, Artificial Sequence
  Description of Artificial Sequence: Synthetic peptide
DDQEITTEQIVTTLHILRDNDNNDGKGG

SEQ ID NO: 40882 - protein, 28 aa, Artificial Sequence
  Description of Artificial Sequence: Synthetic peptide
NESGWSTNNGFIQRAQTGTADQNENRGT

SEQ ID NO: 40883 - protein, 28 aa, Artificial Sequence
  Description of Artificial Sequence: Synthetic peptide
EEEGIESTNNIITDRTDGIYTVVETAGT

SEQ ID NO: 40884 - protein, 28 aa, Artificial Sequence
  Description of Artificial Sequence: Synthetic peptide
DEGRIINNNGVHNDNSGYDKQQILYSNS

SEQ ID NO: 40885 - protein, 28 aa, Artificial Sequence
  Description of Artificial Sequence: Synthetic peptide
EDEGIKTDNRAIGSNYGNTRDQLYQATS

SEQ ID NO: 40886 - protein, 28 aa, Artificial Sequence
  Description of Artificial Sequence: Synthetic peptide
DWENRNANQNFANEGLYVYADLVLNGTT

SEQ ID NO: 40887 - protein, 28 aa, Artificial Sequence
  Description of Artificial Sequence: Synthetic peptide
NDQSTDTLNNFITNQVSRTATNVQNKTG

SEQ ID NO: 40888 - protein, 28 aa, Artificial Sequence
  Description of Artificial Sequence: Synthetic peptide
DERALNLTEGAKEDRVSGTETNFGNADT

SEQ ID NO: 40889 - protein, 28 aa, Artificial Sequence
  Description of Artificial Sequence: Synthetic peptide
DEQDIIYSNNIDNDIYSQTRANLSGQTS

SEQ ID NO: 40890 - protein, 28 aa, Artificial Sequence
  Description of Artificial Sequence: Synthetic peptide
DWQNINNNNPVTNDNVLLPTDPIGGKTG

SEQ ID NO: 40891 - protein, 28 aa, Artificial Sequence
  Description of Artificial Sequence: Synthetic peptide
DELDIISNRAIFTRNSGNIGDELQGQSA

SEQ ID NO: 40892 - protein, 28 aa, Artificial Sequence
  Description of Artificial Sequence: Synthetic peptide
EEETIQTNSNGIDRVVTGTGTQMQDDTN

SEQ ID NO: 40893 - protein, 28 aa, Artificial Sequence
  Description of Artificial Sequence: Synthetic peptide
DERNVNTNNPIDLLRIGTVHDPVPGSGT

SEQ ID NO: 40894 - protein, 28 aa, Artificial Sequence
  Description of Artificial Sequence: Synthetic peptide
DVEETIETNQLINGNVLNTHTQLDYTTS

SEQ ID NO: 40895 - protein, 28 aa, Artificial Sequence
  Description of Artificial Sequence: Synthetic peptide
DWQNINFNLPVTEDNVLLPTDPIGGGTG

SEQ ID NO: 40896 - protein, 28 aa, Artificial Sequence
  Description of Artificial Sequence: Synthetic peptide
DGQSIGFVNQGAITSSGMVTDGWGNASA

SEQ ID NO: 40897 - protein, 28 aa, Artificial Sequence
  Description of Artificial Sequence: Synthetic peptide
DWQNTTFNLIGTNDNVLLITDILGGGNG

SEQ ID NO: 40898 - protein, 28 aa, Artificial Sequence
  Description of Artificial Sequence: Synthetic peptide
DGNEGRSTNRYILNNIGETGDQETSSNG

SEQ ID NO: 40899 - protein, 28 aa, Artificial Sequence
  Description of Artificial Sequence: Synthetic peptide
EEQNINTLNINNNTGLVGTANQIHGKTT

SEQ ID NO: 40900 - protein, 28 aa, Artificial Sequence
  Description of Artificial Sequence: Synthetic peptide
DESEWATQSITIGEGQTGTRDQALLQAS

SEQ ID NO: 40901 - protein, 28 aa, Artificial Sequence
  Description of Artificial Sequence: Synthetic peptide
DWQNINFNNIVTNNNVLLIDDILQGGAG

SEQ ID NO: 40902 - protein, 28 aa, Artificial Sequence
  Description of Artificial Sequence: Synthetic peptide
DEDEGASNNAVRAQNVLIMRDNIGIKNA

SEQ ID NO: 40903 - protein, 28 aa, Artificial Sequence
  Description of Artificial Sequence: Synthetic peptide
NEIFYEFVNGGDTDVYDRTADNGQSGTN

SEQ ID NO: 40904 - protein, 28 aa, Artificial Sequence
  Description of Artificial Sequence: Synthetic peptide
DGRNVNTTNPIDLLNIGTVHDPVGGKTG

SEQ ID NO: 40905 - protein, 28 aa, Artificial Sequence
  Description of Artificial Sequence: Synthetic peptide
DEQALNFTNNGTMDNYQALMDNLLSATF

SEQ ID NO: 40906 - protein, 28 aa, Artificial Sequence
  Description of Artificial Sequence: Synthetic peptide
DPQNINFNNPVTLDNVLLPTDPIGGKTG

SEQ ID NO: 40907 - protein, 28 aa, Artificial Sequence
  Description of Artificial Sequence: Synthetic peptide
DWQNINFNLPVTEDNVLLPTDPIYGATG

SEQ ID NO: 40908 - protein, 28 aa, Artificial Sequence
  Description of Artificial Sequence: Synthetic peptide
DESSYKGTLGGTNERYDGTHDNWGNSRG

SEQ ID NO: 40909 - protein, 28 aa, Artificial Sequence
  Description of Artificial Sequence: Synthetic peptide
DEPEGATTNNFGIRVLGGTRDQALYQAT

SEQ ID NO: 40910 - protein, 28 aa, Artificial Sequence
  Description of Artificial Sequence: Synthetic peptide
SEEELQQGNNYFWSIQSKTRTQAQDTNN

SEQ ID NO: 40911 - protein, 28 aa, Artificial Sequence
  Description of Artificial Sequence: Synthetic peptide
DDQDVRFTMLITGEQQLERGDNIGNAGN

SEQ ID NO: 40912 - protein, 28 aa, Artificial Sequence
  Description of Artificial Sequence: Synthetic peptide
DWQNINFNLTDTEDNWLLITDIIGGANG

SEQ ID NO: 40913 - protein, 28 aa, Artificial Sequence
  Description of Artificial Sequence: Synthetic peptide
NGDETVDTTIYGFEHWSSIGTNHQYLAN

SEQ ID NO: 40914 - protein, 28 aa, Artificial Sequence
  Description of Artificial Sequence: Synthetic peptide
DEEGTNTNNNIDQRVLGGTRDQVQNKTT

SEQ ID NO: 40915 - protein, 28 aa, Artificial Sequence
  Description of Artificial Sequence: Synthetic peptide
DWQNIEFNNIVTEDNVLLIDDAIGGKNQ

SEQ ID NO: 40916 - protein, 28 aa, Artificial Sequence
  Description of Artificial Sequence: Synthetic peptide
DGIEGQNTNGTRNCVQSGTADQAIQATN

SEQ ID NO: 40917 - protein, 28 aa, Artificial Sequence
  Description of Artificial Sequence: Synthetic peptide
DEAEGENENILRIREEGETANQMLYRTN

SEQ ID NO: 40918 - protein, 28 aa, Artificial Sequence
  Description of Artificial Sequence: Synthetic peptide
REINTIFNNILLNRSVGDTSDNIQGSND

SEQ ID NO: 40919 - protein, 28 aa, Artificial Sequence
  Description of Artificial Sequence: Synthetic peptide
DGGEVQTNNGTFNRGLTATADNELVKGT

SEQ ID NO: 40920 - protein, 28 aa, Artificial Sequence
  Description of Artificial Sequence: Synthetic peptide
DEGHVDTTNIMINDIYLTTADNITNQST

SEQ ID NO: 40921 - protein, 28 aa, Artificial Sequence
  Description of Artificial Sequence: Synthetic peptide
DGENVNNTNPIDLLNIGTVHDPIGGKTG

SEQ ID NO: 40922 - protein, 28 aa, Artificial Sequence
  Description of Artificial Sequence: Synthetic peptide
EEEEWPTTSPTHFLHQLNLHTPVPGKGD

SEQ ID NO: 40923 - protein, 28 aa, Artificial Sequence
  Description of Artificial Sequence: Synthetic peptide
DASEVNTINLFHNEGLGIIHDNEESQTG

SEQ ID NO: 40924 - protein, 28 aa, Artificial Sequence
  Description of Artificial Sequence: Synthetic peptide
DEEGVNTNNNIDQRVLGGTRDQVGGKTT

SEQ ID NO: 40925 - protein, 28 aa, Artificial Sequence
  Description of Artificial Sequence: Synthetic peptide
DEQNVNTANWVDNAELGRTATAISQATA

SEQ ID NO: 40926 - protein, 28 aa, Artificial Sequence
  Description of Artificial Sequence: Synthetic peptide
DDTGWAIGNNTSERNYGEVVTQILNTAN

SEQ ID NO: 40927 - protein, 28 aa, Artificial Sequence
  Description of Artificial Sequence: Synthetic peptide
DEEEVNTNNNIDLLRLGTTHDPVPGSGT

SEQ ID NO: 40928 - protein, 28 aa, Artificial Sequence
  Description of Artificial Sequence: Synthetic peptide
AEGGTDRNLQIDTSKYSGTSDNLQASAG

SEQ ID NO: 40929 - protein, 28 aa, Artificial Sequence
  Description of Artificial Sequence: Synthetic peptide
DEQEVTSTEIGDIGILGRNDDYIQNGTG

SEQ ID NO: 40930 - protein, 28 aa, Artificial Sequence
  Description of Artificial Sequence: Synthetic peptide
DGDSRITNNEVTTDNVEVTHEDNGAKNS

SEQ ID NO: 40931 - protein, 28 aa, Artificial Sequence
  Description of Artificial Sequence: Synthetic peptide
DWQNINFNLNATEDNVLLISDAIGGGIG

SEQ ID NO: 40932 - protein, 28 aa, Artificial Sequence
  Description of Artificial Sequence: Synthetic peptide
DEEERKTVSGLGFRNILGYSDQIGNQDE

SEQ ID NO: 40933 - protein, 28 aa, Artificial Sequence
  Description of Artificial Sequence: Synthetic peptide
DEREVNTNNPIDLLRIGTTHDPVPGSGT

SEQ ID NO: 40934 - protein, 28 aa, Artificial Sequence
  Description of Artificial Sequence: Synthetic peptide
NGEDQANTNNADIDILSGVRDNLLQYAT

SEQ ID NO: 40935 - protein, 28 aa, Artificial Sequence
  Description of Artificial Sequence: Synthetic peptide
DGQGINATNGYGWSILGGIRDNEQDRAT

SEQ ID NO: 40936 - protein, 28 aa, Artificial Sequence
  Description of Artificial Sequence: Synthetic peptide
DWQNINFNNPVTLDNVLLPTDPIGGKTG

SEQ ID NO: 40937 - protein, 28 aa, Artificial Sequence
  Description of Artificial Sequence: Synthetic peptide
DEQETDNNNNVDFLNYDLTTSHFGAGAT

SEQ ID NO: 40938 - protein, 28 aa, Artificial Sequence
  Description of Artificial Sequence: Synthetic peptide
DGIENAATRQTVNNRWGTVEDNHGGGAE

SEQ ID NO: 40939 - protein, 28 aa, Artificial Sequence
  Description of Artificial Sequence: Synthetic peptide
DEEGTNTNNNIDQRVLGGTRDQVQGKTT

SEQ ID NO: 40940 - protein, 28 aa, Artificial Sequence
  Description of Artificial Sequence: Synthetic peptide
DERNVNTNNPIDLLNVGTVHDPVPGKTT

SEQ ID NO: 40941 - protein, 28 aa, Artificial Sequence
  Description of Artificial Sequence: Synthetic peptide
DEIEGITNNSYIQDVLNYTVDNSLYKGD

SEQ ID NO: 40942 - protein, 28 aa, Artificial Sequence
  Description of Artificial Sequence: Synthetic peptide
DGRNITFVNDVDRDRQSGSDNNSIGSGT

SEQ ID NO: 40943 - protein, 28 aa, Artificial Sequence
  Description of Artificial Sequence: Synthetic peptide
DGEGNQNALQYANDIYGTIGTNAGTMST

SEQ ID NO: 40944 - protein, 28 aa, Artificial Sequence
  Description of Artificial Sequence: Synthetic peptide
DGAGENTANNYIIKTESGTVDQELNRTT

SEQ ID NO: 40945 - protein, 28 aa, Artificial Sequence
  Description of Artificial Sequence: Synthetic peptide
DGDTNADNNNVIQDIQYGLRDNALWVNE

SEQ ID NO: 40946 - protein, 28 aa, Artificial Sequence
  Description of Artificial Sequence: Synthetic peptide
DWQNINFNNPVTNDNVLLPTDPIGGKAG

SEQ ID NO: 40947 - protein, 28 aa, Artificial Sequence
  Description of Artificial Sequence: Synthetic peptide
DEQNVEFNNNITNDNQLLNTNDIGGKNN

SEQ ID NO: 40948 - protein, 28 aa, Artificial Sequence
  Description of Artificial Sequence: Synthetic peptide
DEEEVNTNNNIDLLRLGTTHDPVPGKGT

SEQ ID NO: 40949 - protein, 28 aa, Artificial Sequence
  Description of Artificial Sequence: Synthetic peptide
DSIEINQTNHSAQTNGGTLRDQITGTGT

SEQ ID NO: 40950 - protein, 28 aa, Artificial Sequence
  Description of Artificial Sequence: Synthetic peptide
DWGDINNTNNYTEDNLSEIRDDILGKAN

SEQ ID NO: 40951 - protein, 28 aa, Artificial Sequence
  Description of Artificial Sequence: Synthetic peptide
DGAEGNNTMRLNGDQIGLTTDNWYGLNT

SEQ ID NO: 40952 - protein, 28 aa, Artificial Sequence
  Description of Artificial Sequence: Synthetic peptide
DAENTAYESITGTHNLQTTASNLQGGST

SEQ ID NO: 40953 - protein, 28 aa, Artificial Sequence
  Description of Artificial Sequence: Synthetic peptide
DDGGIIAVRNVISEEQGGTEDDSQGSNT

SEQ ID NO: 40954 - protein, 28 aa, Artificial Sequence
  Description of Artificial Sequence: Synthetic peptide
DETSIQNTNIGNLNTQGHVHNSMGSSGT

SEQ ID NO: 40955 - protein, 28 aa, Artificial Sequence
  Description of Artificial Sequence: Synthetic peptide
DLDGIITTNALHIDNLQTISDRIDNGGD

SEQ ID NO: 40956 - protein, 28 aa, Artificial Sequence
  Description of Artificial Sequence: Synthetic peptide
DNGGISAGNTVTNDQWYGTRQQTGGSAG

SEQ ID NO: 40957 - protein, 28 aa, Artificial Sequence
  Description of Artificial Sequence: Synthetic peptide
DEREVNTNNPIDLLRLGTTHDPVPGSGT

SEQ ID NO: 40958 - protein, 28 aa, Artificial Sequence
  Description of Artificial Sequence: Synthetic peptide
DWQNINFNLPVTNDNVLLPTDPIGGKNG

SEQ ID NO: 40959 - protein, 28 aa, Artificial Sequence
  Description of Artificial Sequence: Synthetic peptide
DWQNISFNNIVTEDNVLLITDAISGATG

SEQ ID NO: 40960 - protein, 28 aa, Artificial Sequence
  Description of Artificial Sequence: Synthetic peptide
NEEEWAGTSIISFDVLGGTVDQNQFAQA

SEQ ID NO: 40961 - protein, 28 aa, Artificial Sequence
  Description of Artificial Sequence: Synthetic peptide
NSENIISTNKGDLDGVSMIMTNVLGTNE

SEQ ID NO: 40962 - protein, 28 aa, Artificial Sequence
  Description of Artificial Sequence: Synthetic peptide
DEAETAAVNNFAWEVLTTTADQMLNKTT

SEQ ID NO: 40963 - protein, 28 aa, Artificial Sequence
  Description of Artificial Sequence: Synthetic peptide
DAENNSTTNISRSHGISGLRDSIQSSNG

SEQ ID NO: 40964 - protein, 28 aa, Artificial Sequence
  Description of Artificial Sequence: Synthetic peptide
NEDNVITINGTHKTHWDLVSNNIQTSDG

SEQ ID NO: 40965 - protein, 28 aa, Artificial Sequence
  Description of Artificial Sequence: Synthetic peptide
DENIYANNNQYITDSSLKTNDQLERTAG

SEQ ID NO: 40966 - protein, 28 aa, Artificial Sequence
  Description of Artificial Sequence: Synthetic peptide
DEEGVNTNNNIDQRVLGGTRDQILNKTT

SEQ ID NO: 40967 - protein, 28 aa, Artificial Sequence
  Description of Artificial Sequence: Synthetic peptide
DEEGTNTNNNIDQRVLGGTRDQVQNKGT

SEQ ID NO: 40968 - protein, 28 aa, Artificial Sequence
  Description of Artificial Sequence: Synthetic peptide
DGRNVNTTNPIDLLNIGTVHDPIGGKTG

SEQ ID NO: 40969 - protein, 28 aa, Artificial Sequence
  Description of Artificial Sequence: Synthetic peptide
DEQGGNNVNNIFNRELGGTVDQALNSGD

SEQ ID NO: 40970 - protein, 28 aa, Artificial Sequence
  Description of Artificial Sequence: Synthetic peptide
KEIGVNFTNNTTNDSQYNWDDNLGGKGN

SEQ ID NO: 40971 - protein, 28 aa, Artificial Sequence
  Description of Artificial Sequence: Synthetic peptide
STENISITNDIDNLRWEATWTNSQNTGG

SEQ ID NO: 40972 - protein, 28 aa, Artificial Sequence
  Description of Artificial Sequence: Synthetic peptide
DETGRAIGNNVSNKISGGTADNMLNQRT

SEQ ID NO: 40973 - protein, 28 aa, Artificial Sequence
  Description of Artificial Sequence: Synthetic peptide
DEETIQNNNAITDRELRLTSQQATRSTT

SEQ ID NO: 40974 - protein, 28 aa, Artificial Sequence
  Description of Artificial Sequence: Synthetic peptide
DEREVNTNNPIDLLRWGTTHDPVPGSGT

SEQ ID NO: 40975 - protein, 28 aa, Artificial Sequence
  Description of Artificial Sequence: Synthetic peptide
DEEGVNTNNNIDQRVLGGTRDQVQGKTT

SEQ ID NO: 40976 - protein, 28 aa, Artificial Sequence
  Description of Artificial Sequence: Synthetic peptide
IESTIQGTNEITSDMVGLTNDNLGWSAT

SEQ ID NO: 40977 - protein, 28 aa, Artificial Sequence
  Description of Artificial Sequence: Synthetic peptide
DGDNIDNNNIIGEEIRGRDRTNNGWVQT

SEQ ID NO: 40978 - protein, 28 aa, Artificial Sequence
  Description of Artificial Sequence: Synthetic peptide
REDEVANNQITIDDALGTTKTNLLRRGT

SEQ ID NO: 40979 - protein, 28 aa, Artificial Sequence
  Description of Artificial Sequence: Synthetic peptide
DGDENNLNNGFILDQVGTTTENLIGSGA

SEQ ID NO: 40980 - protein, 28 aa, Artificial Sequence
  Description of Artificial Sequence: Synthetic peptide
DENEVNFTRNGTTRVWGGINQDFGDRAT

SEQ ID NO: 40981 - protein, 28 aa, Artificial Sequence
  Description of Artificial Sequence: Synthetic peptide
DEGNWATTNGFHNIVESETRNQMMGQAT

SEQ ID NO: 40982 - protein, 28 aa, Artificial Sequence
  Description of Artificial Sequence: Synthetic peptide
DEDDTELNLIGANEHTQLITTTNQGKNN

SEQ ID NO: 40983 - protein, 28 aa, Artificial Sequence
  Description of Artificial Sequence: Synthetic peptide
DSDGLQITNRVHTDNVTLTSDTLWASAN

SEQ ID NO: 40984 - protein, 28 aa, Artificial Sequence
  Description of Artificial Sequence: Synthetic peptide
DEEEVNTNNNIDLRRLGGTHDPVPGSGT

SEQ ID NO: 40985 - protein, 28 aa, Artificial Sequence
  Description of Artificial Sequence: Synthetic peptide
GEEGLITNNIIAIENQFEIDDNHDGKAT

SEQ ID NO: 40986 - protein, 28 aa, Artificial Sequence
  Description of Artificial Sequence: Synthetic peptide
DEQTAIDNNGTELEELLNTTDVLQQGTN

SEQ ID NO: 40987 - protein, 28 aa, Artificial Sequence
  Description of Artificial Sequence: Synthetic peptide
DEADTINQNNVNNLNEHLTSDSEGRRGG

SEQ ID NO: 40988 - protein, 28 aa, Artificial Sequence
  Description of Artificial Sequence: Synthetic peptide
DGEETTDANIVINRNRLATAENSLGVNE

SEQ ID NO: 40989 - protein, 28 aa, Artificial Sequence
  Description of Artificial Sequence: Synthetic peptide
DDGEVGTNNIYSAENQGNISDVVYDQTA

SEQ ID NO: 40990 - protein, 28 aa, Artificial Sequence
  Description of Artificial Sequence: Synthetic peptide
IEAEGQDTNQYIQSVQQGLRDQQQYQGN

SEQ ID NO: 40991 - protein, 28 aa, Artificial Sequence
  Description of Artificial Sequence: Synthetic peptide
DEENVNTNNPIDLLRLGTTHDPVGGKTT

SEQ ID NO: 40992 - protein, 28 aa, Artificial Sequence
  Description of Artificial Sequence: Synthetic peptide
SEDGWNDGNNFIWDGYGATVDQMLFRDN

SEQ ID NO: 40993 - protein, 28 aa, Artificial Sequence
  Description of Artificial Sequence: Synthetic peptide
SENEWGLTSGIDNSNYGQIDDYLTSKNS

SEQ ID NO: 40994 - protein, 28 aa, Artificial Sequence
  Description of Artificial Sequence: Synthetic peptide
DPQNINFNNPVTLDNVLLPSDPIGGKNG

SEQ ID NO: 40995 - protein, 28 aa, Artificial Sequence
  Description of Artificial Sequence: Synthetic peptide
DEGAGKTGNIYITKVLTGTADQAENRTT

SEQ ID NO: 40996 - protein, 28 aa, Artificial Sequence
  Description of Artificial Sequence: Synthetic peptide
DGQALEATNIVTTDRLGGVGSDVYSQHT

SEQ ID NO: 40997 - protein, 28 aa, Artificial Sequence
  Description of Artificial Sequence: Synthetic peptide
DSDDVIGTIRVTTAIQGGRSDVLLGKQT

SEQ ID NO: 40998 - protein, 28 aa, Artificial Sequence
  Description of Artificial Sequence: Synthetic peptide
DWSEINNANLVTFNQVTTTADKMYQNGD

SEQ ID NO: 40999 - protein, 28 aa, Artificial Sequence
  Description of Artificial Sequence: Synthetic peptide
DENGINNINIGDTSRVLGTQATIQSSAT

SEQ ID NO: 41000 - protein, 28 aa, Artificial Sequence
  Description of Artificial Sequence: Synthetic peptide
NEGGIQTHNNTFIRIQGVTRDQAQGTDT

SEQ ID NO: 41001 - protein, 28 aa, Artificial Sequence
  Description of Artificial Sequence: Synthetic peptide
DWQNINFNNPVTNDNVLLPTDPIGGKTG

SEQ ID NO: 41002 - protein, 28 aa, Artificial Sequence
  Description of Artificial Sequence: Synthetic peptide
DEIEGAQASIVIQDSLSLTTDQQQQRSD

SEQ ID NO: 41003 - protein, 28 aa, Artificial Sequence
  Description of Artificial Sequence: Synthetic peptide
DGENTNNTNPIDLLNIGTVHDPIGGKTG

SEQ ID NO: 41004 - protein, 28 aa, Artificial Sequence
  Description of Artificial Sequence: Synthetic peptide
DGENNDFANWVTTDNLGVTNDEYITTAG

SEQ ID NO: 41005 - protein, 28 aa, Artificial Sequence
  Description of Artificial Sequence: Synthetic peptide
DEIEEQDTNQYINDIVTGTRDNELYKVN

SEQ ID NO: 41006 - protein, 28 aa, Artificial Sequence
  Description of Artificial Sequence: Synthetic peptide
DEHEVDFNNIIKTDNWGENIDNIIGATN

SEQ ID NO: 41007 - protein, 28 aa, Artificial Sequence
  Description of Artificial Sequence: Synthetic peptide
DQEGGITVNGVDALNWLMTSTRWGNQGE

SEQ ID NO: 41008 - protein, 28 aa, Artificial Sequence
  Description of Artificial Sequence: Synthetic peptide
DWQNINFNLPVTEDNVLLPTDPIGGATG

SEQ ID NO: 41009 - protein, 28 aa, Artificial Sequence
  Description of Artificial Sequence: Synthetic peptide
DEQNINFNLPVTNDNVLLPTDPIGGKTG

SEQ ID NO: 41010 - protein, 28 aa, Artificial Sequence
  Description of Artificial Sequence: Synthetic peptide
DEAGWQTGHNFITRIEGKTVNQAGYKTT

SEQ ID NO: 41011 - protein, 28 aa, Artificial Sequence
  Description of Artificial Sequence: Synthetic peptide
DGRNPNTNNPIDLLNIGTVHDPVGGKTT

SEQ ID NO: 41012 - protein, 28 aa, Artificial Sequence
  Description of Artificial Sequence: Synthetic peptide
DDSIINTNSGIGTLRYDLTDDTDDNGST

SEQ ID NO: 41013 - protein, 28 aa, Artificial Sequence
  Description of Artificial Sequence: Synthetic peptide
DWQNIEFTNIGTTDNLLLISDIAGGKAN

SEQ ID NO: 41014 - protein, 28 aa, Artificial Sequence
  Description of Artificial Sequence: Synthetic peptide
DEENVNTNNNIDLDNLGGTHDPIGGKTT

SEQ ID NO: 41015 - protein, 28 aa, Artificial Sequence
  Description of Artificial Sequence: Synthetic peptide
QDEHGAEANSTINDNYGTISDNIYNKGT

SEQ ID NO: 41016 - protein, 28 aa, Artificial Sequence
  Description of Artificial Sequence: Synthetic peptide
DEENVNTNNNIDLDNLGTTHDPVGGKTT

SEQ ID NO: 41017 - protein, 28 aa, Artificial Sequence
  Description of Artificial Sequence: Synthetic peptide
DEEGVNTNNNIDLLRLGGTHDPVPGKTT

SEQ ID NO: 41018 - protein, 28 aa, Artificial Sequence
  Description of Artificial Sequence: Synthetic peptide
NGQEILTNSNTANSTLGTTHNYAGRSDT

SEQ ID NO: 41019 - protein, 28 aa, Artificial Sequence
  Description of Artificial Sequence: Synthetic peptide
DGGSYEQTLNGDFSRLGTVKNNTQESGT

SEQ ID NO: 41020 - protein, 28 aa, Artificial Sequence
  Description of Artificial Sequence: Synthetic peptide
NDEGIITNVNIFTDNLDLFNTYTLQTSG

SEQ ID NO: 41021 - protein, 28 aa, Artificial Sequence
  Description of Artificial Sequence: Synthetic peptide
DEEGVNTNNNIDLDNLGGTHDPIGGKTT

SEQ ID NO: 41022 - protein, 28 aa, Artificial Sequence
  Description of Artificial Sequence: Synthetic peptide
DEGGGANANGYGQSIQTGTRDQELWRTT

SEQ ID NO: 41023 - protein, 28 aa, Artificial Sequence
  Description of Artificial Sequence: Synthetic peptide
EEEGWPQTSPTHFEHELNLHTPVPGKGD

SEQ ID NO: 41024 - protein, 28 aa, Artificial Sequence
  Description of Artificial Sequence: Synthetic peptide
EEQAITFNNGIQNASYSGISDQTLGKTT

SEQ ID NO: 41025 - protein, 28 aa, Artificial Sequence
  Description of Artificial Sequence: Synthetic peptide
DGSEINNTHGIHENDLYGLHNNTGSAGL

SEQ ID NO: 41026 - protein, 28 aa, Artificial Sequence
  Description of Artificial Sequence: Synthetic peptide
DGRNVNTNNPIDLLNIGTVHDPVGGKTT

SEQ ID NO: 41027 - protein, 28 aa, Artificial Sequence
  Description of Artificial Sequence: Synthetic peptide
NEGLISGVSGVDQSIYGLTDDNIGNQAG

SEQ ID NO: 41028 - protein, 28 aa, Artificial Sequence
  Description of Artificial Sequence: Synthetic peptide
DWNNINFNLNVTNDNVLLITDAIGGGNG

SEQ ID NO: 41029 - protein, 28 aa, Artificial Sequence
  Description of Artificial Sequence: Synthetic peptide
EEATVGAAHIVHSEILGATVDNLLSTGT

SEQ ID NO: 41030 - protein, 28 aa, Artificial Sequence
  Description of Artificial Sequence: Synthetic peptide
DGGEEDINNNTSIREQTKVRDQMLYYDT

SEQ ID NO: 41031 - protein, 28 aa, Artificial Sequence
  Description of Artificial Sequence: Synthetic peptide
DWQNINFNNIVTDDNVLLITDAIGGKSG

SEQ ID NO: 41032 - protein, 28 aa, Artificial Sequence
  Description of Artificial Sequence: Synthetic peptide
DEAGTQNNNNFIQSIQSEITDQHLNLAN

SEQ ID NO: 41033 - protein, 28 aa, Artificial Sequence
  Description of Artificial Sequence: Synthetic peptide
DWQNLNFNNPVTNDNVLLPTDPIGGKTG

SEQ ID NO: 41034 - protein, 28 aa, Artificial Sequence
  Description of Artificial Sequence: Synthetic peptide
SGQGWSCGNGTFQSTYGVVSSQNQATAN

SEQ ID NO: 41035 - protein, 28 aa, Artificial Sequence
  Description of Artificial Sequence: Synthetic peptide
DSDTISNTLIMVNESLLNTNDGIGSGND

SEQ ID NO: 41036 - protein, 28 aa, Artificial Sequence
  Description of Artificial Sequence: Synthetic peptide
DGIDRQNDNIFITSVSTGTDDQVLYRHN

SEQ ID NO: 41037 - protein, 28 aa, Artificial Sequence
  Description of Artificial Sequence: Synthetic peptide
DWQNINFNLPVTEDNVLLPEDPIYGATG

SEQ ID NO: 41038 - protein, 28 aa, Artificial Sequence
  Description of Artificial Sequence: Synthetic peptide
NENGTGTGHSVHWEVLGGTRTASETLTT

SEQ ID NO: 41039 - protein, 28 aa, Artificial Sequence
  Description of Artificial Sequence: Synthetic peptide
DWQNINNNNNVTNDNVLLPTDPIGGKAN

SEQ ID NO: 41040 - protein, 28 aa, Artificial Sequence
  Description of Artificial Sequence: Synthetic peptide
DGGGIQSTNGFFQSSLSGTTDIAQYATT

SEQ ID NO: 41041 - protein, 28 aa, Artificial Sequence
  Description of Artificial Sequence: Synthetic peptide
DERSTNGTNIYGNDIGDENTTQAQQSGT

SEQ ID NO: 41042 - protein, 28 aa, Artificial Sequence
  Description of Artificial Sequence: Synthetic peptide
EEEGWPQTSPTHFEGELNLHTPIPGKGD

SEQ ID NO: 41043 - protein, 28 aa, Artificial Sequence
  Description of Artificial Sequence: Synthetic peptide
DQQEINANNIYTNDNSGRTHENTGGKGS

SEQ ID NO: 41044 - protein, 28 aa, Artificial Sequence
  Description of Artificial Sequence: Synthetic peptide
DEENVNTNNNIDLLRLGTTHDPVGGKTT

SEQ ID NO: 41045 - protein, 28 aa, Artificial Sequence
  Description of Artificial Sequence: Synthetic peptide
NWNEQNNQEIVGTDNQTLYSTQYQGSTT

SEQ ID NO: 41046 - protein, 28 aa, Artificial Sequence
  Description of Artificial Sequence: Synthetic peptide
DWRNTDTENLTEDRHWSGTKTELLSTTT

SEQ ID NO: 41047 - protein, 28 aa, Artificial Sequence
  Description of Artificial Sequence: Synthetic peptide
EGIEGSAGNIYHQQVQSGLGTNAQARAT

SEQ ID NO: 41048 - protein, 28 aa, Artificial Sequence
  Description of Artificial Sequence: Synthetic peptide
DEQMLIQNNITALLIGTNTKTNQLEAAT

SEQ ID NO: 41049 - protein, 28 aa, Artificial Sequence
  Description of Artificial Sequence: Synthetic peptide
DERGLSTNNRGINDECLGIGQRVGNQAG

SEQ ID NO: 41050 - protein, 28 aa, Artificial Sequence
  Description of Artificial Sequence: Synthetic peptide
DEEGTNTNNNIDLRRLGGTHDPVPGKGT

SEQ ID NO: 41051 - protein, 28 aa, Artificial Sequence
  Description of Artificial Sequence: Synthetic peptide
VEDNINNQNDITREMLSRVGDDQAGTDG

SEQ ID NO: 41052 - protein, 28 aa, Artificial Sequence
  Description of Artificial Sequence: Synthetic peptide
DEDGANNNNNYTNRVVSLITDQIGGGAE

SEQ ID NO: 41053 - protein, 28 aa, Artificial Sequence
  Description of Artificial Sequence: Synthetic peptide
DGIEWNNVSNIRQNGLTETRTQVLNKNT

SEQ ID NO: 41054 - protein, 28 aa, Artificial Sequence
  Description of Artificial Sequence: Synthetic peptide
DEGGTIDANNTKIRILSETTNQAANGAN

SEQ ID NO: 41055 - protein, 28 aa, Artificial Sequence
  Description of Artificial Sequence: Synthetic peptide
DGSGAIFNNTVFNDMTGGTNANIQGRTD

SEQ ID NO: 41056 - protein, 28 aa, Artificial Sequence
  Description of Artificial Sequence: Synthetic peptide
DGIGNEDGNNFIHRIQTGDSDQMLSKGN

SEQ ID NO: 41057 - protein, 28 aa, Artificial Sequence
  Description of Artificial Sequence: Synthetic peptide
EEEGTPTTSPTHFDHILNLHTPIPGKGD

SEQ ID NO: 41058 - protein, 28 aa, Artificial Sequence
  Description of Artificial Sequence: Synthetic peptide
NGLDLIETLQGTADIGYLATEAFRNGNG

SEQ ID NO: 41059 - protein, 28 aa, Artificial Sequence
  Description of Artificial Sequence: Synthetic peptide
DWNTRALTNDIHNENIQEYDTQWLGKAN

SEQ ID NO: 41060 - protein, 28 aa, Artificial Sequence
  Description of Artificial Sequence: Synthetic peptide
DWQEINFNLRFTEDNVLLPEDPIYGATG

SEQ ID NO: 41061 - protein, 28 aa, Artificial Sequence
  Description of Artificial Sequence: Synthetic peptide
TELGAVNNNIVNTERWSLIRDQNANSNA

SEQ ID NO: 41062 - protein, 28 aa, Artificial Sequence
  Description of Artificial Sequence: Synthetic peptide
DEGGGITANNFFESNLTQTRFQEENKAT

SEQ ID NO: 41063 - protein, 28 aa, Artificial Sequence
  Description of Artificial Sequence: Synthetic peptide
DGLGFTNVNIVDREIWGGTKDQTLAAND

SEQ ID NO: 41064 - protein, 28 aa, Artificial Sequence
  Description of Artificial Sequence: Synthetic peptide
DWQEINFNLRVTEDNVLLPEDPDYGATG

SEQ ID NO: 41065 - protein, 28 aa, Artificial Sequence
  Description of Artificial Sequence: Synthetic peptide
DWQNIEFNNIVTDDNVLAITDAIGGGAG

SEQ ID NO: 41066 - protein, 28 aa, Artificial Sequence
  Description of Artificial Sequence: Synthetic peptide
EGIEENANNNTINETYGGTADQTQHAAN

SEQ ID NO: 41067 - protein, 28 aa, Artificial Sequence
  Description of Artificial Sequence: Synthetic peptide
DWQEINFNLRFTEDNVLLPEDPDYGATG

SEQ ID NO: 41068 - protein, 28 aa, Artificial Sequence
  Description of Artificial Sequence: Synthetic peptide
DERNPNTNNPIDLLRIGTTHDPVPGSGT

SEQ ID NO: 41069 - protein, 28 aa, Artificial Sequence
  Description of Artificial Sequence: Synthetic peptide
SGSNGVTTNGVDADIILGVIDQIGGASN

SEQ ID NO: 41070 - protein, 28 aa, Artificial Sequence
  Description of Artificial Sequence: Synthetic peptide
DWNGINQNSNTANDEQGIMHNGIGGTST

SEQ ID NO: 41071 - protein, 28 aa, Artificial Sequence
  Description of Artificial Sequence: Synthetic peptide
QECECVCTNFCCVYHCGFADEVDYGFGN

SEQ ID NO: 41072 - protein, 28 aa, Artificial Sequence
  Description of Artificial Sequence: Synthetic peptide
VGEGTSTNLIVTDSAYLNVTDQEGLSDT

SEQ ID NO: 41073 - protein, 28 aa, Artificial Sequence
  Description of Artificial Sequence: Synthetic peptide
DWQNINFNLPVTNDNVLLPTDPIGGKAG

SEQ ID NO: 41074 - protein, 28 aa, Artificial Sequence
  Description of Artificial Sequence: Synthetic peptide
DARSDSTNLNYDNEISGLVADNIAGKQE

SEQ ID NO: 41075 - protein, 28 aa, Artificial Sequence
  Description of Artificial Sequence: Synthetic peptide
EEEGWPQTSPTHFEGELNLHTPIEGKGD

SEQ ID NO: 41076 - protein, 28 aa, Artificial Sequence
  Description of Artificial Sequence: Synthetic peptide
SGEDTIFNNNVDQRETDQRHDNLGGNTN

SEQ ID NO: 41077 - protein, 28 aa, Artificial Sequence
  Description of Artificial Sequence: Synthetic peptide
NIDEITNVNSGDTSGVSATRTRLLTKTD

SEQ ID NO: 41078 - protein, 28 aa, Artificial Sequence
  Description of Artificial Sequence: Synthetic peptide
DERGVITVHQVTADMETNTSLNIGTSTG

SEQ ID NO: 41079 - protein, 28 aa, Artificial Sequence
  Description of Artificial Sequence: Synthetic peptide
DGLNFNFNNIVTEDNVLLITDAIGGKTG

SEQ ID NO: 41080 - protein, 28 aa, Artificial Sequence
  Description of Artificial Sequence: Synthetic peptide
DWQNINFNLPVTNDNVLLPTDPIYGATG

SEQ ID NO: 41081 - protein, 28 aa, Artificial Sequence
  Description of Artificial Sequence: Synthetic peptide
DPQNLNFNNPVTLDNVLLPTDPIGGKTG

SEQ ID NO: 41082 - protein, 28 aa, Artificial Sequence
  Description of Artificial Sequence: Synthetic peptide
DGGTTNTNNIGALTNHTMVSNSMGYATN

SEQ ID NO: 41083 - protein, 28 aa, Artificial Sequence
  Description of Artificial Sequence: Synthetic peptide
DGENINNNNQIEFTTEDTVHDYLGASTN

SEQ ID NO: 41084 - protein, 28 aa, Artificial Sequence
  Description of Artificial Sequence: Synthetic peptide
NEENVAFVKIMAEDVWGTKETQLGNSGT

SEQ ID NO: 41085 - protein, 28 aa, Artificial Sequence
  Description of Artificial Sequence: Synthetic peptide
DEQALVTDDNISNETFGLTNNQIQAATG

SEQ ID NO: 41086 - protein, 28 aa, Artificial Sequence
  Description of Artificial Sequence: Synthetic peptide
DEIGIQDNNIFRQRVLGETTDQAQHAST

SEQ ID NO: 41087 - protein, 28 aa, Artificial Sequence
  Description of Artificial Sequence: Synthetic peptide
DWQNINFNLPVTNDNVLLPTDPIGGKTG

SEQ ID NO: 41088 - protein, 28 aa, Artificial Sequence
  Description of Artificial Sequence: Synthetic peptide
DGAEEQNNNGFRGRVGTMITDQDLQLTN

SEQ ID NO: 41089 - protein, 28 aa, Artificial Sequence
  Description of Artificial Sequence: Synthetic peptide
DDLINNDGNGVDNLVVGVTRTEISNLNS

SEQ ID NO: 41090 - protein, 28 aa, Artificial Sequence
  Description of Artificial Sequence: Synthetic peptide
DEIEGQDGSGVRQRVYTTTRDQALYTTN

SEQ ID NO: 41091 - protein, 28 aa, Artificial Sequence
  Description of Artificial Sequence: Synthetic peptide
DGQEGTFANIMNFEQLTNTDFNIDSSTS

SEQ ID NO: 41092 - protein, 28 aa, Artificial Sequence
  Description of Artificial Sequence: Synthetic peptide
DWQNINFNLRFTEDNVLLPTDPIYGATG

SEQ ID NO: 41093 - protein, 28 aa, Artificial Sequence
  Description of Artificial Sequence: Synthetic peptide
DGRNVNTNNPIDLLNVGTVHDPVGGKTT

SEQ ID NO: 41094 - protein, 28 aa, Artificial Sequence
  Description of Artificial Sequence: Synthetic peptide
DIENTDDNNNVHNDVYSNMTDAELYKTT

SEQ ID NO: 41095 - protein, 28 aa, Artificial Sequence
  Description of Artificial Sequence: Synthetic peptide
EEEGWPTTSPTHFLHILNLHTPVPGKGD

SEQ ID NO: 41096 - protein, 28 aa, Artificial Sequence
  Description of Artificial Sequence: Synthetic peptide
EEIEINTVNNTGNIIQSETRDQSLHTAT

SEQ ID NO: 41097 - protein, 28 aa, Artificial Sequence
  Description of Artificial Sequence: Synthetic peptide
DWQNINFNNNVTNDNVLLPTDPIGGKAG

SEQ ID NO: 41098 - protein, 28 aa, Artificial Sequence
  Description of Artificial Sequence: Synthetic peptide
RDEIIDTNDNFATDAWDGIDDQVYYANT

SEQ ID NO: 41099 - protein, 28 aa, Artificial Sequence
  Description of Artificial Sequence: Synthetic peptide
FDEEGNTNNWSDQDVTITTRDRLQCKAT

SEQ ID NO: 41100 - protein, 28 aa, Artificial Sequence
  Description of Artificial Sequence: Synthetic peptide
DGDGVINTNNFGESHQQMTRDQMLARAT

SEQ ID NO: 41101 - protein, 28 aa, Artificial Sequence
  Description of Artificial Sequence: Synthetic peptide
DEDEINNNSASIYRMYTGIMDNEENRTT

SEQ ID NO: 41102 - protein, 28 aa, Artificial Sequence
  Description of Artificial Sequence: Synthetic peptide
DGDENRNTIIYGQDEYTTIRDNHASSAA

SEQ ID NO: 41103 - protein, 28 aa, Artificial Sequence
  Description of Artificial Sequence: Synthetic peptide
DEENLNNDTIIHTDIVSTLKTRVQGAQD

SEQ ID NO: 41104 - protein, 28 aa, Artificial Sequence
  Description of Artificial Sequence: Synthetic peptide
DWQNLNFNNIVTLDQVGLISDIIGTASG

SEQ ID NO: 41105 - protein, 28 aa, Artificial Sequence
  Description of Artificial Sequence: Synthetic peptide
DGGGLEQQNNVSTDNVTSTRDKCLWTAN

SEQ ID NO: 41106 - protein, 28 aa, Artificial Sequence
  Description of Artificial Sequence: Synthetic peptide
DGRNVNTNNPIDLLNVGTVHDPVGGKTG

SEQ ID NO: 41107 - protein, 28 aa, Artificial Sequence
  Description of Artificial Sequence: Synthetic peptide
DWQNINFTNSVTNDNVLLIDDIIGGKAQ

SEQ ID NO: 41108 - protein, 28 aa, Artificial Sequence
  Description of Artificial Sequence: Synthetic peptide
DEDTTNLNNDGKLDRVDTRADTLRGKSG

SEQ ID NO: 41109 - protein, 28 aa, Artificial Sequence
  Description of Artificial Sequence: Synthetic peptide
DGSEVQNVLSVTLDNISNVNDQTINKTN

SEQ ID NO: 41110 - protein, 28 aa, Artificial Sequence
  Description of Artificial Sequence: Synthetic peptide
DWQNINFNLLFTEDNVLLPTDPIYGATG

SEQ ID NO: 41111 - protein, 28 aa, Artificial Sequence
  Description of Artificial Sequence: Synthetic peptide
SDENLNTGNHGIRDGISTLHNTLQGLAN

SEQ ID NO: 41112 - protein, 28 aa, Artificial Sequence
  Description of Artificial Sequence: Synthetic peptide
DWQNINFNNIVTNDNTLLIDDISGGKNN

SEQ ID NO: 41113 - protein, 28 aa, Artificial Sequence
  Description of Artificial Sequence: Synthetic peptide
EEEGTPTTSPTDFLHILNLHTPVPGKGD

SEQ ID NO: 41114 - protein, 28 aa, Artificial Sequence
  Description of Artificial Sequence: Synthetic peptide
DWQNINFNLPVTNDNVLLPTDPIGGATG

SEQ ID NO: 41115 - protein, 28 aa, Artificial Sequence
  Description of Artificial Sequence: Synthetic peptide
DWQNIDDNAIITNDNVSLIATVIGTKNQ

SEQ ID NO: 41116 - protein, 28 aa, Artificial Sequence
  Description of Artificial Sequence: Synthetic peptide
DGRNPNTNNPIDLLNVGTVHDPVPGKTT

SEQ ID NO: 41117 - protein, 28 aa, Artificial Sequence
  Description of Artificial Sequence: Synthetic peptide
DWSNINFNNIGTNDNVLLRTDILGSGAG

SEQ ID NO: 41118 - protein, 28 aa, Artificial Sequence
  Description of Artificial Sequence: Synthetic peptide
DWQNINNNLPVTNDNVLLPTDPIGGKTG

SEQ ID NO: 41119 - protein, 28 aa, Artificial Sequence
  Description of Artificial Sequence: Synthetic peptide
DGRNPNTNNPIDLLNVGTVHDPVGGKTT

SEQ ID NO: 41120 - protein, 28 aa, Artificial Sequence
  Description of Artificial Sequence: Synthetic peptide
DEEGVDLNLARDRDRIGLRGDNTQWLSN

SEQ ID NO: 41121 - protein, 28 aa, Artificial Sequence
  Description of Artificial Sequence: Synthetic peptide
DWQNLNFNNIVTDDNVLLITDIIGGGNG

SEQ ID NO: 41122 - protein, 28 aa, Artificial Sequence
  Description of Artificial Sequence: Synthetic peptide
DWQNINFNLLVTEDNVLLPTDPIYGATG

SEQ ID NO: 41123 - protein, 28 aa, Artificial Sequence
  Description of Artificial Sequence: Synthetic peptide
EEEGWPTTSPTHFLHELNLHTPVPGKGD

SEQ ID NO: 41124 - protein, 28 aa, Artificial Sequence
  Description of Artificial Sequence: Synthetic peptide
FEEGVETLHGYHIEVIGETADQITNTTT

SEQ ID NO: 41125 - protein, 28 aa, Artificial Sequence
  Description of Artificial Sequence: Synthetic peptide
NELNLNINNAATQREYGQGADNSSGSAG

SEQ ID NO: 41126 - protein, 28 aa, Artificial Sequence
  Description of Artificial Sequence: Synthetic peptide
DPQNLNNNNPVTLDNVLLPTDPIGGKTG

SEQ ID NO: 41127 - protein, 28 aa, Artificial Sequence
  Description of Artificial Sequence: Synthetic peptide
NEDAGETANSVMIEEWSATADRVGYGAT

SEQ ID NO: 41128 - protein, 28 aa, Artificial Sequence
  Description of Artificial Sequence: Synthetic peptide
DGRNVNTNNPIDLLNIGTVHDPVGGKTG

SEQ ID NO: 41129 - protein, 28 aa, Artificial Sequence
  Description of Artificial Sequence: Synthetic peptide
DWNNINFNNIVTEDNVLLIDDIIGGKSG

SEQ ID NO: 41130 - protein, 28 aa, Artificial Sequence
  Description of Artificial Sequence: Synthetic peptide
DEGGEANGNGFGIEILTGTVDIEQYSAT

SEQ ID NO: 41131 - protein, 28 aa, Artificial Sequence
  Description of Artificial Sequence: Synthetic peptide
AEGEISNDNEIITDVVSLLAQQVQNSTT

SEQ ID NO: 41132 - protein, 28 aa, Artificial Sequence
  Description of Artificial Sequence: Synthetic peptide
RWENGITDNIVHREGWLRTSDRIGTAGD

SEQ ID NO: 41133 - protein, 28 aa, Artificial Sequence
  Description of Artificial Sequence: Synthetic peptide
DWQNLNFNNPVTLDNVLLPTDPIGGKTG

SEQ ID NO: 41134 - protein, 28 aa, Artificial Sequence
  Description of Artificial Sequence: Synthetic peptide
DEEGVNTNNNIDLRRLGGTHDPVGGKTT

SEQ ID NO: 41135 - protein, 28 aa, Artificial Sequence
  Description of Artificial Sequence: Synthetic peptide
DMESIGIHNNIDQDRITIVHDQIQGSTT

SEQ ID NO: 41136 - protein, 28 aa, Artificial Sequence
  Description of Artificial Sequence: Synthetic peptide
DEDGGAIHNGYGSRVISGTRDNTQYQTN

SEQ ID NO: 41137 - protein, 28 aa, Artificial Sequence
  Description of Artificial Sequence: Synthetic peptide
SEANISSSMNVHTDIYGLWRDGIGSRTD

SEQ ID NO: 41138 - protein, 28 aa, Artificial Sequence
  Description of Artificial Sequence: Synthetic peptide
DIQNTNFNNIVTEDNVLLITDIIGGKTG

SEQ ID NO: 41139 - protein, 28 aa, Artificial Sequence
  Description of Artificial Sequence: Synthetic peptide
DGGNIENNNNGTTDNLTGDTDIIGGANN

SEQ ID NO: 41140 - protein, 28 aa, Artificial Sequence
  Description of Artificial Sequence: Synthetic peptide
DEGEVNDNNGFGIKILTGTADQEQRRTT

SEQ ID NO: 41141 - protein, 28 aa, Artificial Sequence
  Description of Artificial Sequence: Synthetic peptide
DEQTGMNNNAFENRVLVGMRDNEQYRST

SEQ ID NO: 41142 - protein, 28 aa, Artificial Sequence
  Description of Artificial Sequence: Synthetic peptide
DDGHANQNLAVNDLQYGHTTDQWAGKGG

SEQ ID NO: 41143 - protein, 28 aa, Artificial Sequence
  Description of Artificial Sequence: Synthetic peptide
DEQDVEANDIFVWDRGGGRSDRLQYSTG

SEQ ID NO: 41144 - protein, 28 aa, Artificial Sequence
  Description of Artificial Sequence: Synthetic peptide
EGEELNNLNITKTLTLNHVNDGIANRAT

SEQ ID NO: 41145 - protein, 28 aa, Artificial Sequence
  Description of Artificial Sequence: Synthetic peptide
IEEETNNGNIFDETDLGLYATQFGSKAS

SEQ ID NO: 41146 - protein, 28 aa, Artificial Sequence
  Description of Artificial Sequence: Synthetic peptide
DEDGGDTVSTTRQDIIGGTDSQVQNSAN

SEQ ID NO: 41147 - protein, 28 aa, Artificial Sequence
  Description of Artificial Sequence: Synthetic peptide
DEAEWIDGHINFNSTQTTTRDDLEWRTT

SEQ ID NO: 41148 - protein, 28 aa, Artificial Sequence
  Description of Artificial Sequence: Synthetic peptide
DWQNINFNLRVTEDNVLLPTDPIYGATG

SEQ ID NO: 41149 - protein, 28 aa, Artificial Sequence
  Description of Artificial Sequence: Synthetic peptide
EEEGWPQTSPTHFEHELNLHTPIPGKGD

SEQ ID NO: 41150 - protein, 28 aa, Artificial Sequence
  Description of Artificial Sequence: Synthetic peptide
DGQNTEFNVIVTNDNVLLITDSLGGGNG

SEQ ID NO: 41151 - protein, 28 aa, Artificial Sequence
  Description of Artificial Sequence: Synthetic peptide
DGAEGNQGNGIAGDVLSGNATAALARTD

SEQ ID NO: 41152 - protein, 28 aa, Artificial Sequence
  Description of Artificial Sequence: Synthetic peptide
DWGQINNGNIGNTENVLFKADQNGGTGG

SEQ ID NO: 41153 - protein, 28 aa, Artificial Sequence
  Description of Artificial Sequence: Synthetic peptide
EENSLQTNNGIRNDGWTSTDDAEQCSTT

SEQ ID NO: 41154 - protein, 28 aa, Artificial Sequence
  Description of Artificial Sequence: Synthetic peptide
DDGQGNYNENATLDVLGTVVSNIGYSDQ

SEQ ID NO: 41155 - protein, 36 aa, Artificial Sequence
  Description of Artificial Sequence: Synthetic polypeptide
DENEIRTTNPVSYEALWGHSYSEIHDAMMIVEDLDS

SEQ ID NO: 41156 - protein, 28 aa, Artificial Sequence
  Description of Artificial Sequence: Synthetic peptide
DEDEGNQHNNIFKDAQTGLRFDALYLTT

SEQ ID NO: 41157 - protein, 28 aa, Artificial Sequence
  Description of Artificial Sequence: Synthetic peptide
DEQMTGTVNNIDELNWWLTADAVQQANG

SEQ ID NO: 41158 - protein, 28 aa, Artificial Sequence
  Description of Artificial Sequence: Synthetic peptide
DGGATNTQNIIFNRVQSGTDDQAQYQST

SEQ ID NO: 41159 - protein, 28 aa, Artificial Sequence
  Description of Artificial Sequence: Synthetic peptide
DIGNNINENILTSDSWLTVDTNIYYTAN

SEQ ID NO: 41160 - protein, 28 aa, Artificial Sequence
  Description of Artificial Sequence: Synthetic peptide
NERNINEIHGITNDNGGGTHTSVGTATG

SEQ ID NO: 41161 - protein, 28 aa, Artificial Sequence
  Description of Artificial Sequence: Synthetic peptide
DIQSIEFNNIGTNDNVLLIDDALYGKNG

SEQ ID NO: 41162 - protein, 28 aa, Artificial Sequence
  Description of Artificial Sequence: Synthetic peptide
DGNEVSINNGAKMRGVGGLASQQEGGST

SEQ ID NO: 41163 - protein, 28 aa, Artificial Sequence
  Description of Artificial Sequence: Synthetic peptide
NQDGGSIVSNYFTEVFGGTRDQAQNQTT

SEQ ID NO: 41164 - protein, 28 aa, Artificial Sequence
  Description of Artificial Sequence: Synthetic peptide
DGQNIINTQIIEEKNVLGTSDVIQNSGG

SEQ ID NO: 41165 - protein, 28 aa, Artificial Sequence
  Description of Artificial Sequence: Synthetic peptide
EEQNWITLSGAHNDGELLITTTLGGKDT

SEQ ID NO: 41166 - protein, 28 aa, Artificial Sequence
  Description of Artificial Sequence: Synthetic peptide
DWQNINFNLITTNDNVLLRDDILYQGTG

SEQ ID NO: 41167 - protein, 28 aa, Artificial Sequence
  Description of Artificial Sequence: Synthetic peptide
EGIEEDTNNGYGIRVETMTTDQALYRTN

SEQ ID NO: 41168 - protein, 28 aa, Artificial Sequence
  Description of Artificial Sequence: Synthetic peptide
DWQNIDFNNIGTNDNVLLISDILGGAAT

SEQ ID NO: 41169 - protein, 28 aa, Artificial Sequence
  Description of Artificial Sequence: Synthetic peptide
DQAETDINNGAANDMQTTDENNIRSQTT

SEQ ID NO: 41170 - protein, 28 aa, Artificial Sequence
  Description of Artificial Sequence: Synthetic peptide
DGQGINAGNNFFWDVQGGTQDQMQHSTN

SEQ ID NO: 41171 - protein, 28 aa, Artificial Sequence
  Description of Artificial Sequence: Synthetic peptide
DGRNPNTNNPIDLLNVGTTHDPVPGSGT

SEQ ID NO: 41172 - protein, 28 aa, Artificial Sequence
  Description of Artificial Sequence: Synthetic peptide
EEIELNQVNNFGRDVQGGTGDQILNKAD

SEQ ID NO: 41173 - protein, 28 aa, Artificial Sequence
  Description of Artificial Sequence: Synthetic peptide
DIQNLTFNNNVTLDNVLANSDILGGKAG

SEQ ID NO: 41174 - protein, 28 aa, Artificial Sequence
  Description of Artificial Sequence: Synthetic peptide
DGLNINFNLNVTQENVLGIDDQIGGAGQ

SEQ ID NO: 41175 - protein, 28 aa, Artificial Sequence
  Description of Artificial Sequence: Synthetic peptide
DTDETIENLIIKINNSGITTTNQGASSN

SEQ ID NO: 41176 - protein, 28 aa, Artificial Sequence
  Description of Artificial Sequence: Synthetic peptide
DWQNINFNLLTTDDNVLLRTDIIYGATG

SEQ ID NO: 41177 - protein, 28 aa, Artificial Sequence
  Description of Artificial Sequence: Synthetic peptide
DWQNINFNLLTTEDNVLLIDDIIYGATG

SEQ ID NO: 41178 - protein, 28 aa, Artificial Sequence
  Description of Artificial Sequence: Synthetic peptide
DWQNINFNLIVTDDNVLLRDDIIYGANG

SEQ ID NO: 41179 - protein, 28 aa, Artificial Sequence
  Description of Artificial Sequence: Synthetic peptide
DWNNINFNSIGTNNNVLLRDDILGGGAG

SEQ ID NO: 41180 - protein, 28 aa, Artificial Sequence
  Description of Artificial Sequence: Synthetic peptide
DEIGVATQNNFFIDVETMTEDQSLYRAT

SEQ ID NO: 41181 - protein, 37 aa, Artificial Sequence
  Description of Artificial Sequence: Synthetic polypeptide
CEEEIRTTNCEGSEVYGVVTDLMAPGLQLPWLLTELT

SEQ ID NO: 41182 - protein, 28 aa, Artificial Sequence
  Description of Artificial Sequence: Synthetic peptide
DWQNINFNLIVTEDNVLLRDDIIGGATG

SEQ ID NO: 41183 - protein, 28 aa, Artificial Sequence
  Description of Artificial Sequence: Synthetic peptide
DQLSTNETSGVTNDHLLGVAFQIGGLNG

SEQ ID NO: 41184 - protein, 28 aa, Artificial Sequence
  Description of Artificial Sequence: Synthetic peptide
DWANTIFNNNVTNDNVLLITDASGNKAG

SEQ ID NO: 41185 - protein, 28 aa, Artificial Sequence
  Description of Artificial Sequence: Synthetic peptide
DEGTWQNTSGFSKIVYGGLRDDHEWKTL

SEQ ID NO: 41186 - protein, 28 aa, Artificial Sequence
  Description of Artificial Sequence: Synthetic peptide
DDQGVITINLYDNAIQGTTTDQLIWTST

SEQ ID NO: 41187 - protein, 28 aa, Artificial Sequence
  Description of Artificial Sequence: Synthetic peptide
EEQGWPQTSPTHFEGELNLHTPIGGKGD

SEQ ID NO: 41188 - protein, 28 aa, Artificial Sequence
  Description of Artificial Sequence: Synthetic peptide
DGDELANNNNFFRSILGGTDDQNLAKTT

SEQ ID NO: 41189 - protein, 28 aa, Artificial Sequence
  Description of Artificial Sequence: Synthetic peptide
DWRNINQNEDVDLLNIGGIDESIGKGAN

SEQ ID NO: 41190 - protein, 28 aa, Artificial Sequence
  Description of Artificial Sequence: Synthetic peptide
DIQNIGFNLKVTNDNVLLIDDAIGGGNG

SEQ ID NO: 41191 - protein, 28 aa, Artificial Sequence
  Description of Artificial Sequence: Synthetic peptide
EGQGLNTGHGFGQIGEGATADEAQNRTT

SEQ ID NO: 41192 - protein, 28 aa, Artificial Sequence
  Description of Artificial Sequence: Synthetic peptide
NGETADTVLNYSNSQGGHTASNAYGSAE

SEQ ID NO: 41193 - protein, 28 aa, Artificial Sequence
  Description of Artificial Sequence: Synthetic peptide
EGDLVTNQHGIFEEVLGGTATQVLYRCD

SEQ ID NO: 41194 - protein, 28 aa, Artificial Sequence
  Description of Artificial Sequence: Synthetic peptide
DEGGGADVNNYRWKVGGVTRDNHEYQTT

SEQ ID NO: 41195 - protein, 28 aa, Artificial Sequence
  Description of Artificial Sequence: Synthetic peptide
SENENIWDNNIFTDNLDELRDQVGSRTT

SEQ ID NO: 41196 - protein, 28 aa, Artificial Sequence
  Description of Artificial Sequence: Synthetic peptide
FEDNAANSTGFTNRNITGLSTDLVGSAT

SEQ ID NO: 41197 - protein, 28 aa, Artificial Sequence
  Description of Artificial Sequence: Synthetic peptide
DWQNLENNNNVTNDNVLLITQIIGGAAN

SEQ ID NO: 41198 - protein, 28 aa, Artificial Sequence
  Description of Artificial Sequence: Synthetic peptide
SGDGVTTGNIIATDELGMTVNGMVNTTT

SEQ ID NO: 41199 - protein, 28 aa, Artificial Sequence
  Description of Artificial Sequence: Synthetic peptide
EGDGLADGNNFARRIQSGTVDQTLWQTT

SEQ ID NO: 41200 - protein, 28 aa, Artificial Sequence
  Description of Artificial Sequence: Synthetic peptide
DWQNINFNNIVTNDNVLLQTDAIGKASG

SEQ ID NO: 41201 - protein, 28 aa, Artificial Sequence
  Description of Artificial Sequence: Synthetic peptide
DWQNTNFNNIVTNDNVLLQTDIIGGKTG

SEQ ID NO: 41202 - protein, 28 aa, Artificial Sequence
  Description of Artificial Sequence: Synthetic peptide
DWQNINFNLIVTEDNVLLRDDAIGGATG

SEQ ID NO: 41203 - protein, 28 aa, Artificial Sequence
  Description of Artificial Sequence: Synthetic peptide
DIQNLEFNNIVTNDNVLLITDIIGQGAG

SEQ ID NO: 41204 - protein, 28 aa, Artificial Sequence
  Description of Artificial Sequence: Synthetic peptide
EEEGWPQTSPTHFLHELNLHTPVPGKGD

SEQ ID NO: 41205 - protein, 28 aa, Artificial Sequence
  Description of Artificial Sequence: Synthetic peptide
DGQGGDIGNNTIEITQSGTVDQEQWRAT

SEQ ID NO: 41206 - protein, 28 aa, Artificial Sequence
  Description of Artificial Sequence: Synthetic peptide
DWQNIENNLIGTNDNVLLISDIIGGKNN

SEQ ID NO: 41207 - protein, 28 aa, Artificial Sequence
  Description of Artificial Sequence: Synthetic peptide
EEEGWPQTSPTHFEGELNLHFPIPGKGD

SEQ ID NO: 41208 - protein, 28 aa, Artificial Sequence
  Description of Artificial Sequence: Synthetic peptide
DWDETNATSDIILDRQDRTGNDLSSQNG

SEQ ID NO: 41209 - protein, 28 aa, Artificial Sequence
  Description of Artificial Sequence: Synthetic peptide
DWQNLNFNNNGTNDNVLLITDAIYGKNG

SEQ ID NO: 41210 - protein, 28 aa, Artificial Sequence
  Description of Artificial Sequence: Synthetic peptide
FDDEGATTNRNNNDGVDTTDTTILSNST

SEQ ID NO: 41211 - protein, 28 aa, Artificial Sequence
  Description of Artificial Sequence: Synthetic peptide
EDQGNIQGSIYHTEMWTETASNTENGGT

SEQ ID NO: 41212 - protein, 28 aa, Artificial Sequence
  Description of Artificial Sequence: Synthetic peptide
EEEGWPQTSPTHFDGELNLHTPIPGKGD

SEQ ID NO: 41213 - protein, 28 aa, Artificial Sequence
  Description of Artificial Sequence: Synthetic peptide
EEEGWPQTSPTHFDGILNLHTPIPGKGD

SEQ ID NO: 41214 - protein, 28 aa, Artificial Sequence
  Description of Artificial Sequence: Synthetic peptide
DDINLTNGSIVINDQWYTTTDQIAAKGT

SEQ ID NO: 41215 - protein, 28 aa, Artificial Sequence
  Description of Artificial Sequence: Synthetic peptide
EWQETNIENGYDTRVESEIVDDALNGAT

SEQ ID NO: 41216 - protein, 28 aa, Artificial Sequence
  Description of Artificial Sequence: Synthetic peptide
DWRNTNLTNDGTDDQVLLDSDAMYGKTG

SEQ ID NO: 41217 - protein, 28 aa, Artificial Sequence
  Description of Artificial Sequence: Synthetic peptide
DWQNINFNLITTNDNVLLIDDIIGGKNG

SEQ ID NO: 41218 - protein, 28 aa, Artificial Sequence
  Description of Artificial Sequence: Synthetic peptide
DNDGIQANSGYGWEMWGGTADQSQHQTN

SEQ ID NO: 41219 - protein, 28 aa, Artificial Sequence
  Description of Artificial Sequence: Synthetic peptide
DEIEGNDHHNYFQSTLTEIADQALHKAN

SEQ ID NO: 41220 - protein, 28 aa, Artificial Sequence
  Description of Artificial Sequence: Synthetic peptide
DGQNLIFNNIFTNDNVLLNTDTIYGKNG

SEQ ID NO: 41221 - protein, 28 aa, Artificial Sequence
  Description of Artificial Sequence: Synthetic peptide
DWQNTEFNSIGTNDIILTRSEAIYNGNT

SEQ ID NO: 41222 - protein, 28 aa, Artificial Sequence
  Description of Artificial Sequence: Synthetic peptide
SWDNINTSLGVTNDHLGNTTDEIQSKTV

SEQ ID NO: 41223 - protein, 28 aa, Artificial Sequence
  Description of Artificial Sequence: Synthetic peptide
SGDEVNATNGFSGDVLGGTTFQSQWKTT

SEQ ID NO: 41224 - protein, 28 aa, Artificial Sequence
  Description of Artificial Sequence: Synthetic peptide
EGSSIINTHIVHNRNQTSGDDQLGGSAT

SEQ ID NO: 41225 - protein, 28 aa, Artificial Sequence
  Description of Artificial Sequence: Synthetic peptide
DERGTINAHNIRYEILGGLRDQVEVQAN

SEQ ID NO: 41226 - protein, 28 aa, Artificial Sequence
  Description of Artificial Sequence: Synthetic peptide
DWQNINNNLIGTLDNVLLITDELGNATG

SEQ ID NO: 41227 - protein, 28 aa, Artificial Sequence
  Description of Artificial Sequence: Synthetic peptide
DDRGIQFTNRDHRLHVLATEDQVTSQAT

SEQ ID NO: 41228 - protein, 28 aa, Artificial Sequence
  Description of Artificial Sequence: Synthetic peptide
DENNLQTNNLRQNDTLHTRKNNVGGSTT

SEQ ID NO: 41229 - protein, 28 aa, Artificial Sequence
  Description of Artificial Sequence: Synthetic peptide
ETNITNTASDTDFEHELGLNDGHRGRGS

SEQ ID NO: 41230 - protein, 28 aa, Artificial Sequence
  Description of Artificial Sequence: Synthetic peptide
AGDAAGDTTNAMIDGYNNISSQLTVTGL

SEQ ID NO: 41231 - protein, 28 aa, Artificial Sequence
  Description of Artificial Sequence: Synthetic peptide
DWQNTNFTLGVTNDNVLLITDIIGGGTG

SEQ ID NO: 41232 - protein, 28 aa, Artificial Sequence
  Description of Artificial Sequence: Synthetic peptide
DWQNINFNNIVTNDNVLLIDDIIYGGAN

SEQ ID NO: 41233 - protein, 28 aa, Artificial Sequence
  Description of Artificial Sequence: Synthetic peptide
DWSHNSANNDFANDNVNTIASAILNTGE

SEQ ID NO: 41234 - protein, 28 aa, Artificial Sequence
  Description of Artificial Sequence: Synthetic peptide
DWQDINFNSGVTDDNVLLISQIIGRKTG

SEQ ID NO: 41235 - protein, 28 aa, Artificial Sequence
  Description of Artificial Sequence: Synthetic peptide
DELNWEANNNIGDRNRGMAANEAGGSGT

SEQ ID NO: 41236 - protein, 28 aa, Artificial Sequence
  Description of Artificial Sequence: Synthetic peptide
EEEGWPQTSPTHFLHILNLHTPIPGKGD

SEQ ID NO: 41237 - protein, 28 aa, Artificial Sequence
  Description of Artificial Sequence: Synthetic peptide
DERNGNLMNIVKLDTLDTTHDYTGNGAD

SEQ ID NO: 41238 - protein, 28 aa, Artificial Sequence
  Description of Artificial Sequence: Synthetic peptide
DWNNTNFNLIVTNDNWLTRTEALGGGTA

SEQ ID NO: 41239 - protein, 28 aa, Artificial Sequence
  Description of Artificial Sequence: Synthetic peptide
DGDNINNNNNITNRNLGGTRDQIGGKTN

SEQ ID NO: 41240 - protein, 28 aa, Artificial Sequence
  Description of Artificial Sequence: Synthetic peptide
SEIGTNTNSGTRWDVLGGTENDELYQAT

SEQ ID NO: 41241 - protein, 28 aa, Artificial Sequence
  Description of Artificial Sequence: Synthetic peptide
DEGGGAQTSIISGIGLTGTADINLNKDT

SEQ ID NO: 41242 - protein, 28 aa, Artificial Sequence
  Description of Artificial Sequence: Synthetic peptide
DEGEAADNNGYIQDIEGMTVDQAEYTTT

SEQ ID NO: 41243 - protein, 28 aa, Artificial Sequence
  Description of Artificial Sequence: Synthetic peptide
DEGGVQTNNNFTIRVLGGTRNISEASDS

SEQ ID NO: 41244 - protein, 28 aa, Artificial Sequence
  Description of Artificial Sequence: Synthetic peptide
DGIETNDHNNIRQNNGTGIANQSQYSAN

SEQ ID NO: 41245 - protein, 28 aa, Artificial Sequence
  Description of Artificial Sequence: Synthetic peptide
EEEGVNANNIVGSDKLTVLRDDNEYKAN

SEQ ID NO: 41246 - protein, 28 aa, Artificial Sequence
  Description of Artificial Sequence: Synthetic peptide
DGGTLNNTNNYINLILGLTDDQIGGKAV

SEQ ID NO: 41247 - protein, 28 aa, Artificial Sequence
  Description of Artificial Sequence: Synthetic peptide
DWQAVNNNSNVDENNVLTMSDNIYTGAA

SEQ ID NO: 41248 - protein, 28 aa, Artificial Sequence
  Description of Artificial Sequence: Synthetic peptide
DIGTGDNGNNFSQSIQTGTRDQCLYKGT

SEQ ID NO: 41249 - protein, 28 aa, Artificial Sequence
  Description of Artificial Sequence: Synthetic peptide
DWQEDNFNLIVTDNNVLTISDAIGRASG

SEQ ID NO: 41250 - protein, 28 aa, Artificial Sequence
  Description of Artificial Sequence: Synthetic peptide
NADGQNNELNIFTCTLGTVADQATRKGN

SEQ ID NO: 41251 - protein, 28 aa, Artificial Sequence
  Description of Artificial Sequence: Synthetic peptide
DENGGNNASGFIQENLNTTDNNQEFRVT

SEQ ID NO: 41252 - protein, 28 aa, Artificial Sequence
  Description of Artificial Sequence: Synthetic peptide
DGIETADGNNFGNDTQTMLRNIELYKAT

SEQ ID NO: 41253 - protein, 28 aa, Artificial Sequence
  Description of Artificial Sequence: Synthetic peptide
NEQNINSTSIQDEDILNLIRDNIGSKGI

SEQ ID NO: 41254 - protein, 28 aa, Artificial Sequence
  Description of Artificial Sequence: Synthetic peptide
DAQGGGFNENVTNDVLDITHENHGGRSG

SEQ ID NO: 41255 - protein, 28 aa, Artificial Sequence
  Description of Artificial Sequence: Synthetic peptide
EEQGWPQTSPTHFDGILNLHTPIGGKGD

SEQ ID NO: 41256 - protein, 28 aa, Artificial Sequence
  Description of Artificial Sequence: Synthetic peptide
DWNNTNFNLIVTEDNWLTRDEILGTATG

SEQ ID NO: 41257 - protein, 28 aa, Artificial Sequence
  Description of Artificial Sequence: Synthetic peptide
DWQNTNFNNIGTNDNTLLYTQIIGGATQ

SEQ ID NO: 41258 - protein, 28 aa, Artificial Sequence
  Description of Artificial Sequence: Synthetic peptide
FEQNTPFTSPPHNDGILNLTDPIGGKTG

SEQ ID NO: 41259 - protein, 28 aa, Artificial Sequence
  Description of Artificial Sequence: Synthetic peptide
DAQGWNDANNIIFDSLGGTVFQTQYLAT

SEQ ID NO: 41260 - protein, 28 aa, Artificial Sequence
  Description of Artificial Sequence: Synthetic peptide
DGLAGNNGNGGINEILNQTADAVLGAGG

SEQ ID NO: 41261 - protein, 28 aa, Artificial Sequence
  Description of Artificial Sequence: Synthetic peptide
DGDDGITNNNYILAGITTTDDQHQHSAT

SEQ ID NO: 41262 - protein, 28 aa, Artificial Sequence
  Description of Artificial Sequence: Synthetic peptide
NNEQINAANGINLSGQLTLEDGVENLGG

SEQ ID NO: 41263 - protein, 28 aa, Artificial Sequence
  Description of Artificial Sequence: Synthetic peptide
DWQNLNFNNIVTNDNVLLITDTIGTAAT

SEQ ID NO: 41264 - protein, 28 aa, Artificial Sequence
  Description of Artificial Sequence: Synthetic peptide
EEGGEQNGHNMIINVLTGTDDQIEYRAT

SEQ ID NO: 41265 - protein, 28 aa, Artificial Sequence
  Description of Artificial Sequence: Synthetic peptide
DWQNINFNEIVTNDNVLLIDDIIYGASA

SEQ ID NO: 41266 - protein, 28 aa, Artificial Sequence
  Description of Artificial Sequence: Synthetic peptide
DWNNTENTLIVTNDNVLLRNQIDYGKTG

SEQ ID NO: 41267 - protein, 28 aa, Artificial Sequence
  Description of Artificial Sequence: Synthetic peptide
DNQSLEEVLNVTEDNRDTRHQYVRSQSS

SEQ ID NO: 41268 - protein, 28 aa, Artificial Sequence
  Description of Artificial Sequence: Synthetic peptide
DKQGWTIGNNYDEAQGLNIEDNIRNKTT

SEQ ID NO: 41269 - protein, 28 aa, Artificial Sequence
  Description of Artificial Sequence: Synthetic peptide
DDSETNQVNNFDDRHELQTTDYLLELAN

SEQ ID NO: 41270 - protein, 28 aa, Artificial Sequence
  Description of Artificial Sequence: Synthetic peptide
DINNLINTLDVTNDNILTYDDYVYGAGA

SEQ ID NO: 41271 - protein, 28 aa, Artificial Sequence
  Description of Artificial Sequence: Synthetic peptide
DWQNTNFNNNGTDDNVLLITDIIGGATG

SEQ ID NO: 41272 - protein, 28 aa, Artificial Sequence
  Description of Artificial Sequence: Synthetic peptide
DGGIGAQNNIYSQQVLSGLMDQALAQAT

SEQ ID NO: 41273 - protein, 28 aa, Artificial Sequence
  Description of Artificial Sequence: Synthetic peptide
DGIDNADNNIFSQSILSGDAGQALYRAT

SEQ ID NO: 41274 - protein, 28 aa, Artificial Sequence
  Description of Artificial Sequence: Synthetic peptide
DWQNINFNLLTTNDNVLLIDDIIGGATG

SEQ ID NO: 41275 - protein, 28 aa, Artificial Sequence
  Description of Artificial Sequence: Synthetic peptide
DIQNINFNVNVTDDNWLLISDASGGAAG

SEQ ID NO: 41276 - protein, 28 aa, Artificial Sequence
  Description of Artificial Sequence: Synthetic peptide
DWQNINFNNIVTNDNVLLIDDAIGKATG

SEQ ID NO: 41277 - protein, 28 aa, Artificial Sequence
  Description of Artificial Sequence: Synthetic peptide
DWQNIEYNLNVTNDNVLLIDDIIGGKAN

SEQ ID NO: 41278 - protein, 28 aa, Artificial Sequence
  Description of Artificial Sequence: Synthetic peptide
DWQNTNFNLITTEDNWLLRTDIIYTETG

SEQ ID NO: 41279 - protein, 28 aa, Artificial Sequence
  Description of Artificial Sequence: Synthetic peptide
GWNGWNNNNIYDTDEGTALADDLSYGTN

SEQ ID NO: 41280 - protein, 28 aa, Artificial Sequence
  Description of Artificial Sequence: Synthetic peptide
DWQNINFNLIVTNDNVLTIDDAIGGGTG

SEQ ID NO: 41281 - protein, 28 aa, Artificial Sequence
  Description of Artificial Sequence: Synthetic peptide
DEIGWADNNGFFNDIQSMLRDNALNQTD

SEQ ID NO: 41282 - protein, 28 aa, Artificial Sequence
  Description of Artificial Sequence: Synthetic peptide
DWQNINFNSNVTDDNVLLIQDIIGGKTG

SEQ ID NO: 41283 - protein, 28 aa, Artificial Sequence
  Description of Artificial Sequence: Synthetic peptide
DWQNINFNLLTTEDNVLLRDDIGYTATG

SEQ ID NO: 41284 - protein, 28 aa, Artificial Sequence
  Description of Artificial Sequence: Synthetic peptide
DWQEVNNNLAVTNDNVLLISDTIYGATQ

SEQ ID NO: 41285 - protein, 28 aa, Artificial Sequence
  Description of Artificial Sequence: Synthetic peptide
NEDGDVQGNNTGQDVLTGTRGQDQFKTT

SEQ ID NO: 41286 - protein, 28 aa, Artificial Sequence
  Description of Artificial Sequence: Synthetic peptide
EEQGWPQTSPTHFDGELNLHTPIGGKGD

SEQ ID NO: 41287 - protein, 28 aa, Artificial Sequence
  Description of Artificial Sequence: Synthetic peptide
DGGGEDNVNGFIRDVQGATADQALNQTN

SEQ ID NO: 41288 - protein, 28 aa, Artificial Sequence
  Description of Artificial Sequence: Synthetic peptide
DIQNLNNTNIGTLDNVTLIRDIIGGGSG

SEQ ID NO: 41289 - protein, 28 aa, Artificial Sequence
  Description of Artificial Sequence: Synthetic peptide
DGGGGITNNNTRIRILTLTRDNITASAT

SEQ ID NO: 41290 - protein, 28 aa, Artificial Sequence
  Description of Artificial Sequence: Synthetic peptide
DGGSNQNSHAIINQNLTGTNDQLLYQGG

SEQ ID NO: 41291 - protein, 28 aa, Artificial Sequence
  Description of Artificial Sequence: Synthetic peptide
DEENNAIAHNYHIIKLSQTADQAQYKSN

SEQ ID NO: 41292 - protein, 28 aa, Artificial Sequence
  Description of Artificial Sequence: Synthetic peptide
AQDTGNNNNNVTLDIVDMTMDSCQWGSN

SEQ ID NO: 41293 - protein, 28 aa, Artificial Sequence
  Description of Artificial Sequence: Synthetic peptide
DGIGEAINNIFGIDIQSGTADQHLYQAT

SEQ ID NO: 41294 - protein, 28 aa, Artificial Sequence
  Description of Artificial Sequence: Synthetic peptide
DNGDLANNNIYSTEVLTMDMDQMLWQHT

SEQ ID NO: 41295 - protein, 28 aa, Artificial Sequence
  Description of Artificial Sequence: Synthetic peptide
DIQAIEFNEIVDNDNGLNRHADIGGATG

SEQ ID NO: 41296 - protein, 28 aa, Artificial Sequence
  Description of Artificial Sequence: Synthetic peptide
DWNELNNSLNIGRTNLSNVTDTMGSKTG

SEQ ID NO: 41297 - protein, 28 aa, Artificial Sequence
  Description of Artificial Sequence: Synthetic peptide
DEIGGSQDNINILRILDGTRNQWQTSTT

SEQ ID NO: 41298 - protein, 28 aa, Artificial Sequence
  Description of Artificial Sequence: Synthetic peptide
DGDISNDGNIIGQRDQSGTRDQALITST

SEQ ID NO: 41299 - protein, 28 aa, Artificial Sequence
  Description of Artificial Sequence: Synthetic peptide
DGRNSLENANIDTNSLLTMRTTAGNKTG

SEQ ID NO: 41300 - protein, 28 aa, Artificial Sequence
  Description of Artificial Sequence: Synthetic peptide
NGDETSETSNDITNNQLTLAFFLGNSTT

SEQ ID NO: 41301 - protein, 28 aa, Artificial Sequence
  Description of Artificial Sequence: Synthetic peptide
SESGGINVSGFRIDTLGETRDQTLWRAT

SEQ ID NO: 41302 - protein, 28 aa, Artificial Sequence
  Description of Artificial Sequence: Synthetic peptide
DGDNINNNNNITNRNLGGTRDPIGGKTN

SEQ ID NO: 41303 - protein, 28 aa, Artificial Sequence
  Description of Artificial Sequence: Synthetic peptide
DWNNINFNLIVTNDNVLTIDEAIGTGTQ

SEQ ID NO: 41304 - protein, 28 aa, Artificial Sequence
  Description of Artificial Sequence: Synthetic peptide
DGQGWQDNHNTINIVLTGTANNAQYQTT

SEQ ID NO: 41305 - protein, 28 aa, Artificial Sequence
  Description of Artificial Sequence: Synthetic peptide
DEVNINFAIDGTLDHSLTIDFAEGGKTT

SEQ ID NO: 41306 - protein, 28 aa, Artificial Sequence
  Description of Artificial Sequence: Synthetic peptide
DGQGEQVGNGRHFDILGMTRDDQQVQTT

SEQ ID NO: 41307 - protein, 28 aa, Artificial Sequence
  Description of Artificial Sequence: Synthetic peptide
DEIGNQDGSIVFIRILGGTDDQHLWQSS

SEQ ID NO: 41308 - protein, 28 aa, Artificial Sequence
  Description of Artificial Sequence: Synthetic peptide
EEGGGITHHIIGEDVYSGTRDRHEYQYD

SEQ ID NO: 41309 - protein, 28 aa, Artificial Sequence
  Description of Artificial Sequence: Synthetic peptide
EGIEEQTNSGVSWSILTGTDDQAQNKTN

SEQ ID NO: 41310 - protein, 28 aa, Artificial Sequence
  Description of Artificial Sequence: Synthetic peptide
DWQNINFNLNVNDDNVLTNTDAIYGATG

SEQ ID NO: 41311 - protein, 28 aa, Artificial Sequence
  Description of Artificial Sequence: Synthetic peptide
DEDGVDDAHGIIIDVSDMLRDRNQFKAT

SEQ ID NO: 41312 - protein, 28 aa, Artificial Sequence
  Description of Artificial Sequence: Synthetic peptide
EAQAWSFNNGITRSNVDTTADEIRSRGS

SEQ ID NO: 41313 - protein, 28 aa, Artificial Sequence
  Description of Artificial Sequence: Synthetic peptide
DWQNTNNNNLGTDDNVLLITDAIGIATG

SEQ ID NO: 41314 - protein, 28 aa, Artificial Sequence
  Description of Artificial Sequence: Synthetic peptide
SNNAIGLTEDLDDDNGNENSEAVRNASG

SEQ ID NO: 41315 - protein, 28 aa, Artificial Sequence
  Description of Artificial Sequence: Synthetic peptide
DEGNWANNNIYRRSILTKTEDQMETKCN

SEQ ID NO: 41316 - protein, 28 aa, Artificial Sequence
  Description of Artificial Sequence: Synthetic peptide
EGGGLNTAAGFINIIQGGTRDQIENKTQ

SEQ ID NO: 41317 - protein, 28 aa, Artificial Sequence
  Description of Artificial Sequence: Synthetic peptide
DDGGVDNGSIYINSIETGTVFQHQYQAN

SEQ ID NO: 41318 - protein, 28 aa, Artificial Sequence
  Description of Artificial Sequence: Synthetic peptide
DWQNLNFNLDGTNDNVLLRDDIIYGKAQ

SEQ ID NO: 41319 - protein, 28 aa, Artificial Sequence
  Description of Artificial Sequence: Synthetic peptide
VDQNINFNNNGLDDNVLLRTDAGGGATT

SEQ ID NO: 41320 - protein, 28 aa, Artificial Sequence
  Description of Artificial Sequence: Synthetic peptide
FEQNTPFTSPPHNDNILNLHDPIGGKTG

SEQ ID NO: 41321 - protein, 28 aa, Artificial Sequence
  Description of Artificial Sequence: Synthetic peptide
NDRNIVEVNNYIDDNLSRIDDQIRNSSG

SEQ ID NO: 41322 - protein, 28 aa, Artificial Sequence
  Description of Artificial Sequence: Synthetic peptide
ESNNILFNQDIQLDGVYLNDNVLSQKTT

SEQ ID NO: 41323 - protein, 28 aa, Artificial Sequence
  Description of Artificial Sequence: Synthetic peptide
DWQNTNLNLIGTNDIVLLIDDQIGGGAG

SEQ ID NO: 41324 - protein, 28 aa, Artificial Sequence
  Description of Artificial Sequence: Synthetic peptide
DGDDGSDIQIYRTRILDMDRDQVLYRAT

SEQ ID NO: 41325 - protein, 28 aa, Artificial Sequence
  Description of Artificial Sequence: Synthetic peptide
NGSALNNLSNVTEDVVYNRDQVVGGGAD

SEQ ID NO: 41326 - protein, 28 aa, Artificial Sequence
  Description of Artificial Sequence: Synthetic peptide
DGDGTEDGNNIRQRNLTATSDQALAKAT

SEQ ID NO: 41327 - protein, 28 aa, Artificial Sequence
  Description of Artificial Sequence: Synthetic peptide
DGGDGNQNNNEINDTTTGDRDQCQYQYN

SEQ ID NO: 41328 - protein, 28 aa, Artificial Sequence
  Description of Artificial Sequence: Synthetic peptide
DWQNTEFNSNGILDIVLTRDDVIGTATG

SEQ ID NO: 41329 - protein, 38 aa, Artificial Sequence
  Description of Artificial Sequence: Synthetic polypeptide
HEEPVLYTNFVAFYMRQYSIVFCVSMEQNTCTVGKLQY

SEQ ID NO: 41330 - protein, 41 aa, Artificial Sequence
  Description of Artificial Sequence: Synthetic polypeptide
SLECIRTTNPFAWQQSFMGSSSVIEVTMGGEPDLNEGDLCG

SEQ ID NO: 41331 - protein, 28 aa, Artificial Sequence
  Description of Artificial Sequence: Synthetic peptide
DIQNLNNNLLITNDNVLLIDDIIGTKTG

SEQ ID NO: 41332 - protein, 28 aa, Artificial Sequence
  Description of Artificial Sequence: Synthetic peptide
AGSATELLQIVTLDNQNTIHDSGGSKTS

SEQ ID NO: 41333 - protein, 28 aa, Artificial Sequence
  Description of Artificial Sequence: Synthetic peptide
NWQNLEFNNNGTGDNVLLIDDIIGTKTG

SEQ ID NO: 41334 - protein, 42 aa, Artificial Sequence
  Description of Artificial Sequence: Synthetic polypeptide
DPEIIRTTNPGATQMVWYWWMFMVHWCYPEPDPCCDDLFQHN

SEQ ID NO: 41335 - protein, 41 aa, Artificial Sequence
  Description of Artificial Sequence: Synthetic polypeptide
DPNYIRTTGPDAYAIYFIGMDYGFFCECDPPTDEIDMTEGS

SEQ ID NO: 41336 - protein, 42 aa, Artificial Sequence
  Description of Artificial Sequence: Synthetic polypeptide
LSEHIGTNFTFAHGYCCPNCVSDPAHPNVEVFIYLKHDGVMY

SEQ ID NO: 41337 - protein, 41 aa, Artificial Sequence
  Description of Artificial Sequence: Synthetic polypeptide
CHMYTHYVNTDICSCKFCWYIMMENWGEKHHLTILNTIMAV
